United States Patent 12,371,689 (ENGINEERED ENVELOPED VECTORS AND METHODS OF USE THEREOF) - sequence listing, part 3

SEQ ID NO: 7020 - protein, 255 aa, unidentified
MKALLALPLLLLLSTPPCAPQVSGIRGDALERFCLQQPLDCDDIYAQGYQSDGVYLIYPSGPSVPVPVFCDMTTEGGKWTVFQKRFNGSVSFFRGWNDYKLGFGRADGEYWLGLQNMHLLTLKQKYELRVDLEDFENNTAYAKYADFSISPNAVSAEEDGYTLFVAGFEDGGAGDSLSYHSGQKFSTFDRDQDLFVQNCAALSSGAFWFRSCHFANLNGFYLGGSHLSYANGINWAQWKGFYYSLKRTEMKIRRA

SEQ ID NO: 7021 - protein, 173 aa, unidentified
MSLLGPKVLLFLAAFIITSDWIPLGVNSQRGDDVTQATPETFTEDPNLVNDPATDETVLAVLADIAPSTDDLASLSEKNTTAECWDEKFTCTRLYSVHRPVKQCIHQLCFTSLRRMYIVNKEICSRLVCKEHEAMKDELCRQMAGLPPRRLRRSNYFRLPPCENVDLQRPNGL

SEQ ID NO: 7022 - protein, 387 aa, unidentified
MPRPRLLAALCGALLCAPSLLVALDICSKNPCHNGGLCEEISQEVRGDVFPSYTCTCLKGYAGNHCETKCVEPLGLENGNIANSQIAASSVRVTFLGLQHWVPELARLNRAGMVNAWTPSSNDDNPWIQVNLLRRMWVTGVVTQGASRLASHEYLKAFKVAYSLNGHEFDFIHDVNKKHKEFVGNWNKNAVHVNLFETPVEAQYVRLYPTSCHTACTLRFELLGCELNGCANPLGLKNNSIPDKQITASSSYKTWGLHLFSWNPSYARLDKQGNFNAWVAGSYGNDQWLQVDLGSSKEVTGIITQGARNFGSVQFVASYKVAYSNDSANWTEYQDPRTGSSKIFPGNWDNHSHKKNLFETPILARYVRILPVAWHNRIALRLELLGC

SEQ ID NO: 7023 - protein, 321 aa, unidentified
MQCRLPRGLAGALLTLLCMGLLCLRYHLNLSPQRVQGTPELSQPNPGPPKLQLHDVFIAVKTTRAFHRLRLELLLDTWVSRTREQTFVFTDSPDKGLQERLGSHLVVTNCSAEHSHPALSCKMAAEFDTFLASGLRWFCHVDDDNYVNPRALLQLLRAFPLARDVYVGRPSLNRPIHASEPQPHNRTRLVQFWFATGGAGFCINRKLALKMAPWASGSRFMDTSALIRLPDDCTMGYIIECKLGGRLQPSPLFHSHLETLQLLRTAQLPEQVTLSYGVFEGKLNVIKLQGPFSPEEDPSRFRSLHCLLYPDTPWCPQLGAR

SEQ ID NO: 7024 - protein, 3065 aa, unidentified
MEEKQQIILANQDGGTVAGAAPTFFVILKQPGNGKTDQGILVTNQDACALASSVSSPVKSKGKICLPADCTVGGITVTLDNNSMWNEFYHRSTEMILTKQGRRMFPYCRYWITGLDSNLKYILVMDISPVDNHRYKWNGRWWEPSGKAEPHVLGRVFIHPESPSTGHYWMHQPVSFYKLKLTNNTLDQEGHIILHSMHRYLPRLHLVPAEKAVEVIQLNGPGVHTFTFPQTEFFAVTAYQNIQITQLKIDYNPFAKGFRDDGLNNKPQRDGKQKNSSDQEGNNISSSSGHRVRLTEGQGSEIQPGDLDPLSRGHETSGKGLEKTSLNIKRDFLGFMDTDSALSEVPQLKQEISECLIASSFEDDSRVASPLDQNGSFNVVIKEEPLDDYDYELGECPEGVTVKQEETDEETDVYSNSDDDPILEKQLKRHNKVDNPEADHLSSKWLPSSPSGVAKAKMFKLDTGKMPVVYLEPCAVTRSTVKISELPDNMLSTSRKDKSSMLAELEYLPTYIENSNETAFCLGKESENGLRKHSPDLRVVQKYPLLKEPQWKYPDISDSISTERILDDSKDSVGDSLSGKEDLGRKRTTMLKIATAAKVVNANQNASPNVPGKRGRPRKLKLCKAGRPPKNTGKSLISTKNTPVSPGSTFPDVKPDLEDVDGVLFVSFESKEALDIHAVDGTTEESSSLQASTTNDSGYRARISQLEKELIEDLKTLRHKQVIHPGLQEVGLKLNSVDPTMSIDLKYLGVQLPLAPATSFPFWNLTGTNPASPDAGFPFVSRTGKTNDFTKIKGWRGKFHSASASRNEGGNSESSLKNRSAFCSDKLDEYLENEGKLMETSMGFSSNAPTSPVVYQLPTKSTSYVRTLDSVLKKQSTISPSTSYSLKPHSVPPVSRKAKSQNRQATFSGRTKSSYKSILPYPVSPKQKYSHVILGDKVTKNSSGIISENQANNFVVPTLDENIFPKQISLRQAQQQQQQQQGSRPPGLSKSQVKLMDLEDCALWEGKPRTYITEERADVSLTTLLTAQASLKTKPIHTIIRKRAPPCNNDFCRLGCVCSSLALEKRQPAHCRRPDCMFGCTCLKRKVVLVKGGSKTKHFQRKAAHRDPVFYDTLGEEAREEEEGIREEEEQLKEKKKRKKLEYTICETEPEQPVRHYPLWVKVEGEVDPEPVYIPTPSVIEPMKPLLLPQPEVLSPTVKGKLLTGIKSPRSYTPKPNPVIREEDKDPVYLYFESMMTCARVRVYERKKEDQRQPSSSSSPSPSFQQQTSCHSSPENHNNAKEPDSEQQPLKQLTCDLEDDSDKLQEKSWKSSCNEGESSSTSYMHQRSPGGPTKLIEIISDCNWEEDRNKILSILSQHINSNMPQSLKVGSFIIELASQRKSRGEKNPPVYSSRVKISMPSCQDQDDMAEKSGSETPDGPLSPGKMEDISPVQTDALDSVRERLHGGKGLPFYAGLSPAGKLVAYKRKPSSSTSGLIQVASNAKVAASRKPRTLLPSTSNSKMASSSGTATNRPGKNLKAFVPAKRPIAARPSPGGVFTQFVMSKVGALQQKIPGVSTPQTLAGTQKFSIRPSPVMVVTPVVSSEPVQVCSPVTAAVTTTTPQVFLENTTAVTPMTAISDVETKETTYSSGATTTGVVEVSETNTSTSVTSTQSTATVNLTKTTGITTPVASVAFPKSLVASPSTITLPVASTASTSLVVVTAAASSSMVTTPTSSLGSVPIILSGINGSPPVSQRPENAAQIPVATPQVSPNTVKRAGPRLLLIPVQQGSPTLRPVSNTQLQGHRMVLQPVRSPSGMNLFRHPNGQIVQLLPLHQLRGSNTQPNLQPVMFRNPGSVMGIRLPAPSKPSETPPSSTSSSAFSVMNPVIQAVGSSSAVNVITQAPSLLSSGASFVSQAGTLTLRISPPEPQSFASKTGSETKITYSSGGQPVGTASLIPLQSGSFALLQLPGQKPVPSSILQHVASLQMKRESQNPDQKDETNSIKREQETKKVLQSEGEAVDPEANVIKQNSGAATSEETLNDSLEDRGDHLDEECLPEEGCATVKPSEHSCITGSHTDQDYKDVNEEYGARNRKSSKEKVAVLEVRTISEKASNKTVQNLSKVQHQKLGDVKVEQQKGFDNPEENSSEFPVTFKEESKFELSGSKVMEQQSNLQPEAKEKECGDSLEKDRERWRKHLKGPLTRKCVGASQECKKEADEQLIKETKTCQENSDVFQQEQGISDLLGKSGITEDARVLKTECDSWSRISNPSAFSIVPRRAAKSSRGNGHFQGHLLLPGEQIQPKQEKKGGRSSADFTVLDLEEDDEDDNEKTDDSIDEIVDVVSDYQSEEVDDVEKNNCVEYIEDDEEHVDIETVEELSEEINVAHLKTTAAHTQSFKQPSCTHISADEKAAERSRKAPPIPLKLKPDYWSDKLQKEAEAFAYYRRTHTANERRRRGEMRDLFEKLKITLGLLHSSKVSKSLILTRAFSEIQGLTDQADKLIGQKNLLTRKRNILIRKVSSLSGKTEEVVLKKLEYIYAKQQALEAQKRKKKMGSDEFDISPRISKQQEGSSASSVDLGQMFINNRRGKPLILSRKKDQATENTSPLNTPHTSANLVMTPQGQLLTLKGPLFSGPVVAVSPDLLESDLKPQVAGSAVALPENDDLFMMPRIVNVTSLATEGGLVDMGGSKYPHEVPDSKPSDHLKDTVRNEDNSLEDKGRISSRGNRDGRVTLGPTQVFLANKDSGYPQIVDVSNMQKAQEFLPKKISGDMRGIQYKWKESESRGERVKSKDSSFHKLKMKDLKDSSIEMELRKVTSAIEEAALDSSELLTNMEDEDDTDETLTSLLNEIAFLNQQLNDDSVGLAELPSSMDTEFPGDARRAFISKVPPGSRATFQVEHLGTGLKELPDVQGESDSISPLLLHLEDDDFSENEKQLAEPASEPDVLKIVIDSEIKDSLLSNKKAIDGGKNTSGLPAEPESVSSPPTLHMKTGLENSNSTDTLWRPMPKLAPLGLKVANPSSDADGQSLKVMPCLAPIAAKVGSVGHKMNLTGNDQEGRESKVMPTLAPVVAKLGNSGASPSSAGK

SEQ ID NO: 7025 - protein, 447 aa, unidentified
MRFRIYKRKVLILTLVVAACGFVLWSSNGRQRKNEALAPPLLDAEPARGAGGRGGDHPSVAVGIRRVSNVSAASLVPAVPQPEADNLTLRYRSLVYQLNFDQTLRNVDKAGTWAPRELVLVVQVHNRPEYLRLLLDSLRKAQGIDNVLVIFSHDFWSTEINQLIAGVNFCPVLQVFFPFSIQLYPNEFPGSDPRDCPRDLPKNAALKLGCINAEYPDSFGHYREAKFSQTKHHWWWKLHFVWERVKILRDYAGLILFLEEDHYLAPDFYHVFKKMWKLKQQECPECDVLSLGTYSASRSFYGMADKVDVKTWKSTEHNMGLALTRNAYQKLIECTDTFCTYDDYNWDWTLQYLTVSCLPKFWKVLVPQIPRIFHAGDCGMHHKKTCRPSTQSAQIESLLNNNKQYMFPETLTISEKFTVVAISPPRKNGGWGDIRDHELCKSYRRLQ

SEQ ID NO: 7026 - protein, 533 aa, unidentified
MKMRRYKLFLMFCMAGLCLISFLHFFKTLSYVTFPRELASLSPNLVSSFFWNNAPVTPQASPEPGGPDLLRTPLYSHSPLLQPLPPSKAAEELHRVDLVLPEDTTEYFVRTKAGGVCFKPGTKMLERPPPGRPEEKPEGANGSSARRPPRYLLSARERTGGRGARRKWVECVCLPGWHGPSCGVPTVVQYSNLPTKERLVPREVPRRVINAINVNHEFDLLDVRFHELGDVVDAFVVCESNFTAYGEPRPLKFREMLTNGTFEYIRHKVLYVFLDHFPPGGRQDGWIADDYLRTFLTQDGVSRLRNLRPDDVFIIDDADEIPARDGVLFLKLYDGWTEPFAFHMRKSLYGFFWKQPGTLEVVSGCTVDMLQAVYGLDGIRLRRRQYYTMPNFRQYENRTGHILVQWSLGSPLHFAGWHCSWCFTPEGIYFKLVSAQNGDFPRWGDYEDKRDLNYIRGLIRTGGWFDGTQQEYPPADPSEHMYAPKYLLKNYDRFHYLLDNPYQEPRSTAAGGWRHRGPEGRPPARGKLDEAEV

SEQ ID NO: 7027 - protein, 535 aa, unidentified
MRLRNGTVATALAFITSFLTLSWYTTWQNGKEKLIAYQREFLALKERLRIAEHRISQRSSELNTIVQQFKRVGAETNGSKDALNKFSDNTLKLLKELTSKKSLQVPSIYYHLPHLLKNEGSLQPAVQIGNGRTGVSIVMGIPTVKREVKSYLIETLHSLIDNLYPEEKLDCVIVVFIGETDIDYVHGVVANLEKEFSKEISSGLVEVISPPESYYPDLTNLKETFGDSKERVRWRTKQNLDYCFLMMYAQEKGIYYIQLEDDIIVKQNYFNTIKNFALQLSSEEWMILEFSQLGFIGKMFQAPDLTLIVEFIFMFYKEKPIDWLLDHILWVKVCNPEKDAKHCDRQKANLRIRFRPSLFQHVGLHSSLSGKIQKLTDKDYMKPLLLKIHVNPPAEVSTSLKVYQGHTLEKTYMGEDFFWAITPIAGDYILFKFDKPVNVESYLFHSGNQEHPGDILLNTTVEVLPFKSEGLEISKETKDKRLEDGYFRIGKFENGVAEGMVDPSLNPISAFRLSVIQNSAVWAILNEIHIKKATN

SEQ ID NO: 7028 - protein, 548 aa, unidentified
MRLRNGTFLTLLLFCLCAFLSLSWYAALSGQKGDVVDVYQREFLALRDRLHAAEQESLKRSKELNLVLDEIKRAVSERQALRDGDGNRTWGRLTEDPRLKPWNGSHRHVLHLPTVFHHLPHLLAKESSLQPAVRVGQGRTGVSVVMGIPSVRREVHSYLTDTLHSLISELSPQEKEDSVIVVLIAETDSQYTSAVTENIKALFPTEIHSGLLEVISPSPHFYPDFSRLRESFGDPKERVRWRTKQNLDYCFLMMYAQSKGIYYVQLEDDIVAKPNYLSTMKNFALQQPSEDWMILEFSQLGFIGKMFKSLDLSLIVEFILMFYRDKPIDWLLDHILWVKVCNPEKDAKHCDRQKANLRIRFKPSLFQHVGTHSSLAGKIQKLKDKDFGKQALRKEHVNPPAEVSTSLKTYQHFTLEKAYLREDFFWAFTPAAGDFIRFRFFQPLRLERFFFRSGNIEHPEDKLFNTSVEVLPFDNPQSDKEALQEGRTATLRYPRSPDGYLQIGSFYKGVAEGEVDPAFGPLEALRLSIQTDSPVWVILSEIFLKKAD

SEQ ID NO: 7029 - protein, 103 aa, unidentified
MKSLILLAILAALAVVTLCYESHESMESYELNPFINRRNANTFISPQQRWRAKVQERIRERSKPVHELNREACDDYRLCERYAMVYGYNAAYNRYFRKRRGTK

SEQ ID NO: 7030 - protein, 147 aa, unidentified; identical to SEQ ID NO: 2636

SEQ ID NO: 7031 - protein, 131 aa, unidentified
MARSLVCLGVIILLSAFSGPGVRGGPMPKLADRKLCADQECSHPISMAVALQDYMAPDCRFLTIHRGQVVYVFSKLKGRGRLFWGGSVQGDYYGDLAARLGYFPSSIVREDQTLKPGKVDVKTDKWDFYCQ

SEQ ID NO: 7032 - protein, 1412 aa, unidentified
MAKFGVHRILLLAISLTKCLESTKLLADLKKCGDLECEALINRVSAMRDYRGPDCRYLNFTKGEEISVYVKLAGEREDLWAGSKGKEFGYFPRDAVQIEEVFISEEIQMSTKESDFLCLLGVSYTFDNEDSELNGDYGENIYPYEEDKDEKSSIYESDFQIEPGFYATYESTLFEDQVPALEAPEDIGSTSESKDWEEVVVESMEQDRIPEVHVPPSSAVSGVKEWFGLGGEQAEEKAFESVIEPVQESSFRSRKIAVEDENDLEELNNGEPQTEHQQESESEIDSVPKTQSELASESEHIPKPQSTGWFGGGFTSYLGFGDEDTGLELIAEESNPPLQDFPNSISSDKEATVPCTEILTEKKDTITNDSLSLKPSWFDFGFAILGFAYAKEDKIMLDDRKNEEDGGADEHEHPLTSELDPEKEQEIETIKIIETEDQIDKKPVSEKTDESDTIPYLKKFLYNFDNPWNFQNIPKETELPFPKQILDQNNVIENEETGEFSIDNYPTDNTKVMIFKSSYSLSDMVSNIELPTRIHEEVYFEPSSSKDSDENSKPSVDTEGPALVEIDRSVENTLLNSQMVSTDNSLSSQNYISQKEDASEFQILKYLFQIDVYDFMNSAFSPIVILTERVVAALPEGMRPDSNLYGFPWELVICAAVVGFFAVLFFLWRSFRSVRSRLYVGREKKLALMLSGLIEEKSKLLEKFSLVQKEYEGYEVESSLKDASFEKEATEAQSLEATCEKLNRSNSELEDEILCLEKELKEEKSKHSEQDELMADISKRIQSLEDESKSLKSQVAEAKMTFKIFQMNEERLKIAIKDALNENSQLQESQKQLLQEAEVWKEQVSELNKQKVTFEDSKVHAEQVLNDKESHIKTLTERLLKMKDWAAMLGEDITDDDNLELEMNSESENGAYLDNPPKGALKKLIHAAKLNASLKTLEGERNQIYIQLSEVDKTKEELTEHIKNLQTEQASLQSENTHFENENQKLQQKLKVMTELYQENEMKLHRKLTVEENYRLEKEEKLSKVDEKISHATEELETYRKRAKDLEEELERTIHSYQGQIISHEKKAHDNWLAARNAERNLNDLRKENAHNRQKLTETELKFELLEKDPYALDVPNTAFGREHSPYGPSPLGWPSSETRAFLSPPTLLEGPLRLSPLLPGGGGRGSRGPGNPLDHQITNERGESSCDRLTDPHRAPSDTGSLSPPWDQDRRMMFPPPGQSYPDSALPPQRQDRFCSNSGRLSGPAELRSFNMPSLDKMDGSMPSEMESSRNDTKDDLGNLNVPDSSLPAENEATGPGFVPPPLAPIRGPLFPVDARGPFLRRGPPFPPPPPGAMFGASRDYFPPGDFPGPPPAPFAMRNVYPPRGFPPYLPPRPGFFPPPPHSEGRSEFPSGLIPPSNEPATEHPEPQQET

SEQ ID NO: 7033 - protein, 1907 aa, unidentified; identical to SEQ ID NO: 2638

SEQ ID NO: 7034 - protein, 476 aa, unidentified
MFRLNSLSALAELAVGSRWYHGGSQPIQIRRRLMMVAFLGASAVTASTGLLWKRAHAESPPCVDNLKSDIGDKGKNKDEGDVCNHEKKTADLAPHPEEKKKKRSGFRDRKVMEYENRIRAYSTPDKIFRYFATLKVISEPGEAEVFMTPEDFVRSITPNEKQPEHLGLDQYIIKRFDGKKISQEREKFADEGSIFYTLGECGLISFSDYIFLTTVLSTPQRNFEIAFKMFDLNGDGEVDMEEFEQVQSIIRSQTSMGMRHRDRPTTGNTLKSGLCSALTTYFFGADLKGKLTIKNFLEFQRKLQHDVLKLEFERHDPVDGRITERQFGGMLLAYSGVQSKKLTAMQRQLKKHFKEGKGLTFQEVENFFTFLKNINDVDTALSFYHMAGASLDKVTMQQVARTVAKVELSDHVCDVVFALFDCDGNGELSNKEFVSIMKQRLMRGLEKPKDMGFTRLMQAMWKCAQETAWDFALPKQ

SEQ ID NO: 7035 - protein, 512 aa, unidentified
MAEPSVESSSPGGSATSDDHEFDPSADMLVHDFDDERTLEEEEMMEGETNFSSEIEDLAREGDMPIHELLSLYGYGSTVRLPEEDEEEEEEEEEGEDDEDADNDDNSGCSGENKEENIKDSSGQEDETQSSNDDPSQSVASQDAQEIIRPRRCKYFDTNSEVEEESEEDEDYIPSEDWKKEIMVGSMFQAEIPVGICRYKENEKVYENDDQLLWDPEYLPEDKVIIFLKDASRRTGDEKGVEAIPEGSHIKDNEQALYELVKCNFDTEEALRRLRFNVKAAREELSVWTEEECRNFEQGLKAYGKDFHLIQANKVRTRSVGECVAFYYMWKKSERYDFFAQQTRFGKKKYNLHPGVTDYMDRLLDESESAASSRAPSPPPTASNSSNSQSEKEDGTVSTANQNGVSSNGPGEILNKEEVKVEGLHINGPTGGNKKPLHADMDTNGYETDNLTTDPKLAHMTARNENDFDEKSERPAKRRRVNSNGKESPGSSEFFQEAVSHGKFEELENTDD

SEQ ID NO: 7036 - protein, 487 aa, unidentified
MLRAPGCLLRTSVAPAAALAAALLSSLARCSLLEPRDPVASSLSPYFGTKTRYEDVNPVLLSGPEAPWRDPELLEGTCTPVQLVALIRHGTRYPTVKQIRKLRQLHGLLQARGSRDGGASSTGSRDLGAALADWPLWYADWMDGQLVEKGRQDMRQLALRLASLFPALFSRENYGRLRLITSSKHRCMDSSAAFLQGLWQHYHPGLPPPDVADMEFGPPTVNDKLMRFFDHCEKFLTEVEKNATALYHVEAFKTGPEMQNILKKVAATLQVPVNDLNADLIQVAFFTCSFDLAIKGVKSPWCDVFDIDDAKVLEYLNDLKQYWKRGYGYTINSRSSCTLFQDIFQHLDKAVEQKQRSQPISSPVILQFGHAETLLPLLSLMGYFKDKEPLTAYNYKKQMHRKFRSGLIVPYASNLIFVLYHCENAKTPKEQFRVQMLLNEKVLPLAYSQETVSFYEDLKNHYKDILQSCQTSEECELARANSTSDEL

SEQ ID NO: 7037 - protein, 292 aa, unidentified; identical to SEQ ID NO: 2655

SEQ ID NO: 7038 - protein, 115 aa, unidentified
MVSRKAVAALLVVHVAAMLASQTEAFVPIFTYGELQRMQEKERNKGQKKSLSVWQRSGEEGPVDPAEPIREEENEMIKLTAPLEIGMRMNSRQLEKYPATLEGLLSEMLPQHAAK

SEQ ID NO: 7039 - protein, 919 aa, unidentified
MAADVFMCSPRRPRSRGRQVLLKPQVSEDDDDSDTDEPSPPPASGAATPARAHASAAPPPPRAGPGREEPPRRQQIIHSGHFMVSSPHREHPPKKGYDFDTVNKQTCQTYSFGKTSSCHLSIDASLTKLFECMTLAYSGKLVSPKWKNFKGLKLQWRDKIRLNNAIWRAWYMQYLEKRKNPVCHFVTPLDGSVDVDEHRRPEAITTEGKYWKSRIEIVIREYHKWRTYFKKRLQQHKDEDLSSLVQDDDMLYWHKHGDGWKTPVPMEEDPLLDTDMLMSEFSDTLFSTLSSHQPVAWPNPREIAHLGNADMIQPGLIPLQPNLDFMDTFEPFQDLFSSSRSIFGSMLPASASAPVPDPNNPPAQESILPTTALPTVSLPDSLIAPPTAPSLAHMDEQGCEHTSRTEDPFIQPTDFGPSEPPLSVPQPFLPVFTMPLLSPSPAPPPISPVLPLVPPPATALNPPAPPTFHQPQKFAGVNKAPSVITHTASATLTHDAPATTFSQSQGLVITTHHPAPSAAPCGLALSPVTRPPQPRLTFVHPKPVSLTGGRPKQPHKIVPAPKPEPVSLVLKNARIAPAAFSGQPQAVIMTSGPLKREGMLASTVSQSNVVIAPAAIARAPGVPEFHSSILVTDLGHGTSSPPAPVSRLFPSTAQDPLGKGEQVPLHGGSPQVTVTGPSRDCPNSGQASPCASEQSPSPQSPQNNCSGKSDPKNVAALKNRQMKHISAEQKRRFNIKMCFDMLNSLISNNSKLTSHAITLQKTVEYITKLQQERGQMQEEARRLREEIEELNATIISCQQLLPATGVPVTRRQFDHMKDMFDEYVKTRTLQNWKFWIFSIIIKPLFESFKGMVSTSSLEELHRTALSWLDQHCSLPILRPMVLSTLRQLSTSTSILTDPAQLPEQASKAVTRIGKRLGES

SEQ ID NO: 7040 - protein, 852 aa, unidentified
MAGALAGLAAGLQVPRVAPSPDSDSDTDSEDPSLRRSAGGLLRSQVIHSGHFMVSSPHSDSLPRRRDQEGSVGPSDFGPRSIDPTLTRLFECLSLAYSGKLVSPKWKNFKGLKLLCRDKIRLNNAIWRAWYIQYVKRRKSPVCGFVTPLQGPEADAHRKPEAVVLEGNYWKRRIEVVMREYHKWRIYYKKRLRKPSREDDLLAPKQAEGRWPPPEQWCKQLFSSVVPVLLGDPEEEPGGRQLLDLNCFLSDISDTLFTMTQSGPSPLQLPPEDAYVGNADMIQPDLTPLQPSLDDFMDISDFFTNSRLPQPPMPSNFPEPPSFSPVVDSLFSSGTLGPEVPPASSAMTHLSGHSRLQARNSCPGPLDSSAFLSSDFLLPEDPKPRLPPPPVPPPLLHYPPPAKVPGLEPCPPPPFPPMAPPTALLQEEPLFSPRFPFPTVPPAPGVSPLPAPAAFPPTPQSVPSPAPTPFPIELLPLGYSEPAFGPCFSMPRGKPPAPSPRGQKASPPTLAPATASPPTTAGSNNPCLTQLLTAAKPEQALEPPLVSSTLLRSPGSPQETVPEFPCTFLPPTPAPTPPRPPPGPATLAPSRPLLVPKAERLSPPAPSGSERRLSGDLSSMPGPGTLSVRVSPPQPILSRGRPDSNKTENRRITHISAEQKRRFNIKLGFDTLHGLVSTLSAQPSLKVSKATTLQKTAEYILMLQQERAGLQEEAQQLRDEIEELNAAINLCQQQLPATGVPITHQRFDQMRDMFDDYVRTRTLHNWKFWVFSILIRPLFESFNGMVSTASVHTLRQTSLAWLDQYCSLPALRPTVLNSLRQLGTSTSILTDPGRIPEQATRAVTEGTLGKPL

SEQ ID NO: 7041 - protein, 469 aa, unidentified
MHSFPPLLLLLFWGVVSHSFPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRIENYTPDLPRADVDHAIEKAFQLWSNVTPLTFTKVSEGQADIMISFVRGDHRDNSPFDGPGGNLAHAFQPGPGIGGDAHFDEDERWTNNFREYNLHRVAAHELGHSLGLSHSTDIGALMYPSYTFSGDVQLAQDDIDGIQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 7042 - protein, 476 aa, unidentified
MMHLAFLVLLCLPVCSAYPLSGAAKEEDSNKDLAQQYLEKYYNLEKDVKQFRRKDSNLIVKKIQGMQKFLGLEVTGKLDTDTLEVMRKPRCGVPDVGHFSSFPGMPKWRKTHLTYRIVNYTPDLPRDAVDSAIEKALKVWEEVTPLTFSRLYEGEADIMISFAVKEHGDFYSFDGPGHSLAHAYPPGPGLYGDIHFDDDEKWTEDASGTNLFLVAAHELGHSLGLFHSANTEALMYPLYNSFTELAQFRLSQDDVNGIQSLYGPPPASTEEPLVPTKSVPSGSEMPAKCDPALSFDAISTLRGEYLFFKDRYFWRRSHWNPEPEFHLISAFWPSLPSYLDAAYEVNSRDTVFIFKGNEFWAIRGNEVQAGYPRGIHTLGFPPTIRKIDAAVSDKEKKKTYFFAADKYWRFDENSQSMEQGFPRLIADDFPGVEPKVDAVLQAFGFFYFFSGSSQFEFDPNARMVTHILKSNSWLHC

SEQ ID NO: 7043 - protein, 488 aa, unidentified
MAPAAWLRSAAARALLPPMLLLLLQPPPLLARALPPDAHHLHAERRGPQPWHAALPSSPAPAPATQEAPRPASSLRPPRCGVPDPSDGLSARNRQKRFVLSGGRWEKTDLTYRILRFPWQLVQEQVRQTMAEALKVWSDVTPLTFTEVHEGRADIMIDFARYWHGDDLPFDGPGGILAHAFFPKTHREGDVHFDYDETWTIGDDQGTDLLQVAAHEFGHVLGLQHTTAAKALMSAFYTFRYPLSLSPDDCRGVQHLYGQPWPTVTSRTPALGPQAGIDTNEIAPLEPDAPPDACEASFDAVSTIRGELFFFKAGFVWRLRGGQLQPGYPALASRHWQGLPSPVDAAFEDAQGHIWFFQGAQYWVYDGEKPVLGPAPLTELGLVRFPVHAALVWGPEKNKIYFFRGRDYWRFHPSTRRVDSPVPRRATDWRGVPSEIDAAFQDADGYAYFLRGRLYWKFDPVKVKALEGFPRLVGPDFFGCAEPANTFL

SEQ ID NO: 7044 - protein, 470 aa, unidentified
MKFLLILLLQATASGALPLNSSTSLEKNNVLFGERYLEKFYGLEINKLPVTKMKYSGNLMKEKIQEMQHFLGLKVTGQLDTSTLEMMHAPRCGVPDVHHFREMPGGPVWRKHYITYRINNYTPDMNREDVDYAIRKAFQVWSNVTPLKFSKINTGMADILVVFARGAHGDFHAFDGKGGILAHAFGPGSGIGGDAHFDEDEFWTTHSGGTNLFLTAVHEIGHSLGLGHSSDPKAVMFPTYKYVDINTFRLSADDIRGIQSLYGDPKENQRLPNPDNSEPALCDPNLSFDAVTTVGNKIFFFKDRFFWLKVSERPKTSVNLISSLWPTLPSGIEAAYEIEARNQVFLFKDDKYWLISNLRPEPNYPKSIHSFGFPNFVKKIDAAVFNPRFYRTYFFVDNQYWRYDERRQMMDPGYPKLITKNFQGIGPKIDAVFYSKNKYYYFFQGSNQFEYDFLLQRITKTLKSNSWFGC

SEQ ID NO: 7045 - protein, 489 aa, unidentified
MHPGVLAAFLFLSWTHCRALPLPSGGDEDDLSEEDLQFAERYLRSYYHPTNLAGILKENAASSMTERLREMQSFFGLEVTGKLDDNTLDVMKKPRCGVPDVGEYNVFPRTLKWSKMNLTYRIVNYTPDMTHSEVEKAFKKAFKVWSDVTPLNFTRLHDGIADIMISFGIKEHGDFYPFDGPSGLLAHAFPPGPNYGGDAHFDDDETWTSSSKGYNLFLVAAHEFGHSLGLDHSKDPGALMFPIYTYTGKSHFMLPDDDVQGIQSLYGPGDEDPNPKHPKTPDKCDPSLSLDAITSLRGETMIFKDRFFWRLHPQQVDAELFLTKSFWPELPNRIDAAYEHPSHDLIFIFRGRKFWALNGYDILEGYPKKISELGLPKEVKKISAAVHFEDTGKTLLFSGNQVWRYDDTNHIMDKDYPRLIEEDFPGIGDKVDAVYEKNESHSVTQAGVHCRNLSSLQPPPPGFKRFSCLSLWSSWDYRLYLFFQRTHTV

SEQ ID NO: 7046 - protein, 582 aa, unidentified; identical to SEQ ID NO: 2662

SEQ ID NO: 7047 - protein, 603 aa, unidentified
MRRRAARGPGPPPPGPGLSRLPLPLLLLLALGTRGGCAAPAPAPRAEDLSLGVEWLSRFGYLPPADPTTGQLQTQEELSKAITAMQQFGGLEATGILDEATLALMKTPRCSLPDLPVLTQARRRRQAPAPTKWNKRNLSWRVRTFPRDSPLGHDTVRALMYYALKVWSDIAPLNFHEVAGSAADIQIDFSKADHNDGYPFDGPGGTVAHAFFPGHHHTAGDTHFDDDEAWTFRSSDAHGMDLFAVAVHEFGHAIGLSHVAAAHSIMRPYYQGPVGDPLRYGLPYEDKVRVWQLYGVRESVSPTAQPEEPPLLPEPPDNRSSAPPRKDVPHRCSTHFDAVAQIRGEAFFFKGKYFWRLTRDRHLVSLQPAQMHRFWRGLPLHLDSVDAVYERTSDHKIVFFKGDRYWVFKDNNVEEGYPRPVSDFSLPPGGIDAAFSWAHNDRTYFFKDQLYWRYDDHTRHMDPGYPAQSPLWRGVPSTLDDAMRWSDGASYFFRGQEYWKVLDGELEVAPGYPQSTARDWLVCGDSQADGSVAAGVDAAEGPRAPPGQHDQSRSEDGYEVCSCTSGASSPPGAPGPLVAATMLLLLPPLSPGALWTAAQALTL

SEQ ID NO: 7048 - protein, 508 aa, unidentified
MNCQQLWLGFLLPMTVSGRVLGLAEVAPVDYLSQYGYLQKPLEGSNNFKPEDITEALRAFQEASELPVSGQLDDATRARMRQPRCGLEDPFNQKTLKYLLLGRWRKKHLTFRILNLPSTLPPHTARAALRQAFQDWSNVAPLTFQEVQAGAADIRLSFHGRQSSYCSNTFDGPGRVLAHADIPELGSVHFDEDEFWTEGTYRGVNLRIIAAHEVGHALGLGHSRYSQALMAPVYEGYRPHFKLHPDDVAGIQALYGKKSPVIRDEEEEETELPTVPPVPTEPSPMPDPCSSELDAMMLGPRGKTYAFKGDYVWTVSDSGPGPLFRVSALWEGLPGNLDAAVYSPRTQWIHFFKGDKVWRYINFKMSPGFPKKLNRVEPNLDAALYWPLNQKVFLFKGSGYWQWDELARTDFSSYPKPIKGLFTGVPNQPSAAMSWQDGRVYFFKGKVYWRLNQQLRVEKGYPRNISHNWMHCRPRTIDTTPSGGNTTPSGTGITLDTTLSATETTFEY

SEQ ID NO: 7049 - protein, 660 aa, unidentified
MEALMARGALTGPLRALCLLGCLLSHAAAAPSPIIKFPGDVAPKTDKELAVQYLNTFYGCPKESCNLFVLKDTLKKMQKFFGLPQTGDLDQNTIETMRKPRCGNPDVANYNFFPRKPKWDKNQITYRIIGYTPDLDPETVDDAFARAFQVWSDVTPLRFSRIHDGEADIMINFGRWEHGDGYPFDGKDGLLAHAFAPGTGVGGDSHFDDDELWTLGEGQVVRVKYGNADGEYCKFPFLFNGKEYNSCTDTGRSDGFLWCSTTYNFEKDGKYGFCPHEALFTMGGNAEGQPCKFPFRFQGTSYDSCTTEGRTDGYRWCGTTEDYDRDKKYGFCPETAMSTVGGNSEGAPCVFPFTFLGNKYESCTSAGRSDGKMWCATTANYDDDRKWGFCPDQGYSLFLVAAHEFGHAMGLEHSQDPGALMAPIYTYTKNFRLSQDDIKGIQELYGASPDIDLGTGPTPTLGPVTPEICKQDIVFDGIAQIRGEIFFFKDRFIWRTVTPRDKPMGPLLVATFWPELPEKIDAVYEAPQEEKAVFFAGNEYWIYSASTLERGYPKPLTSLGLPPDVQRVDAAFNWSKNKKTYIFAGDKFWRYNEVKKKMDPGFPKLIADAWNAIPDNLDAVVDLQGGGHSYFFKGAYYLKLENQSLKSVKFGSIKSDWLGC

SEQ ID NO: 7050 - protein, 483 aa, unidentified
MKVLPASGLAVFLIMALKFSTAAPSLVAASPRTWRNNYRLAQAYLDKYYTNKEGHQIGEMVARGSNSMIRKIKELQAFFGLQVTGKLDQTTMNVIKKPRCGVPDVANYRLFPGEPKWKKNTLTYRISKYTPSMSSVEVDKAVEMALQAWSSAVPLSFVRINSGEADIMISFENGDHGDSYPFDGPRGTLAHAFAPGEGLGGDTHFDNAEKWTMGTNGFNLFTVAAHEFGHALGLAHSTDPSALMYPTYKYKNPYGFHLPKDDVKGIQALYGPRKVFLGKPTLPHAPHHKPSIPDLCDSSSSFDAVTMLGKELLLFKDRIFWRRQVHLRTGIRPSTITSSFPQLMSNVDAAYEVAERGTAYFFKGPHYWITRGFQMQGPPRTIYDFGFPRHVQQIDAAVYLREPQKTLFFVGDEYYSYDERKRKMEKDYPKNTEEEFSGVNGQIDAAVELNGYIYFFSGPKTYKYDTEKEDVVSVVKSSSWIGC

SEQ ID NO: 7051 - protein, 569 aa, unidentified
MLAASIFRPTLLLCWLAAPWPTQPESLFHSRDRSDLEPSPLRQAKPIADLHAAQRFLSRYGWSGVWAAWGPSPEGPPETPKGAALAEAVRRFQRANALPASGELDAATLAAMNRPRCGVPDMRPPPPSAPPSPPGPPPRARSRRSPRAPLSLSRRGWQPRGYPDGGAAQAFSKRTLSWRLLGEALSSQLSVADQRRIVALAFRMWSEVTPLDFREDLAAPGAAVDIKLGFGRGRHLGCPRAFDGSGQEFAHAWRLGDIHFDDDEHFTPPTSDTGISLLKVAVHEIGHVLGLPHTYRTGSIMQPNYIPQEPAFELDWSDRKAIQKLYGSCEGSFDTAFDWIRKERNQYGEVMVRFSTYFFRNSWYWLYENRNNRTRYGDPIQILTGWPGIPTHNIDAFVHIWTWKRDERYFFQGNQYWRYDSDKDQALTEDEQGKSYPKLISEGFPGIPSPLDTAFYDRRQKLIYFFKESLVFAFDVNRNRVLNSYPKRITEVFPAVIPQNHPFRNIDSAYYSYAYNSIFFFKGNAYWKVVNDKDKQQNSWLPANGLFPKKFISEKWFDVCDVHISTLNM

SEQ ID NO: 7052 - protein, 562 aa, unidentified
MRLRLRLLALLLLLLAPPARAPKPSAQDVSLGVDWLTRYGYLPPPHPAQAQLQSPEKLRDAIKVMQRFAGLPETGRMDPGTVATMRKPRCSLPDVLGVAGLVRRRRRYALSGSVWKKRTLTWRVRSFPQSSQLSQETVRVLMSYALMAWGMESGLTFHEVDSPQGQEPDILIDFARAFHQDSYPFDGLGGTLAHAFFPGEHPISGDTHFDDEETWTFGSKDGEGTDLFAVAVHEFGHALGLGHSSAPNSIMRPFYQGPVGDPDKYRLSQDDRDGLQQLYGKAPQTPYDKPTRKPLAPPPQPPASPTHSPSFPIPDRCEGNFDAIANIRGETFFFKGPWFWRLQPSGQLVSPRPARLHRFWEGLPAQVRVVQAAYARHRDGRILLFSGPQFWVFQDRQLEGGARPLTELGLPPGEEVDAVFSWPQNGKTYLVRGRQYWRYDEAAARPDPGYPRDLSLWEGAPPSPDDVTVSNAGDTYFFKGAHYWRFPKNSIKTEPDAPQPMGPNWLDCPAPSSGPRAPRPPKATPVSETCDCQCELNQAAGRWPAPIPLLLLPLLVGGVASR

SEQ ID NO: 7053 - protein, 261 aa, unidentified
MQLVILRVTIFLPWCFAVPVPPAADHKGWDFVEGYFHQFFLTKKESPLLTQETQTQLLQQFHRNGTDLLDMQMHALLHQPHCGVPDGSDTSISPGRCKWNKHTLTYRIINYPHDMKPSAVKDSIYNAVSIWSNVTPLIFQQVQNGDADIKVSFWQWAHEDGWPFDGPGGILGHAFLPNSGNPGVVHFDKNEHWSASDTGYNLFLVATHEIGHSLGLQHSGNQSSIMYPTYWYHDPRTFQLSADDIQRIQHLYGEKCSSDIP

SEQ ID NO: 7054 - protein, 513 aa, unidentified
MKRLLLLFLFFITFSSAFPLVRMTENEENMQLAQAYLNQFYSLEIEGNHLVQSKNRSLIDDKIREMQAFFGLTVTGKLDSNTLEIMKTPRCGVPDVGQYGYTLPGWRKYNLTYRIINYTPDMARAAVDEAIQEGLEVWSKVTPLKFTKISKGIADIMIAFRTRVHGRCPRYFDGPLGVLGHAFPPGPGLGGDTHFDEDENWTKDGAGFNLFLVAAHEFGHALGLSHSNDQTALMFPNYVSLDPRKYPLSQDDINGIQSIYGGLPKEPAKPKEPTIPHACDPDLTFDAITTFRREVMFFKGRHLWRIYYDITDVEFELIASFWPSLPADLQAAYENPRDKILVFKDENFWMIRGYAVLPDYPKSIHTLGFPGRVKKIDAAVCDKTTRKTYFFVGIWCWRFDEMTQTMDKGFPQRVVKHFPGISIRVDAAFQYKGFFFFSRGSKQFEYDIKTKNITRIMRTNTWFQCKEPKNSSFGFDINKEKAHSGGIKILYHKSLSLFIFGIVHLLKNTSIYQ

SEQ ID NO: 7055 - protein, 477 aa, unidentified
MKSLPILLLLCVAVCSAYPLDGAARGEDTSMNLVQKYLENYYDLKKDVKQFVRRKDSGPVVKKIREMQKFLGLEVTGKLDSDTLEVMRKPRCGVPDVGHFRTFPGIPKWRKTHLTYRIVNYTPDLPKDAVDSAVEKALKVWEEVTPLTFSRLYEGEADIMISFAVREHGDFYPFDGPGNVLAHAYAPGPGINGDAHFDDDEQWTKDTTGTNLFLVAAHEIGHSLGLFHSANTEALMYPLYHSLTDLTRFRLSQDDINGIQSLYGPPPDSPETPLVPTEPVPPEPGTPANCDPALSFDAVSTLRGEILIFKDRHFWRKSLRKLEPELHLISSFWPSLPSGVDAAYEVTSKDLVFIFKGNQFWAIRGNEVRAGYPRGIHTLGFPPTVRKIDAAISDKEKNKTYFFVEDKYWRFDEKRNSMEPGFPKQIAEDFPGIDSKIDAVFEEFGFFYFFTGSSQLEFDPNAKKVTHTLKSNSWLNC

SEQ ID NO: 7056 - protein, 267 aa, unidentified
MRLTVLCAVCLLPGSLALPLPQEAGGMSELQWEQAQDYLKRFYLYDSETKNANSLEAKLKEMQKFFGLPITGMLNSRVIEIMQKPRCGVPDVAEYSLFPNSPKWTSKVVTYRIVSYTRDLPHITVDRLVSKALNMWGKEIPLHFRKVVWGTADIMIGFARGAHGDSYPFDGPGNTLAHAFAPGTGLGGDAHFDEDERWTDGSSLGINFLYAATHELGHSLGMGHSSDPNAVMYPTYGNGDPQNFKLSQDDIKGIQKLYGKRSNSRKK

SEQ ID NO: 7057 - protein, 467 aa, unidentified [sequence omitted]

SEQ ID NO: 7058 - protein, 707 aa, unidentified
MSLWQPLVLVLLVLGCCFAAPRQRQSTLVLFPGDLRTNLTDRQLAEEYLYRYGYTRVAEMRGESKSLGPALLLLQKQLSLPETGELDSATLKAMRTPRCGVPDLGRFQTFEGDLKWHHHNITYWIQNYSEDLPRAVIDDAFARAFALWSAVTPLTFTRVYSRDADIVIQFGVAEHGDGYPFDGKDGLLAHAFPPGPGIQGDAHFDDDELWSLGKGVVVPTRFGNADGAACHFPFIFEGRSYSACTTDGRSDGLPWCSTTANYDTDDRFGFCPSERLYTQDGNADGKPCQFPFIFQGQSYSACTTDGRSDGYRWCATTANYDRDKLFGFCPTRADSTVMGGNSAGELCVFPFTFLGKEYSTCTSEGRGDGRLWCATTSNFDSDKKWGFCPDQGYSLFLVAAHEFGHALGLDHSSVPEALMYPMYRFTEGPPLHKDDVNGIRHLYGPRPEPEPRPPTTTTPQPTAPPTVCPTGPPTVHPSERPTAGPTGPPSAGPTGPPTAGPSTATTVPLSPVDDACNVNIFDAIAEIGNQLYLFKDGKYWRFSEGRGSRPQGPFLIADKWPALPRKLDSVFEERLSKKLFFFSGRQVWVYTGASVLGPRRLDKLGLGADVAQVTGALRSGRGKMLLFSGRRLWRFDVKAQMVDPRSASEVDRMFPGVPLDTHDVFQYREKAYFCQDRFYWRVSSRSELNQVDQVGYVTYDILQCPED

SEQ ID NO: 7059 - protein, 1228 aa, unidentified
MKGARLFVLLSSLWSGGIGLNNSKHSWTIPEDGNSQKTMPSASVPPNKIQSLQILPTTRVMSAEIATTPEARTSEDSLLKSTLPPSETSAPAEGVRNQTLTSTEKAEGVVKLQNLTLPTNASIKFNPGAESVVLSNSTLKFLQSFARKSNEQATSLNTVGGTGGIGGVGGTGGVGNRAPRETYLSRGDSSSSQRTDYQKSNFETTRGKNWCAYVHTRLSPTVILDNQVTYVPGGKGPCGWTGGSCPQRSQKISNPVYRMQHKIVTSLDWRCCPGYSGPKCQLRAQEQQSLIHTNQAESHTAVGRGVAEQQQQQGCGDPEVMQKMTDQVNYQAMKLTLLQKKIDNISLTVNDVRNTYSSLEGKVSEDKSREFQSLLKGLKSKSINVLIRDIVREQFKIFQNDMQETVAQLFKTVSSLSEDLESTRQIIQKVNESVVSIAAQQKFVLVQENRPTLTDIVELRNHIVNVRQEMTLTCEKPIKELEVKQTHLEGALEQEHSRSILYYESLNKTLSKLKEVHEQLLSTEQVSDQKNAPAAESVSNNVTEYMSTLHENIKKQSLMMLQMFEDLHIQESKINNLTVSLEMEKESLRGECEDMLSKCRNDFKFQLKDTEENLHVLNQTLAEVLFPMDNKMDKMSEQLNDLTYDMEILQPLLEQGASLRQTMTYEQPKEAIVIRKKIENLTSAVNSLNFIIKELTKRHNLLRNEVQGRDDALERRINEYALEMEDGLNKTMTIINNAIDFIQDNYALKETLSTIKDNSEIHHKCTSDMETILTFIPQFHRLNDSIQTLVNDNQRYNFVLQVAKTLAGIPRDEKLNQSNFQKMYQMFNETTSQVRKYQQNMSHLEEKLLLTTKISKNFETRLQDIESKVTQTLIPYYISVKKGSVVTNERDQALQLQVLNSRFKALEAKSIHLSINFFSLNKTLHEVLTMCHNASTSVSELNATIPKWIKHSLPDIQLLQKGLTEFVEPIIQIKTQAALSNLTCCIDRSLPGSLANVVKSQKQVKSLPKKINALKKPTVNLTTVLIGRTQRNTDNIIYPEEYSSCSRHPCQNGGTCINGRTSFTCACRHPFTGDNCTIKLVEENALAPDFSKGSYRYAPMVAFFASHTYGMTIPGPILFNNLDVNYGASYTPRTGKFRIPYLGVYVFKYTIESFSAHISGFLVVDGIDKLAFESENINSEIHCDRVLTGDALLELNYGQEVWLRLAKGTIPAKFPPVTTFSGYLLYRT

SEQ ID NO: 7060 - protein, 949 aa, unidentified
MILSLLFSLGGPLGWGLLGAWAQASSTSLSDLQSSRTPGVWKAEAEDTGKDPVGRNWCPYPMSKLVTLLALCKTEKFLIHSQQPCPQGAPDCQKVKVMYRMAHKPVYQVKQKVLTSLAWRCCPGYTGPNCEHHDSMAIPEPADPGDSHQEPQDGPVSFKPGHLAAVINEVEVQQEQQEHLLGDLQNDVHRVADSLPGLWKALPGNLTAAVMEANQTGHEFPDRSLEQVLLPHVDTFLQVHFSPIWRSFNQSLHSLTQAIRNLSLDVEANRQAISRVQDSAVARADFQELGAKFEAKVQENTQRVGQLRQDVEDRLHAQHFTLHRSISELQADVDTKLKRLHKAQEAPGTNGSLVLATPGAGARPEPDSLQARLGQLQRNLSELHMTTARREEELQYTLEDMRATLTRHVDEIKELYSESDETFDQISKVERQVEELQVNHTALRELRVILMEKSLIMEENKEEVERQLLELNLTLQHLQGGHADLIKYVKDCNCQKLYLDLDVIREGQRDATRALEETQVSLDERRQLDGSSLQALQNAVDAVSLAVDAHKAEGERARAATSRLRSQVQALDDEVGALKAAAAEARHEVRQLHSAFAALLEDALRHEAVLAALFGEEVLEEMSEQTPGPLPLSYEQIRVALQDAASGLQEQALGWDELAARVTALEQASEPPRPAEHLEPSHDAGREEAATTALAGLARELQSLSNDVKNVGRCCEAEAGAGAASLNASLHGLHNALFATQRSLEQHQRLFHSLFGNFQGLMEANVSLDLGKLQTMLSRKGKKQQKDLEAPRKRDKKEAEPLVDIRVTGPVPGALGAALWEAGSPVAFYASFSEGTAALQTVKFNTTYINIGSSYFPEHGYFRAPERGVYLFAVSVEFGPGPGTGQLVFGGHHRTPVCTTGQGSGSTATVFAMAELQKGERVWFELTQGSITKRSLSGTAFGGFLMFKT

SEQ ID NO: 7061 - protein, 613 aa, unidentified; identical to SEQ ID NO: 2674

SEQ ID NO: 7062 - protein, 241 aa, unidentified; identical to SEQ ID NO: 2680

SEQ ID NO: 7063 - protein, 745 aa, unidentified
MGVPFFSSLRCMVDLGPCWAGGLTAEMKLLLALAGLLAILATPQPSEGAAPAVLGEVDTSLVLSSMEEAKQLVDKAYKERRESIKQRLRSGSASPMELLSYFKQPVAATRTAVRAADYLHVALDLLERKLRSLWRRPFNVTDVLTPAQLNVLSKSSGCAYQDVGVTCPEQDKYRTITGMCNNRRSPTLGASNRAFVRWLPAEYEDGFSLPYGWTPGVKRNGFPVALARAVSNEIVRFPTDQLTPDQERSLMFMQWGQLLDHDLDFTPEPAARASFVTGVNCETSCVQQPPCFPLKIPPNDPRIKNQADCIPFFRSCPACPGSNITIRNQINALTSFVDASMVYGSEEPLARNLRNMSNQLGLLAVNQRFQDNGRALLPFDNLHDDPCLLTNRSARIPCFLAGDTRSSEMPELTSMHTLLLREHNRLATELKSLNPRWDGERLYQEARKIVGAMVQIITYRDYLPLVLGPTAMRKYLPTYRSYNDSVDPRIANVFTNAFRYGHTLIQPFMFRLDNRYQPMEPNPRVPLSRVFFASWRVVLEGGIDPILRGLMATPAKLNRQNQIAVDEIRERLFEQVMRIGLDLPALNMQRSRDHGLPGYNAWRRFCGLPQPETVGQLGTVLRNLKLARKLMEQYGTPNNIDIWMGGVSEPLKRKGRVGPLLACIIGTQFRKLRDGDRFWWENEGVFSMQQRQALAQISLPRIICDNTGITTVSKNNIFMSNSYPRDFVNCSTLPALNLASWREAS

SEQ ID NO: 7064 - protein, 326 aa, unidentified
MWRSRWDASVLKAEALALLPCGLGMAFSQSHVMAARRHQHSRLIIEVDEYSSNPTQAFTFYNINQGRFQPPHVQMVDPVPHDAPKPPGYTRFVCVSDTHSRTDPIQMPYGDVLIHAGDFTELGLPSEVKKFNEWLGSLPYEYKIVIAGNHELTFDQEFMADLIKQDFYYFPSVSKLKPENYENVQSLLTNCIYLQDSEVTVRGFRIYGSPWQPWFYGWGFNLPRGQALLEKWNLIPEGVDILITHGPPLGFLDWVPKKMQRVGCVELLNTVQRRVQPRLHVFGHIHEGYGVMADGTTTYVNASVCTVNYQPVNPPIVIDLPTPRNS

SEQ ID NO: 7065 - protein, 269 aa, unidentified; identical to SEQ ID NO: 2687

SEQ ID NO: 7066 - protein, 341 aa, unidentified; identical to SEQ ID NO: 2690

SEQ ID NO: 7067 - protein, 305 aa, unidentified [sequence omitted]

SEQ ID NO: 7068 - protein, 205 aa, unidentified
MAASSLTVTLGRLASACSHSILRPSGPGAASLWSASRRFNSQSTSYLPGYVPKTSLSSPPWPEVVLPDPVEETRHHAEVVKKVNEMIVTGQYGRLFAVVHFASRQWKVTSEDLILIGNELDLACGERIRLEKVLLVGADNFTLLGKPLLGKDLVRVEATVIEKTESWPRIIMRFRKRKNFKKKRIVTTPQTVLRINSIEIAPCLL

SEQ ID NO: 7069 - protein, 206 aa, unidentified
MAAAVLGQLGALWIHNLRSRGKLALGVLPQSYIHTSASLDISRKWEKKNKIVYPPQLPGEPRRPAEIYHCRRQIKYSKDKMWYLAKLIRGMSIDQALAQLEFNDKKGAKIIKEVLLEAQDMAVRDHNVEFRSNLYIAESTSGRGQCLKRIRYHGRGRFGIMEKVYCHYFVKLVEGPPPPPEPPKTAVAHAKEYIQQLRSRTIVHTL

SEQ ID NO: 7070 - protein, 216 aa, unidentified
MRLSALLALASKVTLPPHYRYGMSPPGSVADKRKNPPWIRRRPVVVEPISDEDWYLFCGDTVEILEGKDAGKQGKVVQVIRQRNWVVVGGLNTHYRYIGKTMDYRGTMIPSEAPLLHRQVKLVDPMDRKPTEIEWRFTEAGERVRVSTRSGRIIPKPEFPRADGIVPETWIDGPKDTSVEDALERTYVPCLKTLQEEVMEAMGIKETRKYKKVYWY

SEQ ID NO: 7071 - protein, 148 aa, unidentified
MASVVLALRTRTAVTSLLSPTPATALAVRYASKKSGGSSKNLGGKSSGRRQGIKKMEGHYVHAGNIIATQRHFRWHPGAHVGVGKNKCLYALEEGIVRYTKEVYVPHPRNTEAVDLITRLPKGAVLYKTFVHVVPAKPEGTFKLVAML

SEQ ID NO: 7072 - protein, 188 aa, unidentified [sequence omitted]

SEQ ID NO: 7073 - protein, 92 aa, unidentified [sequence omitted]

SEQ ID NO: 7074 - protein, 188 aa, unidentified [sequence omitted]

SEQ ID NO: 7075 - protein, 128 aa, unidentified
MAAVGSLLGRLRQSTVKATGPALRRLHTSSWRADSSRASLTRVHRQAYARLYPVLLVKQDGSTIHIRYREPRRMLAMPIDLDTLSPEERRARLRKREAQLQSRKEYEQELSDDLHVERYRQFWTRTKK

SEQ ID NO: 7076 - protein, 128 aa, unidentified
MAAFMLGSLLRTFKQMVPSSASGQVRSHYVDWRMWRDVKRRKMAYEYADERLRINSLRKNTILPKILQDVADEEIAALPRDSCPVRIRNRCVMTSRPRGVKRRWRLSRIVFRHLADHGQLSGIQRATW

SEQ ID NO: 7077 - protein, 360 aa, unidentified
MAPLGTTVLLWSLLRSSPGVERVCFRARIQPWHGGLLQPLPCSFEMGLPRRRFSSEAAESGSPETKKPTFMDEEVQSILTKMTGLNLQKTFKPAIQELKPPTYKLMTQAQLEEATRQAVEAAKVRLKMPPVLEERVPINDVLAEDKILEGTETTKYVFTDISYSIPHRERFIVVREPSGTLRKASWEERDRMIQVYFPKEGRKILTPIIFKEENLRTMYSQDRHVDVLNLCFAQFEPDSTEYIKVHHKTYEDIDKRGKYDLLRSTRYFGGMVWYFVNNKKIDGLLIDQIQRDLIDDATNLVQLYHVLHPDGQSAQGAKDQAAEGINLIKVFAKTEAQKGAYIELTLQTYQEALSRHSAAS

SEQ ID NO: 7078 - protein, 187 aa, unidentified
MAALCRTRAVAAESHFLRVFLFFRPFRGVGTESGSESGSSNAKEPKTRAGGFASALERHSELLQKVEPLQKGSPKNVESFASMLRHSPLTQMGPAKDKLVIGRIFHIVENDLYIDFGGKFHCVCRRPEVDGEKYQKGTRVRLRLLDLELTSRFLGATTDTTVLEANAVLLGIQESKDSRSKEEHHEK

SEQ ID NO: 7079 - protein, 679 aa, unidentified; identical to SEQ ID NO: 2709

SEQ ID NO: 7080 - protein, 214 aa, unidentified; identical to SEQ ID NO: 2712

SEQ ID NO: 7081 - protein, 1137 aa, unidentified
MSRRKPASGGLAASSSAPARQAVLSRFFQSTGSLKSTSSSTGAADQVDPGAAAAAAAAAAAAPPAPPAPAFPPQLPPHIATEIDRRKKRPLENDGPVKKKVKKVQQKEGGSDLGMSGNSEPKKCLRTRNVSKSLEKLKEFCCDSALPQSRVQTESLQERFAVLPKCTDFDDISLLHAKNAVSSEDSKRQINQKDTTLFDLSQFGSSNTSHENLQKTASKSANKRSKSIYTPLELQYIEMKQQHKDAVLCVECGYKYRFFGEDAEIAARELNIYCHLDHNFMTASIPTHRLFVHVRRLVAKGYKVGVVKQTETAALKAIGDNRSSLFSRKLTALYTKSTLIGEDVNPLIKLDDAVNVDEIMTDTSTSYLLCISENKENVRDKKKGNIFIGIVGVQPATGEVVFDSFQDSASRSELETRMSSLQPVELLLPSALSEQTEALIHRATSVSVQDDRIRVERMDNIYFEYSHAFQAVTEFYAKDTVDIKGSQIISGIVNLEKPVICSLAAIIKYLKEFNLEKMLSKPENFKQLSSKMEFMTINGTTLRNLEILQNQTDMKTKGSLLWVLDHTKTSFGRRKLKKWVTQPLLKLREINARLDAVSEVLHSESSVFGQIENHLRKLPDIERGLCSIYHKKCSTQEFFLIVKTLYHLKSEFQAIIPAVNSHIQSDLLRTVILEIPELLSPVEHYLKILNEQAAKVGDKTELFKDLSDFPLIKKRKDEIQGVIDEIRMHLQEIRKILKNPSAQYVTVSGQEFMIEIKNSAVSCIPTDWVKVGSTKAVSRFHSPFIVENYRHLNQLREQLVLDCSAEWLDFLEKFSEHYHSLCKAVHHLATVDCIFSLAKVAKQGDYCRPTVQEERKIVIKNGRHPVIDVLLGEQDQYVPNNTDLSEDSERVMIITGPNMGGKSSYIKQVALITIMAQIGSYVPAEEATIGIVDGIFTRMGAADNIYKGQSTFMEELTDTAEIIRKATSQSLVILDELGRGTSTHDGIAIAYATLEYFIRDVKSLTLFVTHYPPVCELEKNYSHQVGNYHMGFLVSEDESKLDPGAAEQVPDFVTFLYQITRGIAARSYGLNVAKLADVPGEILKKAAHKSKELEGLINTKRKRLKYFAKLWTMHNAQDLQKWTEEFNMEETQTSLLH

SEQ ID NO: 7082 - protein, 834 aa, unidentified
MASLGANPRRTPQGPRPGAASSGFPSPAPVPGPREAEEEEVEEEEELAEIHLCVLWNSGYLGIAYYDTSDSTIHFMPDAPDHESLKLLQRVLDEINPQSVVTSAKQDENMTRFLGKLASQEHREPKRPEIIFLPSVDFGLEISKQRLLSGNYSFIPDAMTATEKILFLSSIIPFDCLLTVRALGGLLKFLGRRRIGVELEDYNVSVPILGFKKFMLTHLVNIDQDTYSVLQIFKSESHPSVYKVASGLKEGLSLFGILNRCHCKWGEKLLRLWFTRPTHDLGELSSRLDVIQFFLLPQNLDMAQMLHRLLGHIKNVPLILKRMKLSHTKVSDWQVLYKTVYSALGLRDACRSLPQSIQLFRDIAQEFSDDLHHIASLIGKVVDFEGSLAENRFTVLPNIDPEIDEKKRRLMGLPSFLTEVARKELENLDSRIPSCSVIYIPLIGFLLSIPRLPSMVEASDFEINGLDFMFLSEEKLHYRSARTKELDALLGDLHCEIRDQETLLMYQLQCQVLARAAVLTRVLDLASRLDVLLALASAARDYGYSRPRYSPQVLGVRIQNGRHPLMELCARTFVPNSTECGGDKGRVKVITGPNSSGKSIYLKQVGLITFMALVGSFVPAEEAEIGAVDAIFTRIHSCESISLGLSTFMIDLNQVAKAVNNATAQSLVLIDEFGKGTNTVDGLALLAAVLRHWLARGPTCPHIFVATNFLSLVQLQLLPQGPLVQYLTMETCEDGNDLVFFYQVCEGVAKASHASHTAAQAGLPDKLVARGKEVSDLIRSGKPIKPVKDLLKKNQMENCQTLVDKFMKLDLEDPNLDLNVFMSQEVLPAATSIL

SEQ ID NO: 7083 - protein, 630 aa, unidentified; identical to SEQ ID NO: 2720

SEQ ID NO: 7084 - protein, 114 aa, unidentified
MNVLLGSVVIFATFVTLCNASCYFIPNEGVPGDSTRKCMDLKGNKHPINSEWQTDNCETCTCYETEISCCTLVSTPVGYDKDNCQRIFKKEDCKYIVVEKKDPKKTCSVSEWII

SEQ ID NO: 7085 - protein, 235 aa, unidentified
MLSATRRACQLLLLHSLFPVPRMGNSASNIVSPQEALPGRKEQTPVAAKHHVNGNRTVEPFPEGTQMAVFGMGCFWGAERKFWVLKGVYSTQVGFAGGYTSNPTYKEVCSEKTGHAEVVRVVYQPEHMSFEELLKVFWENHDPTQGMRQGNDHGTQYRSAIYPTSAKQMEAALSSKENYQKVLSEHGFGPITTDIREGQTFYYAEDYHQQYLSKNPNGYCGLGGTGVSCPVGIKK

SEQ ID NO: 7086 - protein, 182 aa, unidentified
MARLLWLLRGLTLGTAPRRAVRGQAGGGGPGTGPGLGEAGSLATCELPLAKSEWQKKLTPEQFYVTREKGTEPPFSGIYLNNKEAGMYHCVCCDSPLFSSEKKYCSGTGWPSFSEAHGTSGSDESHTGILRRLDTSLGSARTEVVCKQCEAHLGHVFPDGPGPNGQRFCINSVALKFKPRKH

SEQ ID NO: 7087 - protein, 192 aa, unidentified
MSPRRTLPRPLSLCLSLCLCLCLAAALGSAQSGSCRDKKNCKVVFSQQELRKRLTPLQYHVTQEKGTESAFEGEYTHHKDPGIYKCVVCGTPLFKSETKFDSGSGWPSFHDVINSEAITFTDDFSYGMHRVETSCSQCGAHLGHIFDDGPRPTGKRYCINSAALSFTPADSSGTAEGGSGVASPAQADKAEL

SEQ ID NO: 7088 - protein, 711 aa, unidentified
MGWLPLLLLLTQCLGVPGQRSPLNDFQVLRGTELQHLLHAVVPGPWQEDVADAEECAGRCGPLMDCRAFHYNVSSHGCQLLPWTQHSPHTRLRRSGRCDLFQKKDYVRTCIMNNGVGYRGTMATTVGGLPCQAWSHKFPNDHKYTPTLRNGLEENFCRNPDGDPGGPWCYTTDPAVRFQSCGIKSCREAACVWCNGEEYRGAVDRTESGRECQRWDLQHPHQHPFEPGKFLDQGLDDNYCRNPDGSERPWCYTTDPQIEREFCDLPRCGSEAQPRQEATTVSCFRGKGEGYRGTANTTTAGVPCQRWDAQIPHQHRFTPEKYACKDLRENFCRNPDGSEAPWCFTLRPGMRAAFCYQIRRCTDDVRPQDCYHGAGEQYRGTVSKTRKGVQCQRWSAETPHKPQFTFTSEPHAQLEENFCRNPDGDSHGPWCYTMDPRTPFDYCALRRCADDQPPSILDPPDQVQFEKCGKRVDRLDQRRSKLRVVGGHPGNSPWTVSLRNRQGQHFCGGSLVKEQWILTARQCFSSCHMPLTGYEVWLGTLFQNPQHGEPSLQRVPVAKMVCGPSGSQLVLLKLERSVTLNQRVALICLPPEWYVVPPGTKCEIAGWGETKGTGNDTVLNVALLNVISNQECNIKHRGRVRESEMCTEGLLAPVGACEGDYGGPLACFTHNCWVLEGIIIPNRVCARSRWPAVFTRVSVFVDWIHKVMRLG

SEQ ID NO: 7089 - protein, 375 aa, unidentified
MQKLQLCVYIYLFMLIVAGPVDLNENSEQKENVEKEGLCNACTWRQNTKSSRIEAIKIQILSKLRLETAPNISKDVIRQLLPKAPPLRELIDQYDVQRDDSSDGSLEDDDYHATTETIITMPTESDFLMQVDGKPKCCFFKFSSKIQYNKVVKAQLWIYLRPVETPTTVFVQILRLIKPMKDGTRYTGIRSLKLDMNPGTGIWQSIDVKTVLQNWLKQPESNLGIEIKALDENGHDLAVTFPGPGEDGLNPFLEVKVTDTPKRSRRDFGLDCDEHSTESRCCRYPLTVDFEAFGWDWIIAPKRYKANYCSGECEFVFLQKYPHTHLVHQANPRGSAGPCCTPTKMSPINMLYFNGKEQIIYGKIPAMVVDRCGCS

SEQ ID NO: 7090 - protein, 62 aa, unidentified
MDPNCSCAAAGVSCTCASSCKCKECKCTSCKKSCCSCCPVGCAKCAQGCICKGASEKCSCCA

SEQ ID NO: 7091 - protein, 350 aa, unidentified
MAATSLMSALAARLLQPAHSCSLRLRPFHLAAVRNEAVVISGRKLAQQIKQEVRQEVEEWVASGNKRPHLSVILVGENPASHSYVLNKTRAAAVVGINSETIMKPASISEEELLNLINKLNNDDNVDGLLVQLPLPEHIDERRICNAVSPDKDVDGFHVINVGRMCLDQYSMLPATPWGVWEIIKRTGIPTLGKNVVVAGRSKNVGMPIAMLLHTDGAHERPGGDATVTISHRYTPKEQLKKHTILADIVISAAGIPNLITADMIKEGAAVIDVGINRVHDPVTAKPKLVGDVDFEGVRQKAGYITPVPGGVGPMTVAMLMKNTIIAAKKVLRLEEREVLKSKELGVATN

SEQ ID NO: 7092 - protein, 650 aa, unidentified
MAGARAAAAAASAGSSASSGNQPPQELGLGELLEEFSRTQYRAKDGSGTGGSKVERIEKRCLELFGRDYCFSVIPNTNGDICGHYPRHIVFLEYESSEKEKDTFESTVQVSKLQDLIHRSKMARCRGRFVCPVILFKGKHICRSATLAGWGELYGRSGYNYFFSGGADDAWADVEDVTEEDCALRSGDTHLFDKVRGYDIKLLRYLSVKYICDLMVENKKVKFGMNVTSSEKVDKAQRYADFTLLSIPYPGCEFFKEYKDRDYMAEGLIFNWKQDYVDAPLSIPDFLTHSLNIDWSQYQCWDLVQQTQNYLKLLLSLVNSDDDSGLLVHCISGWDRTPLFISLLRLSLWADGLIHTSLKPTEILYLTVAYDWFLFGHMLVDRLSKGEEIFFFCFNFLKHITSEEFSALKTQRRKSLPARDGGFTLEDICMLRRKDRGSTTSLGSDFSLVMESSPGATGSFTYEAVELVPAGAPTQAAWRKSHSSSPQSVLWNRPQPSEDRLPSQQGLAEARSSSSSSSNHSDNFFRMGSSPLEVPKPRSVDHPLPGSSLSTDYGSWQMVTGCGSIQERAVLHTDSSLPFSFPDELPNSCLLAALSDRETRLQEVRSAFLAAYSSTVGLRAVAPSPSGAIGGLLEQFARGVGLRSISSNAL

SEQ ID NO: 7093 - protein, 698 aa, unidentified
MRRFLLLYATQQGQAKAIAEEICEQAVVHGFSADLHCISESDKYDLKTETAPLVVVVSTTGTGDPPDTARKFVKEIQNQTLPVDFFAHLRYGLLGLGDSEYTYFCNGGKIIDKRLQELGARHFYDTGHADDCVGLELVVEPWIAGLWPALRKHFRSSRGQEEISGALPVASPASSRTDLVKSELLHIESQVELLRFDDSGRKDSEVLKQNAVNSNQSNVVIEDFESSLTRSVPPLSQASLNIPGLPPEYLQVHLQESLGQEESQVSVTSADPVFQVPISKAVQLTTNDAIKTTLLVELDISNTDFSYQPGDAFSVICPNSDSEVQSLLQRLQLEDKREHCVLLKIKADTKKKGATLPQHIPAGCSLQFIFTWCLEIRAIPKKAFLRALVDYTSDSAEKRRLQELCSKQGAADYSRFVRDACACLLDLLLAFPSCQPPLSLLLEHLPKLQPRPYSCASSSLFHPGKLHFVFNIVEFLSTATTEVLRKGVCTGWLALLVASVLQPNIHASHEDSGKALAPKISISPRTTNSFHLPDDPSIPIIMVGPGTGIAPFIGFLQHREKLQEQHPDGNFGAMWLFFGCRHKDRDYLFRKELRHFLKHGILTHLKVSFSRDAPVGEEEAPAKYVQDNIQLHGQQVARILLQENGHIYVCGDAKNMAKDVHDALVQIISKEVGVEKLEAMKTLATLKEEKRYLQDIWS

SEQ ID NO: 7094 - protein, 894 aa, unidentified
MILLAVLFLCFISSYSASVKGHTTGLSLNNDRLYKLTYSTEVLLDRGKGKLQDSVGYRISSNVDVALLWRNPDGDDDQLIQITMKDVNVENVNQQRGEKSIFKGKSPSKIMGKENLEALQRPTLLHLIHGKVKEFYSYQNEAVAIENIKRGLASLFQTQLSSGTTNEVDISGNCKVTYQAHQDKVIKIKALDSCKIARSGFTTPNQVLGVSSKATSVTTYKIEDSFVIAVLAEETHNFGLNFLQTIKGKIVSKQKLELKTTEAGPRLMSGKQAAAIIKAVDSKYTAIPIVGQVFQSHCKGCPSLSELWRSTRKYLQPDNLSKAEAVRNFLAFIQHLRTAKKEEILQILKMENKEVLPQLVDAVTSAQTSDSLEAILDFLDFKSDSSIILQERFLYACGFASHPNEELLRALISKFKGSIGSSDIRETVMIITGTLVRKLCQNEGCKLKAVVEAKKLILGGLEKAEKKEDTRMYLLALKNALLPEGIPSLLKYAEAGEGPISHLATTALQRYDLPFITDEVKKTLNRIYHQNRKVHEKTVRTAAAAIILNNNPSYMDVKNILLSIGELPQEMNKYMLAIVQDILRFEMPASKIVRRVLKEMVAHNYDRFSRSGSSSAYTGYIERSPRSASTYSLDILYSGSGILRRSNLNIFQYIGKAGLHGSQVVIEAQGLEALIAATPDEGEENLDSYAGMSAILFDVQLRPVTFFNGYSDLMSKMLSASGDPISVVKGLILLIDHSQELQLQSGLKANIEVQGGLAIDISGAMEFSLWYRESKTRVKNRVTVVITTDITVDSSFVKAGLETSTETEAGLEFISTVQFSQYPFLVCMQMDKDEAPFRQFEKKYERLSTGRGYVSQKRKESVLAGCEFPLHQENSEMCKVVFAPQPDSTSSGWF

SEQ ID NO: 7095 - protein, 263 aa, unidentified
MSLVAEAFVSQIAAAEPWPENATLYQQLKGEQILLSDNAASLAVQAFLQMCNLPIKVVCRANAEYMSPSGKVPFIHVGNQVVSELGPIVQFVKAKGHSLSDGLEEVQKAEMKAYMELVNNMLLTAELYLQWCDEATVGEITHARYGSPYPWPLNHILAYQKQWEVKRKMKAIGWGKKTLDQVLEDVDQCCQALSQRLGTQPYFFNKQPTELDALVFGHLYTILTTQLTNDELSEKVKNYSNLLAFCRRIEQHYFEDRGKGRLS

SEQ ID NO: 7096 - protein, 1255 aa, unidentified; identical to SEQ ID NO: 2748

SEQ ID NO: 7097 - protein, 512 aa, unidentified; identical to SEQ ID NO: 2749

SEQ ID NO: 7098 - protein, 709 aa, unidentified
MGCLWGLALPLFFFCWEVGVSGSSAGPSTRRADTAMTTDDTEVPAMTLAPGHAALETQTLSAETSSRASTPAGPIPEAETRGAKRISPARETRSFTKTSPNFMVLIATSVETSAASGSPEGAGMTTVQTITGSDPREAIFDTLCTDDSSEEAKTLTMDILTLAHTSTEAKGLSSESSASSDSPHPVITPSRASESSASSDGPHPVITPSRASESSASSDGPHPVITPSRASESSASSDGPHPVITPSRASESSASSDGPHPVITPSRASESSASSDGPHPVITPSRASESSASSDGPHPVITPSRASESSASSDGPHPVITPSRASESSASSDGPHPVITPSRASESSASSDGLHPVITPSRASESSASSDGPHPVITPSRASESSASSDGPHPVITPSWSPGSDVTLLAEALVTVTNIEVINCSITEIETTTSSIPGASDTDLIPTEGVKASSTSDPPALPDSTEAKPHITEVTASAETLSTAGTTESAAPDATVGTPLPTNSATEREVTAPGATTLSGALVTVSRNPLEETSALSVETPSYVKVSGAAPVSIEAGSAVGKTTSFAGSSASSYSPSEAALKNFTPSETPTMDIATKGPFPTSRDPLPSVPPTTTNSSRGTNSTLAKITTSAKTTMKPPTATPTTARTRPTTDVSAGENGGFLLLRLSVASPEDLTDPRVAERLMQQLHRELHAHAPHFQVSLLRVRRG

SEQ ID NO: 7099 - protein, 5762 aa, unidentified
MGAPSACRTLVLALAAMLVVPQAETQGPVEPSWENAGHTMDGGAPTSSPTRRVSFVPPVTVFPSLSPLNPAHNGRVCSTWGDFHYKTFDGDVFRFPGLCNYVFSEHCRAAYEDFNVQLRRGLVGSRPVVTRVVIKAQGLVLEASNGSVLINGQREELPYSRTGLLVEQSGDYIKVSIRLVLTFLWNGEDSALLELDPKYANQTCGLCGDFNGLPAFNEFYAHNARLTPLQFGNLQKLDGPTEQCPDPLPLPAGNCTDEEGICHRTLLGPAFAECHALVDSTAYLAACAQDLCRCPTCPCATFVEYSRQCAHAGGQPRNWRCPELCPRTCPLNMQHQECGSPCTDTCSNPQRAQLCEDHCVDGCFCPPGTVLDDITHSGCLPLGQCPCTHGGRTYSPGTSFNTTCSSCTCSGGLWQCQDLPCPGTCSVQGGAHISTYDEKLYDLHGDCSYVLSKKCADSSFTVLAELRKCGLTDNENCLKAVTLSLDGGDTAIRVQADGGVFLNSIYTQLPLSAANITLFTPSSFFIVVQTGLGLQLLVQLVPLMQVFVRLDPAHQGQMCGLCGNFNQNQADDFTALSGVVEATGAAFANTWKAQAACANARNSFEDPCSLSVENENYARHWCSRLTDPNSAFSRCHSIINPKPFHSNCMFDTCNCERSEDCLCAALSSYVHACAAKGVQLSDWRDGVCTKYMQNCPKSQRYAYVVDACQPTCRGLSEADVTCSVSFVPVDGCTCPAGTFLNDAGACVPAQECPCYAHGTVLAPGEVVHDEGAVCSCTGGKLSCLGASLQKSTGCAAPMVYLDCSNSSAGTPGAECLRSCHTLDVGCFSTHCVSGCVCPPGLVSDGSGGCIAEEDCPCVHNEATYKPGETIRVDCNTCTCRNRRWECSHRLCLGTCVAYGDGHFITFDGDRYSFEGSCEYILAQDYCGDNTTHGTFRIVTENIPCGTTGTTCSKAIKLFVESYELILQEGTFKAVARGPGGDPPYKIRYMGIFLVIETHGMAVSWDRKTSVFIRLHQDYKGRVCGLCGNFDDNAINDFATRSRSVVGDALEFGNSWKLSPSCPDALAPKDPCTANPFRKSWAQKQCSILHGPTFAACRSQVDSTKYYEACVNDACACDSGGDCECFCTAVAAYAQACHDAGLCVSWRTPDTCPLFCDFYNPHGGCEWHYQPCGAPCLKTCRNPSGHCLVDLPGLEGCYPKCPPSQPFFNEDQMKCVAQCGCYDKDGNYYDVGARVPTAENCQSCNCTPSGIQCAHSLEACTCTYEDRTYSYQDVIYNTTDGLGACLIAICGSNGTIIRKAVACPGTPATTPFTFTTAWVPHSTTSPALPVSTVCVREVCRWSSWYNGHRPEPGLGGGDFETFENLRQRGYQVCPVLADIECRAAQLPDMPLEELGQQVDCDRMRGLMCANSQQSPPLCHDYELRVLCCEYVPCGPSPAPGTSPQPSLSASTEPAVPTPTQTTATEKTTLWVTPSIRSTAALTSQTGSSSGPVTVTPSAPGTTTCQPRCQWTEWFDEDYPKSEQLGGDVESYDKIRAAGGHLCQQPKDIECQAESFPNWTLAQVGQKVHCDVHFGLVCRNWEQEGVFKMCYNYRIRVLCCSDDHCRGRATTPPPTTELETATTTTTQALFSTPQPTSSPGLTRAPPASTTAVPTLSEGLTSPRYTSTLGTATTGGPTTPAGSTEPTVPGVATSTLPTRSALPGTTGSLGTWRPSQPPTLAPTTMATSRARPTGTASTASKEPLTTSLAPTLTSELSTSQAETSTPRTETTMSPLTNTTTSQGTTRCQPKCEWTEWFDVDFPTSGVAGGDMETFENIRAAGGKMCWAPKSIECRAENYPEVSIDQVGQVLTCSLETGLTCKNEDQTGRFNMCFNYNVRVLCCDDYSHCPSTPATSSTATPSSTPGTTWILTKPTTTATTTASTGSTATPTSTLRTAPPPKVLTTTATTPTVTSSKATPSSSPGTATALPALRSTATTPTATSVTPIPSSSLGTTWTRLSQTTTPTATMSTATPSSTPETAHTSTVLTATATTTGATGSVATPSSTPGTAHTTKVPTTTTTGFTATPSSSPGTALTPPVWISTTTTPTTRGSTVTPSSIPGTTHTATVLTTTTTTVATGSMATPSSSTQTSGTPPSLTTTATTITATGSTTNPSSTPGTTPIPPVLTTTATTPAATSNTVTPSSALGTTHTPPVPNTMATTHGRSLPPSSPHTVRTAWTSATSGILGTTHITEPSTVTSHTLAATTGTTQHSTPALSSPHPSSRTTESPPSPGTTTPGHTTATSRTTATATPSKTRTSTLLPSSPTSAPITTVVTMGCEPQCAWSEWLDYSYPMPGPSGGDFDTYSNIRAAGGAVCEQPLGLECRAQAQPGVPLRELGQVVECSLDFGLVCRNREQVGKFKMCFNYEIRVFCCNYGHCPSTPATSSTAMPSSTPGTTWILTELTTTATTTESTGSTATPSSTPGTTWILTEPSTTATVTVPTGSTATASSTQATAGTPHVSTTATTPTVTSSKATPFSSPGTATALPALRSTATTPTATSFTAIPSSSLGTTWTRLSQTTTPTATMSTATPSSTPETVHTSTVLTTTATTTGATGSVATPSSTPGTAHTTKVLTTTTTGFTATPSSSPGTARTLPVWISTTTTPTTRGSTVTPSSIPGTTHTPTVLTTTTTTVATGSMATPSSSTQTSGTPPSLTTTATTITATGSTTNPSSTPGTTPIPPVLTTTATTPAATSSTVTPSSALGTTHTPPVPNTTATTHGRSLSPSSPHTVRTAWTSATSGTLGTTHITEPSTGTSHTPAATTGTTQHSTPALSSPHPSSRTTESPPSPGTTTPGHTRATSRTTATATPSKTRTSTLLPSSPTSAPITTVVTMGCEPQCAWSEWLDYSYPMPGPSGGDFDTYSNIRAAGGAVCEQPLGLECRAQAQPGVPLRELGQVVECSLDFGLVCRNREQVGKFKMCFNYEIRVFCCNYGHCPSTPATSSTATPSSTPGTTWILTEQTTAATTTATTGSTAIPSSTPGTAPPPKVLTSTATTPTATSSKATSSSSPRTATTLPVLTSTATKSTATSFTPIPSFTLGTTGTLPEQTTTPMATMSTIHPSSTPETTHTSTVLTTKATTTRATSSMSTPSSTPGTTWILTELTTAATTTAATGPTATPSSTPGTTWILTEPSTTATVTVPTGSTATASSTRATAGTLKVLTSTATTPTVISSRATPSSSPGTATALPALRSTATTPTATSVTAIPSSSLGTAWTRLSQTTTPTATMSTATPSSTPETVHTSTVLTTTTTTTRATGSVATPSSTPGTAHTTKVPTTTTTGFTATPSSSPGTALTPPVWISTTTTPTTRGSTVTPSSIPGTTHTATVLTTTTTTVATGSMATPSSSTQTSGTPPSLTTTATTITATGSTTNPSSTPGTTPIPPVLTTTATTPAATSSTVTPSSALGTTHTPPVPNTTATTHGRSLPPSSPHTVRTAWTSATSGILGTTHITEPSTVTSHTPAATTSTTQHSTPALSSPHPSSRTTESPPSPGTTTPGHTRGTSRTTATATPSKTRTSTLLPSSPTSAPITTVVTTGCEPQCAWSEWLDYSYPMPGPSGGDFDTYSNIRAAGGAVCEQPLGLECRAQAQPGVPLRELGQVVECSLDFGLVCRNREQVGKFKMCFNYEIRVFCCNYGHCPSTPATSSTATPSSTPGTTWILTKLTTTATTTESTGSTATPSSTPGTTWILTEPSTTATVTVPTGSTATASSTQATAGTPHVSTTATTPTVTSSKATPFSSPGTATALPALRSTATTPTATSFTAIPSSSLGTTWTRLSQTTTPTATMSTATPSSTPETAHTSTVLTTTATTTRATGSVATPSSTPGTAHTTKVPTTTTTGFTVTPSSSPGTARTPPVWISTTTTPTTSGSTVTPSSVPGTTHTPTVLTTTTTTVATGSMATPSSSTQTSGTPPSLITTATTITATGSTTNPSSTPGTTPIPPVLTTTATTPAATSSTVTPSSALGTTHTPPVPNTTATTHGRSLSPSSPHTVRTAWTSATSGTLGTTHITEPSTGTSHTPAATTGTTQHSTPALSSPHPSSRTTESPPSPGTTTPGHTTATSRTTATATPSKTRTSTLLPSSPTSAPITTVVTTGCEPQCAWSEWLDYSYPMPGPSGGDFDTYSNIRAAGGAVCEQPLGLECRAQAQPGVPLGELGQVVECSLDFGLVCRNREQVGKFKMCFNYEIRVFCCNYGHCPSTPATSSTAMPSSTPGTTWILTELTTTATTTASTGSTATPSSTPGTAPPPKVLTSPATTPTATSSKATSSSSPRTATTLPVLTSTATKSTATSVTPIPSSTLGTTGTLPEQTTTPVATMSTIHPSSTPETTHTSTVLTTKATTTRATSSTSTPSSTPGTTWILTELTTAATTTAATGPTATPSSTPGTTWILTELTTTATTTASTGSTATPSSTPGTTWILTEPSTTATVTVPTGSTATASSTQATAGTPHVSTTATTPTVTSSKATPSSSPGTATALPALRSTATTPTATSFTAIPSSSLGTTWTRLSQTTTPTATMSTATPSSTPETVHTSTVLTATATTTGATGSVATPSSTPGTAHTTKVPTTTTTGFTATPSSSPGTALTPPVWISTTTTPTTTTPTTSGSTVTPSSIPGTTHTARVLTTTTTTVATGSMATPSSSTQTSGTPPSLTTTATTITATGSTTNPSSTPGTTPITPVLTSTATTPAATSSKATSSSSPRTATTLPVLTSTATKSTATSFTPIPSSTLWTTWTVPAQTTTPMSTMSTIHTSSTPETTHTSTVLTTTATMTRATNSTATPSSTLGTTRILTELTTTATTTAATGSTATLSSTPGTTWILTEPSTIATVMVPTGSTATASSTLGTAHTPKVVTTMATMPTATASTVPSSSTVGTTRTPAVLPSSLPTFSVSTVSSSVLTTLRPTGFPSSHFSTPCFCRAFGQFFSPGEVIYNKTDRAGCHFYAVCNQHCDIDRFQGACPTSPPPVSSAPLSSPSPAPGCDNAIPLRQVNETWTLENCTVARCVGDNRVVLLDPKPVANVTCVNKHLPIKVSDPSQPCDFHYECECICSMWGGSHYSTFDGTSYTFRGNCTYVLMREIHARFGNLSLYLDNHYCTASATAAAARCPRALSIHYKSMDIVLTVTMVHGKEEGLILFDQIPVSSGFSKNGVLVSVLGTTTMRVDIPALGVSVTFNGQVFQARLPYSLFHNNTEGQCGTCTNNQRDDCLQRDGTTAASCKDMAKTWLVPDSRKDGCWAPTGTPPTASPAAPVSSTPTPTPCPPQPLCDLMLSQVFAECHNLVPPGPFFNACISDHCRGRLEVPCQSLEAYAELCRARGVCSDWRGATGGLCDLTCPPTKVYKPCGPIQPATCNSRNQSPQLEGMAEGCFCPEDQILFNAHMGICVQACPCVGPDGFPKFPGERWVSNCQSCVCDEGSVSVQCKPLPCDAQGQPPPCNRPGFVTVTRPRAENPCCPETVCVCNTTTCPQSLPVCPPGQESICTQEEGDCCPTFRCRPQLCSYNGTFYGVGATFPGALPCHMCTCLSGDTQDPTVQCQEDACNNTTCPQGFEYKRVAGQCCGECVQTACLTPDGQPVQLNETWVNSHVDNCTVYLCEAEGGVHLLTPQPASCPDVSSCRGSLRKTGCCYSCEEDSCQVRINTTILWHQGCETEVNITFCEGSCPGASKYSAEAQAMQHQCTCCQERRVHEETVPLHCPNGSAILHTYTHVDECGCTPFCVPAPMAPPHTRGFPAQEATAV

SEQ ID NO: 7100 - protein, 2439 aa, unidentified
MVQRWLLLSCCGALLSAGLANTSYTSPGLQRLKDSPQTAPDKGQCSTWGAGHFSTFDHHVYDFSGTCNYIFAATCKDAFPTFSVQLRRGPDGSISRIIVELGASVVTVSEAIISVKDIGVISLPYTSNGLQITPFGQSVRLVAKQLELELEVVWGPDSHLMVLVERKYMGQMCGLCGNFDGKVTNEFVSEEGKFLEPHKFAALQKLDDPGEICTFQDIPSTHVRQAQHARICTQLLTLVAPECSVSKEPFVLSCQADVAAAPQPGPQNSSCATLSEYSRQCSMVGQPVRRWRSPGLCSVGQCPANQVYQECGSACVKTCSNPQHSCSSSCTFGCFCPEGTVLNDLSNNHTCVPVTQCPCVLHGAMYAPGEVTIAACQTCRCTLGRWVCTERPCPGHCSLEGGSFVTTFDARPYRFHGTCTYILLQSPQLPEDGALMAVYDKSGVSHSETSLVAVVYLSRQDKIVISQDEVVTNNGEAKWLPYKTRNITVFRQTSTHLQMATSFGLELVVQLRPIFQAYVTVGPQFRGQTRGLCGNFNGDTTDDFTTSMGIAEGTASLFVDSWRAGNCPAALERETDPCSMSQLNKVCAETHCSMLLRTGTVFERCHATVNPAPFYKRCVYQACNYEETFPHICAALGDYVHACSLRGVLLWGWRSSVDNCTIPCTGNTTFSYNSQACERTCLSLSDRATECHHSAVPVDGCNCPDGTYLNQKGECVRKAQCPCILEGYKFILAEQSTVINGITCHCINGRLSCPQRPQMFLASCQAPKTFKSCSQSSENKFGAACAPTCQMLATGVACVPTKCEPGCVCAEGLYENADGQCVPPEECPCEFSGVSYPGGAELHTDCRTCSCSRGRWACQQGTHCPSTCTLYGEGHVITFDGQRFVFDGNCEYILATDVCGVNDSQPTFKILTENVICGNSGVTCSRAIKIFLGGLSVVLADRNYTVTGEEPHVQLGVTPGALSLVVDISIPGRYNLTLIWNRHMTILIRIARASQDPLCGLCGNFNGNMKDDFETRSRYVASSELELVNSWKESPLCGDVSFVTDPCSLNAFRRSWAERKCSVINSQTFATCHSKVYHLPYYEACVRDACGCDSGGDCECLCDAVAAYAQACLDKGVCVDWRTPAFCPIYCGFYNTHTQDGHGEYQYTQEANCTWHYQPCLCPSQPQSVPGSNIEGCYNCSQDEYFDHEEGVCVPCMPPTTPQPPTTPQLPTTGSRPTQVWPMTGTSTTIGLLSSTGPSPSSNHTPASPTQTPLLPATLTSSKPTASSGEPPRPTTAVTPQATSGLPPTATLRSTATKPTVTQATTRATASTASPATTSTAQSTTRTTMTLPTPATSGTSPTLPKSTNQELPGTTATQTTGPRPTPASTTGPTTPQPGQPTRPTATETTQTRTTTEYTTPQTPHTTHSPPTAGSPVPSTGPVTATSFHATTTYPTPSHPETTLPTHVPPFSTSLVTPSTHTVITPTHAQMATSASNHSAPTGTIPPPTTLKATGSTHTAPPITPTTSGTSQAHSSFSTNKTPTSLHSHTSSTHHPEVTPTSTTTITPNPTSTRTRTPVAHTNSATSSRPPPPFTTHSPPTGSSPFSSTGPMTATSFKTTTTYPTPSHPQTTLPTHVPPFSTSLVTPSTHTVITPTHAQMATSASIHSMPTGTIPPPTTLKATGSTHTAPTMTLTTSGTSQALSSLNTAKTSTSLHSHTSSTHHAEATSTSTTNITPNPTSTGTPPMTVTTSGTSQSRSSFSTAKTSTSLHSHTSSTHHPEVTSTSTTSITPNHTSTGTRTPVAHTTSATSSRLPTPFTTHSPPTGTTPISSTGPVTATSFQTTTTYPTPSHPHTTLPTHVPSFSTSLVTPSTHTVIIPTHTQMATSASIHSMPTGTIPPPTTIKATGSTHTAPPMTPTTSGTSQSPSSFSTAKTSTSLPYHTSSTHHPEVTPTSTTNITPKHTSTGTRTPVAHTTSASSSRLPTPFTTHSPPTGSSPFSSTGPMTATSFQTTTTYPTPSHPQTTLPTHVPPFSTSLVTPSTHTVIITTHTQMATSASIHSTPTGTVPPPTTLKATGSTHTAPPMTVTTSGTSQTHSSFSTATASSSFISSSSWLPQNSSSRPPSSPITTQLPHLSSATTPVSTTNQLSSSFSPSPSAPSTVSSYVPSSHSSPQTSSPSVGTSSSFVSAPVHSTTLSSGSHSSLSTHPTTASVSASPLFPSSPAASTTIRATLPHTISSPFTLSALLPISTVTVSPTPSSHLASSTIAFPSTPRTTASTHTAPAFSSQSTTSRSTSLTTRVPTSGFVSLTSGVTGIPTSPVTNLTTRHPGPTLSPTTRFLTSSLTAHGSTPASAPVSSLGTPTPTSPGVCSVREQQEEITFKGCMANVTVTRCEGACISAASFNIITQQVDARCSCCRPLHSYEQQLELPCPDPSTPGRRLVLTLQVFSHCVCSSVACGD

SEQ ID NO: 7101 - protein, 377 aa, unidentified
MKTLPLFVCICALSACFSFSEGRERDHELRHRRHHHQSPKSHFELPHYPGLLAHQKPFIRKSYKCLHKRCRPKLPPSPNNPPKFPNPHQPPKHPDKNSSVVNPTLVATTQIPSVTFPSASTKITTLPNVTFLPQNATTISSRENVNTSSSVATLAPVNSPAPQDTTAAPPTPSATTPAPPSSSAPPETTAAPPTPSATTQAPPSSSAPPETTAAPPTPPATTPAPPSSSAPPETTAAPPTPSATTPAPLSSSAPPETTAVPPTPSATTLDPSSASAPPETTAAPPTPSATTPAPPSSPAPQETTAAPITTPNSSPTTLAPDTSETSAAPTHQTTTSVTTQTTTTKQPTSAPGQNKISRFLLYMKNLLNRIIDDMVEQ

SEQ ID NO: 7102 - protein, 90 aa, unidentified
MKFLAVLVLLGVSIFLVSAQNPTTAAPADTYPATGPADDEAPDAETTAAATTATTAAPTTATTAASTTARKDIPVLPKWVGDLPNGRVCP

SEQ ID NO: 7103 - protein, 2828 aa, unidentified
MPKRAHWGALSVVLILLWGHPRVALACPHPCACYVPSEVHCTFRSLASVPAGIAKHVERINLGFNSIQALSETSFAGLTKLELLMIHGNEIPSIPDGALRDLSSLQVFKFSYNKLRVITGQTLQGLSNLMRLHIDHNKIEFIHPQAFNGLTSLRLLHLEGNLLHQLHPSTFSTFTFLDYFRLSTIRHLYLAENMVRTLPASMLRNMPLLENLYLQGNPWTCDCEMRWFLEWDAKSRGILKCKKDKAYEGGQLCAMCFSPKKLYKHEIHKLKDMTCLKPSIESPLRQNRSRSIEEEQEQEEDGGSQLILEKFQLPQWSISLNMTDEHGNMVNLVCDIKKPMDVYKIHLNQTDPPDIDINATVALDFECPMTRENYEKLWKLIAYYSEVPVKLHRELMLSKDPRVSYQYRQDADEEALYYTGVRAQILAEPEWVMQPSIDIQLNRRQSTAKKVLLSYYTQYSQTISTKDTRQARGRSWVMIEPSGAVQRDQTVLEGGPCQLSCNVKASESPSIFWVLPDGSILKAPMDDPDSKFSILSSGWLRIKSMEPSDSGLYQCIAQVRDEMDRMVYRVLVQSPSTQPAEKDTVTIGKNPGESVTLPCNALAIPEAHLSWILPNRRIINDLANTSHVYMLPNGTLSIPKVQVSDSGYYRCVAVNQQGADHFTVGITVTKKGSGLPSKRGRRPGAKALSRVREDIVEDEGGSGMGDEENTSRRLLHPKDQEVFLKTKDDAINGDKKAKKGRRKLKLWKHSEKEPETNVAEGRRVFESRRRINMANKQINPERWADILAKVRGKNLPKGTEVPPLIKTTSPPSLSLEVTPPFPAISPPSASPVQTVTSAEESSADVPLLGEEEHVLGTISSASMGLEHNHNGVILVEPEVTSTPLEEVVDDLSEKTEEITSTEGDLKGTAAPTLISEPYEPSPTLHTLDTVYEKPTHEETATEGWSAADVGSSPEPTSSEYEPPLDAVSLAESEPMQYFDPDLETKSQPDEDKMKEDTFAHLTPTPTIWVNDSSTSQLFEDSTIGEPGVPGQSHLQGLTDNIHLVKSSLSTQDTLLIKKGMKEMSQTLQGGNMLEGDPTHSRSSESEGQESKSITLPDSTLGIMSSMSPVKKPAETTVGTLLDKDTTTATTTPRQKVAPSSTMSTHPSRRRPNGRRRLRPNKFRHRHKQTPPTTFAPSETFSTQPTQAPDIKISSQVESSLVPTAWVDNTVNTPKQLEMEKNAEPTSKGTPRRKHGKRPNKHRYTPSTVSSRASGSKPSPSPENKHRNIVTPSSETILLPRTVSLKTEGPYDSLDYMTTTRKIYSSYPKVQETLPVTYKPTSDGKEIKDDVATNVDKHKSDILVTGESITNAIPTSRSLVSTMGEFKEESSPVGFPGTPTWNPSRTAQPGRLQTGIPVTTSGENLTDPPLLKELEDVDFTSEFLSSLTVSTPFHQEEAGSSTTLSSIKVEVASSQAETTTLDQDHLETTVAILLSETRPQNHTPTAARMKEPASSSPSTILMSLGQTTTTKPALPSPRISQASRDSKENVFLNYVGNPETEATPVNNEGTQHMSGPNELSTPSSDQDAFNLSTKLELEKQVFGSRSLPRGPDSQRQDGRVHASHQLTRVPAKPILPTATVRLPEMSTQSASRYFVTSQSPRHWTNKPEITTYPSGALPENKQFTTPRLSSTTIPLPLHMSKPSIPSKFTDRRTDQFNGYSKVFGNNNIPEARNPVGKPPSPRIPHYSNGRLPFFTNKTLSFPQLGVTRRPQIPTSPAPVMRERKVIPGSYNRIHSHSTFHLDFGPPAPPLLHTPQTTGSPSTNLQNIPMVSSTQSSISFITSSVQSSGSFHQSSSKFFAGGPPASKFWSLGEKPQILTKSPQTVSVTAETDTVFPCEATGKPKPFVTWTKVSTGALMTPNTRIQRFEVLKNGTLVIRKVQVQDRGQYMCTASNLHGLDRMVVLLSVTVQQPQILASHYQDVTVYLGDTIAMECLAKGTPAPQISWIFPDRRVWQTVSPVEGRITLHENRTLSIKEASFSDRGVYKCVASNAAGADSLAIRLHVAALPPVIHQEKLENISLPPGLSIHIHCTAKAAPLPSVRWVLGDGTQIRPSQFLHGNLFVFPNGTLYIRNLAPKDSGRYECVAANLVGSARRTVQLNVQRAAANARITGTSPRRTDVRYGGTLKLDCSASGDPWPRILWRLPSKRMIDALFSFDSRIKVFANGTLVVKSVTDKDAGDYLCVARNKVGDDYVVLKVDVVMKPAKIEHKEENDHKVFYGGDLKVDCVATGLPNPEISWSLPDGSLVNSFMQSDDSGGRTKRYVVFNNGTLYFNEVGMREEGDYTCFAENQVGKDEMRVRVKVVTAPATIRNKTYLAVQVPYGDVVTVACEAKGEPMPKVTWLSPTNKVIPTSSEKYQIYQDGTLLIQKAQRSDSGNYTCLVRNSAGEDRKTVWIHVNVQPPKINGNPNPITTVREIAAGGSRKLIDCKAEGIPTPRVLWAFPEGVVLPAPYYGNRITVHGNGSLDIRSLRKSDSVQLVCMARNEGGEARLILQLTVLEPMEKPIFHDPISEKITAMAGHTISLNCSAAGTPTPSLVWVLPNGTDLQSGQQLQRFYHKADGMLHISGLSSVDAGAYRCVARNAAGHTERLVSLKVGLKPEANKQYHNLVSIINGETLKLPCTPPGAGQGRFSWTLPNGMHLEGPQTLGRVSLLDNGTLTVREASVFDRGTYVCRMETEYGPSVTSIPVIVIAYPPRITSEPTPVIYTRPGNTVKLNCMAMGIPKADITWELPDKSHLKAGVQARLYGNRFLHPQGSLTIQHATQRDAGFYKCMAKNILGSDSKTTYIHVF

SEQ ID NO: 7104 - protein, 204 aa, unidentified
MEAPAELLAALPALATALALLLAWLLVRRGAAASPEPARAPPEPAPPAEATGAPAPSRPCAPEPAASPAGPEEPGEPAGLGELGEPAGPGEPEGPGDPAAAPAEAEEQAVEARQEEEQDLDGEKGPSSEGPEEEDGEGFSFKYSPGKLRGNQYKKMMTKEELEEEQRVQKEQLAAIFKLMKDNKETFGEMSDGDVQEQLRLYDM

SEQ ID NO: 7105 - protein, 173 aa, unidentified
MAAPSGGWNGVGASLWAALLLGAVALRPAEAVSEPTTVAFDVRPGGVVHSFSHNVGPGDKYTCMFTYASQGGTNEQWQMSLGTSEDHQHFTCTIWRPQGKSYLYFTQFKAEVRGAEIEYAMAYSKAAFERESDVPLKTEEFEVTKTAVAHRPGAFKAELSKLVIVAKASRTEL

SEQ ID NO: 7106 - protein, 194 aa, unidentified
MAPKKDVKKPVAAAAAAPAPAPAPAPAPAPAKPKEEKIDLSAIKIEFSKEQQDEFKEAFLLFDRTGDSKITLSQVGDVLRALGTNPTNAEVRKVLGNPSNEELNAKKIEFEQFLPMMQAISNNKDQATYEDFVEGLRVFDKEGNGTVMGAELRHVLATLGEKMKEEEVEALMAGQEDSNGCINYEAFVKHIMSI

SEQ ID NO: 7107 - protein, 504 aa, unidentified
MRFFCARCCSFGPEMPAVQLLLLACLVWDVGARTAQLRKANDQSGRCQYTFSVASPNESSCPEQSQAMSVIHNLQRDSSTQRLDLEATKARLSSLESLLHQLTLDQAARPQETQEGLQRELGTLRRERDQLETQTRELETAYSNLLRDKSVLEEEKKRLRQENENLARRLESSSQEVARLRRGQCPQTRDTARAVPPGSREVSTWNLDTLAFQELKSELTEVPASRILKESPSGYLRSGEGDTGCGELVWVGEPLTLRTAETITGKYGVWMRDPKPTYPYTQETTWRIDTVGTDVRQVFEYDLISQFMQGYPSKVHILPRPLESTGAVVYSGSLYFQGAESRTVIRYELNTETVKAEKEIPGAGYHGQFPYSWGGYTDIDLAVDEAGLWVIYSTDEAKGAIVLSKLNPENLELEQTWETNIRKQSVANAFIICGTLYTVSSYTSADATVNFAYDTGTGISKTLTIPFKNRYKYSSMIDYNPLEKKLFAWDNLNMVTYDIKLSKM

SEQ ID NO: 7108 - protein, 189 aa, unidentified
MRLSLPLLLLLLGAWAIPGGLGDRAPLTATAPQLDDEEMYSAHMPAHLRCDACRAVAYQMWQNLAKAETKLHTSNSGGRRELSELVYTDVLDRSCSRNWQDYGVREVDQVKRLTGPGLSEGPEPSISVMVTGGPWPTRLSRTCLHYLGEFGEDQIYEAHQQGRGALEALLCGGPQGACSEKVSATREEL

SEQ ID NO: 7109 - protein, 583 aa, unidentified; identical to SEQ ID NO: 2768

SEQ ID NO: 7110 - protein, 125 aa, unidentified
MAGAGPTMLLREENGCCSRRQSSSSAGDSDGEREDSAAERARQQLEALLNKTMRIRMTDGRTLVGCFLCTDRDCNVILGSAQEFLKPSDSFSAGEPRVLGLAMVPGHHIVSIEVQRESLTGPPYL

SEQ ID NO: 7111 - protein, 359 aa, unidentified
MRTADREARPGLPSLLLLLLAGAGLSAASPPAAPRFNVSLDSVPELRWLPVLRHYDLDLVRAAMAQVIGDRVPKWVHVLIGKVVLELERFLPQPFTGEIRGMCDFMNLSLADCLLVNLAYESSVFCTSIVAQDSRGHIYHGRNLDYPFGNVLRKLTVDVQFLKNGQIAFTGTTFIGYVGLWTGQSPHKFTVSGDERDKGWWWENAIAALFRRHIPVSWLIRATLSESENFEAAVGKLAKTPLIADVYYIVGGTSPREGVVITRNRDGPADIWPLDPLNGAWFRVETNYDHWKPAPKEDDRRTSAIKALNATGQANLSLEALFQILSVVPVYNNFTIYTTVMSAGSPDKYMTRIRNPSRK

SEQ ID NO: 7112 - protein, 411 aa, unidentified
MLLKTVLLLGHVAQVLMLDNGLLQTPPMGWLAWERFRCNINCDEDPKNCISEQLFMEMADRMAQDGWRDMGYTYLNIDDCWIGGRDASGRLMPDPKRFPHGIPFLADYVHSLGLKLGIYADMGNFTCMGYPGTTLDKVVQDAQTFAEWKVDMLKLDGCFSTPEERAQGYPKMAAALNATGRPIAFSCSWPAYEGGLPPRVNYSLLADICNLWRNYDDIQDSWWSVLSILNWFVEHQDILQPVAGPGHWNDPDMLLIGNFGLSLEQSRAQMALWTVLAAPLLMSTDLRTISAQNMDILQNPLMIKINQDPLGIQGRRIHKEKSLIEVYMRPLSNKASALVFFSCRTDMPYRYHSSLGQLNFTGSVIYEAQDVYSGDIISGLRDETNFTVIINPSGVVMWYLYPIKNLEMSQQ

SEQ ID NO: 7113 - protein, 743 aa, unidentified
MEAVAVAAAVGVLLLAGAGGAAGDEAREAAAVRALVARLLGPGPAADFSVSVERALAAKPGLDTYSLGGGGAARVRVRGSTGVAAAAGLHRYLRDFCGCHVAWSGSQLRLPRPLPAVPGELTEATPNRYRYYQNVCTQSYSFVWWDWARWEREIDWMALNGINLALAWSGQEAIWQRVYLALGLTQAEINEFFTGPAFLAWGRMGNLHTWDGPLPPSWHIKQLYLQHRVLDQMRSFGMTPVLPAFAGHVPEAVTRVFPQVNVTKMGSWGHFNCSYSCSFLLAPEDPIFPIIGSLFLRELIKEFGTDHIYGADTFNEMQPPSSEPSYLAAATTAVYEAMTAVDTEAVWLLQGWLFQHQPQFWGPAQIRAVLGAVPRGRLLVLDLFAESQPVYTRTASFQGQPFIWCMLHNFGGNHGLFGALEAVNGGPEAARLFPNSTMVGTGMAPEGISQNEVVYSLMAELGWRKDPVPDLAAWVTSFAARRYGVSHPDAGAAWRLLLRSVYNCSGEACRGHNRSPLVRRPSLQMNTSIWYNRSDVFEAWRLLLTSAPSLATSPAFRYDLLDLTRQAVQELVSLYYEEARSAYLSKELASLLRAGGVLAYELLPALDEVLASDSRFLLGSWLEQARAAAVSEAEADFYEQNSRYQLTLWGPEGNILDYANKQLAGLVANYYTPRWRLFLEALVDSVAQGIPFQQHQFDKNVFQLEQAFVLSKQRYPSQPRGDTVDLAKKIFLKYYPRWVAGSW

SEQ ID NO: 7114 - protein, 534 aa, unidentified
MATALMAVVLRAAAVAPRLRGRGGTGGARRLSCGARRRAARGTSPGRRLSTAWSQPQPPPEEYAGADDVSQSPVAEEPSWVPSPRPPVPHESPEPPSGRSLVQRDIQAFLNQCGASPGEARHWLTQFQTCHHSADKPFAVIEVDEEVLKCQQGVSSLAFALAFLQRMDMKPLVVLGLPAPTAPSGCLSFWEAKAQLAKSCKVLVDALRHNAAAAVPFFGGGSVLRAAEPAPHASYGGIVSVETDLLQWCLESGSIPILCPIGETAARRSVLLDSLEVTASLAKALRPTKIIFLNNTGGLRDSSHKVLSNVNLPADLDLVCNAEWVSTKERQQMRLIVDVLSRLPHHSSAVITAASTLLTELFSNKGSGTLFKNAERMLRVRSLDKLDQGRLVDLVNASFGKKLRDDYLASLRPRLHSIYVSEGYNAAAILTMEPVLGGTPYLDKFVVSSSRQGQGSGQMLWECLRRDLQTLFWRSRVTNPINPWYFKHSDGSFSNKQWIFFWFGLADIRDSYELVNHAKGLPDSFHKPASDPGS

SEQ ID NO: 7115 - protein, 420 aa, unidentified
MSPPPLLQPLLLLLPLLNVEPSGATLIRIPLHRVQPGRRILNLLRGWREPAELPKLGAPSPGDKPIFVPLSNYRDVQYFGEIGLGTPPQNFTVAFDTGSSNLWVPSRRCHFFSVPCWLHHRFDPKASSSFQANGTKFAIQYGTGRVDGILSEDKLTIGGIKGASVIFGEALWEPSLVFAFAHFDGILGLGFPILSVEGVRPPMDVLVEQGLLDKPVFSFYLNRDPEEPDGGELVLGGSDPAHYIPPLTFVPVTVPAYWQIHMERVKVGPGLTLCAKGCAAILDTGTSLITGPTEEIRALHAAIGGIPLLAGEYIILCSEIPKLPAVSFLLGGVWFNLTAHDYVIQTTRNGVRLCLSGFQALDVPPPAGPFWILGDVFLGTYVAVFDRGDMKSSARVGLARARTRGADLGWGETAQAQFPG

SEQ ID NO: 7116 - protein, 288 aa, unidentified
MSRLRALLGLGLLVAGSRVPRIKSQTIACRSGPTWWGPQRLNSGGRWDSEVMASTVVKYLSQEEAQAVDQELFNEYQFSVDQLMELAGLSCATAIAKAYPPTSMSRSPPTVLVICGPGNNGGDGLVCARHLKLFGYEPTIYYPKRPNKPLFTALVTQCQKMDIPFLGEMPAEPMTIDELYELVVDAIFGFSFKGDVREPFHSILSVLKGLTVPIASIDIPSGWDVEKGNAGGIQPDLLISLTAPKKSATQFTGRYHYLGGRFVPPALEKKYQLNLPPYPDTECVYRLQ

SEQ ID NO: 7117 - protein, 181 aa, unidentified
MMLRVLVGAVLPAMLLAAPPPINKLALFPDKSAWCEAKNITQIVGHSGCEAKSIQNRACLGQCFSYSVPNTFPQSTESLVHCDSCMPAQSMWEIVTLECPGHEEVPRVDKLVEKILHCSCQACGKEPSHEGLSVYVQGEDGPGSQPGTHPHPHPHPHPGGQTPEPEDPPGAPHTEEEGAED

SEQ ID NO: 7118 - protein, 858 aa, unidentified; identical to SEQ ID NO: 2780

SEQ ID NO: 7119 - protein, 1321 aa, unidentified
MGAPFVWALGLLMLQMLLFVAGEQGTQDITDASERGLHMQKLGSGSVQAALAELVALPCLFTLQPRPSAARDAPRIKWTKVRTASGQRQDLPILVAKDNVVRVAKSWQGRVSLPSYPRRRANATLLLGPLRASDSGLYRCQVVRGIEDEQDLVPLEVTGVVFHYRSARDRYALTFAEAQEACRLSSAIIAAPRHLQAAFEDGFDNCDAGWLSDRTVRYPITQSRPGCYGDRSSLPGVRSYGRRNPQELYDVYCFARELGGEVFYVGPARRLTLAGARAQCRRQGAALASVGQLHLAWHEGLDQCDPGWLADGSVRYPIQTPRRRCGGPAPGVRTVYRFANRTGFPSPAERFDAYCFRAHHPTSQHGDLETPSSGDEGEILSAEGPPVRELEPTLEEEEVVTPDFQEPLVSSGEEETLILEEKQESQQTLSPTPGDPMLASWPTGEVWLSTVAPSPSDMGAGTAASSHTEVAPTDPMPRRRGRFKGLNGRYFQQQEPEPGLQGGMEASAQPPTSEAAVNQMEPPLAMAVTEMLGSGQSRSPWADLTNEVDMPGAGSAGGKSSPEPWLWPPTMVPPSISGHSRAPVLELEKAEGPSARPATPDLFWSPLEATVSAPSPAPWEAFPVATSPDLPMMAMLRGPKEWMLPHPTPISTEANRVEAHGEATATAPPSPAAETKVYSLPLSLTPTGQGGEAMPTTPESPRADFRETGETSPAQVNKAEHSSSSPWPSVNRNVAVGFVPTETATEPTGLRGIPGSESGVFDTAESPTSGLQATVDEVQDPWPSVYSKGLDASSPSAPLGSPGVFLVPKVTPNLEPWVATDEGPTVNPMDSTVTPAPSDASGIWEPGSQVFEEAESTTLSPQVALDTSIVTPLTTLEQGDKVGVPAMSTLGSSSSQPHPEPEDQVETQGTSGASVPPHQSSPLGKPAVPPGTPTAASVGESASVSSGEPTVPWDPSSTLLPVTLGIEDFELEVLAGSPGVESFWEEVASGEEPALPGTPMNAGAEEVHSDPCENNPCLHGGTCNANGTMYGCSCDQGFAGENCEIDIDDCLCSPCENGGTCIDEVNGFVCLCLPSYGGSFCEKDTEGCDRGWHKFQGHCYRYFAHRRAWEDAEKDCRRRSGHLTSVHSPEEHSFINSFGHENTWIGLNDRIVERDFQWTDNTGLQFENWRENQPDNFFAGGEDCVVMVAHESGRWNDVPCNYNLPYVCKKGTVLCGPPPAVENASLIGARKAKYNVHATVRYQCNEGFAQHHVATIRCRSNGKWDRPQIVCTKPRRSHRMRRHHHHHQHHHQHHHHKSRKERRKHKKHPTEDWEKDEGNFC

SEQ ID NO: 7120 - protein, 709 aa, unidentified; identical to SEQ ID NO: 2792

SEQ ID NO: 7121 - protein, 568 aa, unidentified
MVLLHWCLLWLLFPLSSRTQKLPTRDEELFQMQIRDKAFFHDSSVIPDGAEISSYLFRDTPKRYFFVVEEDNTPLSVTVTPCDAPLEWKLSLQELPEDRSGEGSGDLEPLEQQKQQIINEEGTELFSYKGNDVEYFISSSSPSGLYQLDLLSTEKDTHFKVYATTTPESDQPYPELPYDPRVDVTSLGRTTVTLAWKPSPTASLLKQPIQYCVVINKEHNFKSLCAVEAKLSADDAFMMAPKPGLDFSPFDFAHFGFPSDNSGKERSFQAKPSPKLGRHVYSRPKVDIQKICIGNKNIFTVSDLKPDTQYYFDVFVVNINSNMSTAYVGTFARTKEEAKQKTVELKDGKITDVFVKRKGAKFLRFAPVSSHQKVTFFIHSCLDAVQIQVRRDGKLLLSQNVEGIQQFQLRGKPKAKYLVRLKGNKKGASMLKILATTRPTKQSFPSLPEDTRIKAFDKLRTCSSATVAWLGTQERNKFCIYKKEVDDNYNEDQKKREQNQCLGPDIRKKSEKVLCKYFHSQNLQKAVTTETIKGLQPGKSYLLDVYVIGHGGHSVKYQSKVVKTRKFC

SEQ ID NO: 7122 - protein, 133 aa, unidentified
MRKHVLAASFSMLSLLVIMGDTDSKTDSSFIMDSDPRRCMRHHYVDSISHPLYKCSSKMVLLARCEGHCSQASRSEPLVSFSTVLKQPFRSSCHCCRPQTSKLKALRLRCSGGMRLTATYRYILSCHCEECNS

SEQ ID NO: 7123 - protein, 355 aa, unidentified
MALRLLKLAATSASARVVAAGAQRVRGIHSSVQCKLRYGMWHFLLGDKASKRLTERSRVITVDGNICTGKGKLAKEIAEKLGFKHFPEAGIHYPDSTTGDGKPLATDYNGNCSLEKFYDDPRSNDGNSYRLQSWLYSSRLLQYSDALEHLLTTGQGVVLERSIFSDFVFLEAMYNQGFIRKQCVDHYNEVKSVTICDYLPPHLVIYIDVPVPEVQRRIQKKGDPHEMKITSAYLQDIENAYKKTFLPEMSEKCEVLQYSAREAQDSKKVVEDIEYLKFDKGPWLKQDNRTLYHLRLLVQDKFEVLNYTSIPIFLPEVTIGAHQTDRVLHQFRELPGRKYSPGYNTEVGDKWIWLK

SEQ ID NO: 7124 - protein, 189 aa, unidentified; identical to SEQ ID NO: 2812

SEQ ID NO: 7125 - protein, 210 aa, unidentified
MRCLTTPMLLRALAQAARAGPPGGRSLHSSAVAATYKYVNMQDPEMDMKSVTDRAARTLLWTELFRGLGMTLSYLFREPATINYPFEKGPLSPRFRGEHALRRYPSGEERCIACKLCEAICPAQAITIEAEPRADGSRRTTRYDIDMTKCIYCGFCQEACPVDAIVEGPNFEFSTETHEELLYNKEKLLNNGDKWEAEIAANIQADYLYR

SEQ ID NO: 7126 - protein, 464 aa, unidentified
MLATRRLLGWSLPARVSVRFSGDTTAPKKTSFGSLKDEDRIFTNLYGRHDWRLKGSLSRGDWYKTKEILLKGPDWILGEIKTSGLRGRGGAGFPTGLKWSFMNKPSDGRPKYLVVNADEGEPGTCKDREILRHDPHKLLEGCLVGGRAMGARAAYIYIRGEFYNEASNLQVAIREAYEAGLIGKNACGSGYDFDVFVVRGAGAYICGEETALIESIEGKQGKPRLKPPFPADVGVFGCPTTVANVETVAVSPTICRRGGTWFAGFGRERNSGTKLFNISGHVNHPCTVEEEMSVPLKELIEKHAGGVTGGWDNLLAVIPGGSSTPLIPKSVCETVLMDFDALVQAQTGLGTAAVIVMDRSTDIVKAIARLIEFYKHESCGQCTPCREGVDWMNKVMARFVRGDARPAEIDSLWEISKQIEGHTICALGDGAAWPVQGLIRHFRPELEERMQRFAQQHQARQAAS

SEQ ID NO: 7127 - protein, 396 aa, unidentified
MACAGLLTVCLLRPPAPQPQPQTPRHPQLAPDPGPAGHTLFQDVFRRADKNDDGKLSFEEFQNYFADGVLSLGELQELFSGIDGHLTDNLETEKLCDYFSEHLGVYRPVLAALESLNRAVLAAMDATKLEYERASKVDQFVTRFLLRETVSQLQALQSSLEGASDTLEAQAHGWRSDAESVEAQSRLCGSRRAGRRALRSVSRSSTWSPGSSDTGRSSEAEMQWRLQVNRLQELIDQLECKVRAVGPGPHKGGPSWYPPEPGPCWRPGPHSVPSQAPRLEPLREEDLAKGPDLHILMAQRQVQVAEEGLQDFHRALRCYVDFTGAQSHCLHVSAQKMLDGASFTLYEFWQDEASWRRHQQSPGSKAFQRILIDHLRAPDTLTTVFFPASWWIMNNN

SEQ ID NO: 7128 - protein, 517 aa, unidentified; identical to SEQ ID NO: 2817

SEQ ID NO: 7129 - protein, 810 aa, unidentified
MPMDLILVVWFCVCTARTVVGFGMDPDLQMDIVTELDLVNTTLGVAQVSGMHNASKAFLFQDIEREIHAAPHVSEKLIQLFRNKSEFTILATVQQKPSTSGVILSIRELEHSYFELESSGLRDEIRYHYIHNGKPRTEALPYRMADGQWHKVALSVSASHLLLHVDCNRIYERVIDPPDTNLPPGINLWLGQRNQKHGLFKGIIQDGKIIFMPNGYITQCPNLNHTCPTCSDFLSLVQGIMDLQELLAKMTAKLNYAETRLSQLENCHCEKTCQVSGLLYRDQDSWVDGDHCRNCTCKSGAVECRRMSCPPLNCSPDSLPVHIAGQCCKVCRPKCIYGGKVLAEGQRILTKSCRECRGGVLVKITEMCPPLNCSEKDHILPENQCCRVCRGHNFCAEGPKCGENSECKNWNTKATCECKSGYISVQGDSAYCEDIDECAAKMHYCHANTVCVNLPGLYRCDCVPGYIRVDDFSCTEHDECGSGQHNCDENAICTNTVQGHSCTCKPGYVGNGTICRAFCEEGCRYGGTCVAPNKCVCPSGFTGSHCEKDIDECSEGIIECHNHSRCVNLPGWYHCECRSGFHDDGTYSLSGESCIDIDECALRTHTCWNDSACINLAGGFDCLCPSGPSCSGDCPHEGGLKHNGQVWTLKEDRCSVCSCKDGKIFCRRTACDCQNPSADLFCCPECDTRVTSQCLDQNGHKLYRSGDNWTHSCQQCRCLEGEVDCWPLTCPNLSCEYTAILEGECCPRCVSDPCLADNITYDIRKTCLDSYGVSRLSGSVWTMAGSPCTTCKCKNGRVCCSVDFECLQNN

SEQ ID NO: 7130 - protein, 816 aa, unidentified; identical to SEQ ID NO: 2822

SEQ ID NO: 7131 - protein, 172 aa, unidentified
MVGPAPRRRLRPLAALALVLALAPGLPTARAGQTPRPAERGPPVRLFTEEELARYGGEEEDQPIYLAVKGVVFDVTSGKEFYGRGAPYNALTGKDSTRGVAKMSLDPADLTHDTTGLTAKELEALDEVFTKVYKAKYPIVGYTARRILNEDGSPNLDFKPEDQPHFDIKDEF

SEQ ID NO: 7132 - protein, 533 aa, unidentified; identical to SEQ ID NO: 2826

SEQ ID NO: 7133 - protein, 1347 aa, unidentified; identical to SEQ ID NO: 2830

SEQ ID NO: 7134 - protein, 772 aa, unidentified
MLSLKKYLTEGLLQFTILLSLIGVRVDVDTYLTSQLPPLREIILGPSSAYTQTQFHNLRNTLDGYGIHPKSIDLDNYFTARRLLSQVRALDRFQVPTTEVNAWLVHRDPEGSVSGSQPNSGLALESSSGLQDVTGPDNGVRESETEQGFGEDLEDLGAVAPPVSGDLTKEDIDLIDILWRQDIDLGAGREVFDYSHRQKEQDVEKELRDGGEQDTWAGEGAEALARNLLVDGETGESFPAQVPSGEDQTALSLEECLRLLEATCPFGENAEFPADISSITEAVPSESEPPALQNNLLSPLLTGTESPFDLEQQWQDLMSIMEMQAMEVNTSASEILYSAPPGDPLSTNYSLAPNTPINQNVSLHQASLGGCSQDFLLFSPEVESLPVASSSTLLPLAPSNSTSLNSTFGSTNLTGLFFPPQLNGTANDTAGPELPDPLGGLLDEAMLDEISLMDLAIEEGFNPVQASQLEEEFDSDSGLSLDSSHSPSSLSSSEGSSSSSSSSSSSSSSASSSASSSFSEEGAVGYSSDSETLDLEEAEGAVGYQPEYSKFCRMSYQDPAQLSCLPYLEHVGHNHTYNMAPSALDSADLPPPSALKKGSKEKQADFLDKQMSRDEHRARAMKIPFTNDKIINLPVEEFNELLSKYQLSEAQLSLIRDIRRRGKNKMAAQNCRKRKLDTILNLERDVEDLQRDKARLLREKVEFLRSLRQMKQKVQSLYQEVFGRLRDENGRPYSPSQYALQYAGDGSVLLIPRTMADQQARRQERKPKDRRK

SEQ ID NO: 7135 - protein, 694 aa, unidentified
MKHLKRWWSAGGGLLHLTLLLSLAGLRVDLDLYLLLPPPTLLQDELLFLGGPASSAYALSPFSASGGWGRAGHLHPKGRELDPAAPPEGQLLREVRALGVPFVPRTSVDAWLVHSVAAGSADEAHGLLGAAAASSTGGAGASVDGGSQAVQGGGGDPRAARSGPLDAGEEEKAPAEPTAQVPDAGGCASEENGVLREKHEAVDHSSQHEENEERVSAQKENSLQQNDDDENKIAEKPDWEAEKTTESRNERHLNGTDTSFSLEDLFQLLSSQPENSLEGISLGDIPLPGSISDGMNSSAHYHVNFSQAISQDVNLHEAILLCPNNTFRRDPTARTSQSQEPFLQLNSHTTNPEQTLPGTNLTGFLSPVDNHMRNLTSQDLLYDLDINIFDEINLMSLATEDNFDPIDVSQLFDEPDSDSGLSLDSSHNNTSVIKSNSSHSVCDEGAIGYCTDHESSSHHDLEGAVGGYYPEPSKLCHLDQSDSDFHGDLTFQHVFHNHTYHLQPTAPESTSEPFPWPGKSQKIRSRYLEDTDRNLSRDEQRAKALHIPFSVDEIVGMPVDSFNSMLSRYYLTDLQVSLIRDIRRRGKNKVAAQNCRKRKLDIILNLEDDVCNLQAKKETLKREQAQCNKAINIMKQKLHDLYHDIFSRLRDDQGRPVNPNHYALQCTHDGSILIVPKELVASGHKKETQKGKRK

SEQ ID NO: 7136 - protein, 710 aa, unidentified
METRESEDLEKTRRKSASDQWNTDNEPAKVKPELLPEKEETSQADQDIQDKEPHCHIPIKRNSIFNRSIRRKSKAKARDNPERNASCLADSQDNGKSVNEPLTLNIPWSRMPPCRTAMQTDPGAQEMSESSSTPGNGATPEEWPALADSPTTLTEALRMIHPIPADSWRNLIEQIGLLYQEYRDKSTLQEIETRRQQDAEIEDNTNGSPASEDTPEEEEEEEEEEEPASPPERKTLPQICLLSNPHSRFNLWQDLPEIRSSGVLEILQPEEIKLQEAMFELVTSEASYYKSLNLLVSHFMENERIRKILHPSEAHILFSNVLDVLAVSERFLLELEHRMEENIVISDVCDIVYRYAADHFSVYITYVSNQTYQERTYKQLLQEKAAFRELIAQLELDPKCRGLPFSSFLILPFQRITRLKLLVQNILKRVEERSERECTALDAHKELEMVVKACNEGVRKMSRTEQMISIQKKMEFKIKSVPIISHSRWLLKQGELQQMSGPKTSRTLRTKKLFHEIYLFLFNDLLVICRQIPGDKYQVFDSAPRGLLRVEELEDQGQTLANVFILRLLENADDREATYMLKASSQSEMKRWMTSLAPNRRTKFVSFTSRLLDCPQVQCVHPYVAQQPDELTLELADILNILDKTDDGWIFGERLHDQERGWFPSSMTEEILNPKIRSQNLKECFRVHKMDDPQRSQNKDRRKLGSRNRQ

SEQ ID NO: 7137 - protein, 241 aa, unidentified
MSMLFYTLITAFLIGIQAEPHSESNVPAGHTIPQAHWTKLQHSLDTALRRARSAPAAAIAARVAGQTRNITVDPRLFKKRRLRSPRVLFSTQPPREAADTQDLDFEVGGAAPFNRTHRSKRSSSHPIFHRGEFSVCDSVSVWVGDKTTATDIKGKEVMVLGEVNINNSVFKQYFFETKCRDPNPVDSGCRGIDSKHWNSYCTTTHTFVKALTMDGKQAAWRFIRIDTACVCVLSRKAVRRA

SEQ ID NO: 7138 - protein, 654 aa, unidentified [sequence omitted]

SEQ ID NO: 7139 - protein, 291 aa, unidentified
MAVTLSLLLGGRVCAAVTRCGFATRGVAGPGPIGREPDPDSDWEPEERELQEVESTLKRQKQAIRFQKIRRQMEAPGAPPRTLTWEAMEQIRYLHEEFPESWSVPRLAEGFDVSTDVIRRVLKSKFLPTLEQKLKQDQKVLKKAGLAHSLQHLRGSGNTSKLLPAGHSVSGSLLMPGHEASSKDPNHSTALKVIESDTHRTNTPRRRKGRNKEIQDLEESFVPVAAPLGHPRELQKYSSDSESPRGTGSGALPSGQKLEELKAEEPDNFSSKVVQRGREFFDSNGNFLYRI

SEQ ID NO: 7140 - protein, 347 aa, unidentified
MARFWVCVAGAGFFLAFLVLHSRFCGSPVLRNFTFAVSWRTEKILYRLDVGWPKHPEYFTGTTFCVAVDSLNGLVYIGQRGDNIPKILVFTEDGYFLRAWNYTVDTPHGIFAASTLYEQSVWITDVGSGFFGHTVKKYSSFGDLVQVLGTPGKKGTSLNPLQFDNPAELYVEDTGDIYIVDGDGGLNNRLIKLSQDFMILWLHGENGTGPAKFNIPHSVTLDSAGRVWVADRGNKRIQVFDKDTGEWLGAWNNCFTEEGPSSVRFTPDGKYLIVAQLNLSRLSVVAAPPVGSIGECSVISTIQLADQVLPHLLEVDRKTGAVYVAEIGAKQVQKYVPLNSYVPSFGS

SEQ ID NO: 7141 - protein, 1247 aa, unidentified
MLASSSRIRAAWTRALLLPLLLAGPVGCLSRQELFPFGPGQGDLELEDGDDFVSPALELSGALRFYDRSDIDAVYVTTNGIIATSEPPAKESHPGLFPPTFGAVAPFLADLDTTDGLGKVYYREDLSPSITQRAAECVHRGFPEISFQPSSAVVVTWESVAPYQGPSRDPDQKGKRNTFQAVLASSDSSSYAIFLYPEDGLQFHTTFSKKENNQVPAVVAFSQGSVGFLWKSNGAYNIFANDRESVENLAKSSNSGQQGVWVFEIGSPATTNGVVPADVILGTEDGAEYDDEDEDYDLATTRLGLEDVGTTPFSYKALRRGGADTYSVPSVLSPRRAATERPLGPPTERTRSFQLAVETFHQQHPQVIDVDEVEETGVVFSYNTDSRQTCANNRHQCSVHAECRDYATGFCCSCVAGYTGNGRQCVAEGSPQRVNGKVKGRIFVGSSQVPIVFENTDLHSYVVMNHGRSYTAISTIPETVGYSLLPLAPVGGIIGWMFAVEQDGFKNGFSITGGEFTRQAEVTFVGHPGNLVIKQRFSGIDEHGHLTIDTELEGRVPQIPFGSSVHIEPYTELYHYSTSVITSSSTREYTVTEPERDGASPSRIYTYQWRQTITFQECVHDDSRPALPSTQQLSVDSVFVLYNQEEKILRYALSNSIGPVREGSPDALQNPCYIGTHGCDTNAACRPGPRTQFTCECSIGFRGDGRTCYDIDECSEQPSVCGSHTICNNHPGTFRCECVEGYQFSDEGTCVAVVDQRPINYCETGLHNCDIPQRAQCIYTGGSSYTCSCLPGFSGDGQACQDVDECQPSRCHPDAFCYNTPGSFTCQCKPGYQGDGFRCVPGEVEKTRCQHEREHILGAAGATDPQRPIPPGLFVPECDAHGHYAPTQCHGSTGYCWCVDRDGREVEGTRTRPGMTPPCLSTVAPPIHQGPAVPTAVIPLPPGTHLLFAQTGKIERLPLEGNTMRKTEAKAFLHVPAKVIIGLAFDCVDKMVYWTDITEPSIGRASLHGGEPTTIIRQDLGSPEGIAVDHLGRNIFWTDSNLDRIEVAKLDGTQRRVLFETDLVNPRGIVTDSVRGNLYWTDWNRDNPKIETSYMDGTNRRILVQDDLGLPNGLTFDAFSSQLCWVDAGTNRAECLNPSQPSRRKALEGLQYPFAVTSYGKNLYFTDWKMNSVVALDLAISKETDAFQPHKQTRLYGITTALSQCPQGHNYCSVNNGGCTHLCLATPGSRTCRCPDNTLGVDCIEQK

SEQ ID NO: 7142 - protein, 1375 aa, unidentified
MEGDRVAGRPVLSSLPVLLLLPLLMLRAAALHPDELFPHGESWGDQLLQEGDDESSAVVKLANPLHFYEARFSNLYVGTNGIISTQDFPRETQYVDYDFPTDFPAIAPFLADIDTSHGRGRVLYREDTSPAVLGLAARYVRAGFPRSARFTPTHAFLATWEQVGAYEEVKRGALPSGELNTFQAVLASDGSDSYALFLYPANGLQFLGTRPKESYNVQLQLPARVGFCRGEADDLKSEGPYFSLTSTEQSVKNLYQLSNLGIPGVWAFHIGSTSPLDNVRPAAVGDLSAAHSSVPLGRSFSHATALESDYNEDNLDYYDVNEEEAEYLPGEPEEALNGHSSIDVSFQSKVDTKPLEESSTLDPHTKEGTSLGEVGGPDLKGQVEPWDERETRSPAPPEVDRDSLAPSWETPPPYPENGSIQPYPDGGPVPSEMDVPPAHPEEEIVLRSYPASGHTTPLSRGTYEVGLEDNIGSNTEVFTYNAANKETCEHNHRQCSRHAFCTDYATGFCCHCQSKFYGNGKHCLPEGAPHRVNGKVSGHLHVGHTPVHFTDVDLHAYIVGNDGRAYTAISHIPQPAAQALLPLTPIGGLFGWLFALEKPGSENGFSLAGAAFTHDMEVTFYPGEETVRITQTAEGLDPENYLSIKTNIQGQVPYVSANFTAHISPYKELYHYSDSTVTSTSSRDYSLTFGAINQTWSYRIHQNITYQVCRHAPRHPSFPTTQQLNVDRVFALYNDEERVLRFAVTNQIGPVKEDSDPTPGNPCYDGSHMCDTTARCHPGTGVDYTCECASGYQGDGRNCVDENECATGFHRCGPNSVCINLPGSYRCECRSGYEFADDRHTCILITPPANPCEDGSHTCAPAGQARCVHHGGSTFSCACLPGYAGDGHQCTDVDECSENRCHPAATCYNTPGSFSCRCQPGYYGDGFQCIPDSTSSLTPCEQQQRHAQAQYAYPGARFHIPQCDEQGNFLPLQCHGSTGFCWCVDPDGHEVPGTQTPPGSTPPHCGPSPEPTQRPPTICERWRENLLEHYGGTPRDDQYVPQCDDLGHFIPLQCHGKSDFCWCVDKDGREVQGTRSQPGTTPACIPTVAPPMVRPTPRPDVTPPSVGTFLLYTQGQQIGYLPLNGTRLQKDAAKTLLSLHGSIIVGIDYDCRERMVYWTDVAGRTISRAGLELGAEPETIVNSGLISPEGLAIDHIRRTMYWTDSVLDKIESALLDGSERKVLFYTDLVNPRAIAVDPIRGNLYWTDWNREAPKIETSSLDGENRRILINTDIGLPNGLTFDPFSKLLCWADAGTKKLECTLPDGTGRRVIQNNLKYPFSIVSYADHFYHTDWRRDGVVSVNKHSGQFTDEYLPEQRSHLYGITAVYPYCPTGRK

SEQ ID NO: 7143 - protein, 165 aa, unidentified; identical to SEQ ID NO: 2847

SEQ ID NO: 7144 - protein, 848 aa, unidentified; identical to SEQ ID NO: 2850

SEQ ID NO: 7145 - protein, 816 aa, unidentified; identical to SEQ ID NO: 2852

SEQ ID NO: 7146 - protein, 1200 aa, unidentified
MKVAGGLELGAAALLSASPRALVTLSTGPTCSILPKNPLFPQNLSSQPCIKMEGDKSLTFSSYGLQWCLYELDKEEFQTFKELLKKKSSESTTCSIPQFEIENANVECLALLLHEYYGASLAWATSISIFENMNLRTLSEKARDDMKRHSPEDPEATMTDQGPSKEKVPGISQAVQQDSATAAETKEQEISQAMEQEGATAAETEEQEISQAMEQEGATAAETEEQGHGGDTWDYKSHVMTKFAEEEDVRRSFENTAADWPEMQTLAGAFDSDRWGFRPRTVVLHGKSGIGKSALARRIVLCWAQGGLYQGMFSYVFFLPVREMQRKKESSVTEFISREWPDSQAPVTEIMSRPERLLFIIDGFDDLGSVLNNDTKLCKDWAEKQPPFTLIRSLLRKVLLPESFLIVTVRDVGTEKLKSEVVSPRYLLVRGISGEQRIHLLLERGIGEHQKTQGLRAIMNNRELLDQCQVPAVGSLICVALQLQDVVGESVAPFNQTLTGLHAAFVFHQLTPRGVVRRCLNLEERVVLKRFCRMAVEGVWNRKSVFDGDDLMVQGLGESELRALFHMNILLPDSHCEEYYTFFHLSLQDFCAALYYVLEGLEIEPALCPLYVEKTKRSMELKQAGFHIHSLWMKRFLFGLVSEDVRRPLEVLLGCPVPLGVKQKLLHWVSLLGQQPNATTPGDTLDAFHCLFETQDKEFVRLALNSFQEVWLPINQNLDLIASSFCLQHCPYLRKIRVDVKGIFPRDESAEACPVVPLWMRDKTLIEEQWEDFCSMLGTHPHLRQLDLGSSILTERAMKTLCAKLRHPTCKIQTLMFRNAQITPGVQHLWRIVMANRNLRSLNLGGTHLKEEDVRMACEALKHPKCLLESLRLDCCGLTHACYLKISQILTTSPSLKSLSLAGNKVTDQGVMPLSDALRVSQCALQKLILEDCGITATGCQSLASALVSNRSLTHLCLSNNSLGNEGVNLLCRSMRLPHCSLQRLMLNQCHLDTAGCGFLALALMGNSWLTHLSLSMNPVEDNGVKLLCEVMREPSCHLQDLELVKCHLTAACCESLSCVISRSRHLKSLDLTDNALGDGGVAALCEGLKQKNSVLARLGLKACGLTSDCCEALSLALSCNRHLTSLNLVQNNFSPKGMMKLCSAFACPTSNLQIIGLWKWQYPVQIRKLLEEVQLLKPRVVIDGSWHSFDEDDRYWWKN

SEQ ID NO: 7147 - protein, 121 aa, unidentified
MARRAGGARMFGSLLLFALLAAGVAPLSWDLPEPRSRASKIRVHSRGNLWATGHFMGKKSLEPSSPSPLGTAPHTSLRDQRLQLSHDLLGILLLKKALGVSLSRPAPQIQYRRLLVQILQK

SEQ ID NO: 7148 - protein, 152 aa, unidentified
MANCERTFIAIKPDGVQRGLVGEIIKRFEQKGFRLVGLKFMQASEDLLKEHYVDLKDRPFFAGLVKYMHSGPVVAMVWEGLNVVKTGRVMLGETNPADSKPGTIRGDFCIQVGRNIIHGSDSVESAEKEIGLWFHPEELVDYTSCAQNWIYE

SEQ ID NO: 7149 - protein, 152 aa, unidentified
MANLERTFIAIKPDGVQRGLVGEIIKRFEQKGFRLVAMKFLRASEEHLKQHYIDLKDRPFFPGLVKYMNSGPVVAMVWEGLNVVKTGRVMLGETNPADSKPGTIRGDFCIQVGRNIIHGSDSVKSAEKEISLWFKPEELVDYKSCAHDWVYE

SEQ ID NO: 7150 - protein, 169 aa, unidentified
MICLVLTIFANLFPAACTGAHERTFLAVKPDGVQRRLVGEIVRRFERKGFKLVALKLVQASEELLREHYAELRERPFYGRLVKYMASGPVVAMVWQGLDVVRTSRALIGATNPADAPPGTIRGDFCIEVGKNLIHGSDSVESARREIALWFRADELLCWEDSAGHWLYE

SEQ ID NO: 7151 - protein, 153 aa, unidentified
MKHLRPQFPLILAIYCFCMLQIPSSGFPQPLADPSDGLDIVQLEQLAYCLSQWAPLSRQPKDNQDIYKRFLFHYSRTQEATHPVKTGFPPVHPLMHLAAKLANRRMKRILQRGSGTAAVDFTKKDHTATWGRPFFLFRPRNGRNIEDEAQIQW

SEQ ID NO: 7152 - protein, 174 aa, unidentified
MLRTESCRPRSPAGQVAAASPLLLLLLLLAWCAGACRGAPILPQGLQPEQQLQLWNEIDDTCSSFLSIDSQPQASNALEELCFMIMGMLPKPQEQDEKDNTKRFLFHYSKTQKLGKSNVVSSVVHPLLQLVPHLHERRMKRFRVDEEFQSPFASQSRGYFLFRPRNGRRSAGFI

SEQ ID NO: 7153 - protein, 698 aa, unidentified
MLPARLPFRLLSLFLRGSAPTAARHGLREPLLERRCAAASSFQHSSSLGRELPYDPVDTEGFGEGGDMQERFLFPEYILDPEPQPTREKQLQELQQQQEEEERQRQQRREERRQQNLRARSREHPVVGHPDPALPPSGVNCSGCGAELHCQDAGVPGYLPREKFLRTAEADGGLARTVCQRCWLLSHHRRALRLQVSREQYLELVSAALRRPGPSLVLYMVDLLDLPDALLPDLPALVGPKQLIVLGNKVDLLPQDAPGYRQRLRERLWEDCARAGLLLAPGHQGPQRPVKDEPQDGENPNPPNWSRTVVRDVRLISAKTGYGVEELISALQRSWRYRGDVYLVGATNAGKSTLFNTLLESDYCTAKGSEAIDRATISPWPGTTLNLLKFPICNPTPYRMFKRHQRLKKDSTQAEEDLSEQEQNQLNVLKKHGYVVGRVGRTFLYSEEQKDNIPFEFDADSLAFDMENDPVMGTHKSTKQVELTAQDVKDAHWFYDTPGITKENCILNLLTEKEVNIVLPTQSIVPRTFVLKPGMVLFLGAIGRIDFLQGNQSAWFTVVASNILPVHITSLDRADALYQKHAGHTLLQIPMGGKERMAGFPPLVAEDIMLKEGLGASEAVADIKFSSAGWVSVTPNFKDRLHLRGYTPEGTVLTVRPPLLPYIVNIKGQRIKKSVAYKTKKPPSLMYNVRKKKGKINV

SEQ ID NO: 7154 - protein, 347 aa, unidentified
MHAHCLPFLLHAWWALLQAGAATVATALLRTRGQPSSPSPLAYMLSLYRDPLPRADIIRSLQAEDVAVDGQNWTFAFDFSFLSQQEDLAWAELRLQLSSPVDLPTEGSLAIEIFHQPKPDTEQASDSCLERFQMDLFTVTLSQVTFSLGSMVLEVTRPLSKWLKHPGALEKQMSRVAGECWPRPPTPPATNVLLMLYSNLSQEQRQLGGSTLLWEAESSWRAQEGQLSWEWGKRHRRHHLPDRSQLCRKVKFQVDFNLIGWGSWIIYPKQYNAYRCEGECPNPVGEEFHPTNHAYIQSLLKRYQPHRVPSTCCAPVKTKPLSMLYVDNGRVLLDHHKDMIVEECGCL

SEQ ID NO: 7155 - protein, 232 aa, unidentified
MERCPSLGVTLYALVVVLGLRATPAGGQHYLHIRPAPSDNLPLVDLIEHPDPIFDPKEKDLNETLLRSLLGGHYDPGFMATSPPEDRPGGGGGAAGGAEDLAELDQLLRQRPSGAMPSEIKGLEFSEGLAQGKKQRLSKKLRRKLQMWLWSQTFCPVLYAWNDLGSRFWPRYVKVGSCFSKRSCSVPEGMVCKPSKSVHLTVLRWRCQRRGGQRCGWIPIQYPIISECKCSC

SEQ ID NO: 7156 - protein, 1222 aa, unidentified; identical to SEQ ID NO: 2861

SEQ ID NO: 7157 - protein, 2321 aa, unidentified; identical to SEQ ID NO: 2864

SEQ ID NO: 7158 - protein, 496 aa, unidentified
MGRGVRVLLLLSLLHCAGGSEGRKTWRRRGQQPPPPPRTEAAPAAGQPVESFPLDFTAVEGNMDSFMAQVKSLAQSLYPCSAQQLNEDLRLHLLLNTSVTCNDGSPAGYYLKESRGSRRWLLFLEGGWYCFNRENCDSRYDTMRRLMSSRDWPRTRTGTGILSSQPEENPYWWNANMVFIPYCSSDVWSGASSKSEKNEYAFMGALIIQEVVRELLGRGLSGAKVLLLAGSSAGGTGVLLNVDRVAEQLEKLGYPAIQVRGLADSGWFLDNKQYRHTDCVDTITCAPTEAIRRGIRYWNGVVPERCRRQFQEGEEWNCFFGYKVYPTLRCPVFVVQWLFDEAQLTVDNVHLTGQPVQEGLRLYIQNLGRELRHTLKDVPASFAPACLSHEIIIRSHWTDVQVKGTSLPRALHCWDRSLHDSHKASKTPLKGCPVHLVDSCPWPHCNPSCPTVRDQFTGQEMNVAQFLMHMGFDMQTVAQPQGLEPSELLGMLSNGS

SEQ ID NO: 7159 - protein, 357 aa, unidentified
MQSVQSTSFCLRKQCLCLTFLLLHLLGQVAATQRCPPQCPGRCPATPPTCAPGVRAVLDGCSCCLVCARQRGESCSDLEPCDESSGLYCDRSADPSNQTGICTAVEGDNCVFDGVIYRSGEKFQPSCKFQCTCRDGQIGCVPRCQLDVLLPEPNCPAPRKVEVPGECCEKWICGPDEEDSLGGLTLAAYRPEATLGVEVSDSSVNCIEQTTEWTACSKSCGMGFSTRVTNRNRQCEMLKQTRLCMVRPCEQEPEQPTDKKGKKCLRTKKSLKAIHLQFKNCTSLHTYKPRFCGVCSDGRCCTPHNTKTIQAEFQCSPGQIVKKPVMVIGTCTCHTNCPKNNEAFLQELELKTTRGKM

SEQ ID NO: 7160 - protein, 125 aa, unidentified
MARSATLAAAALALCLLLAPPGLAWYKPAAGHSSYSVGRAAGLLSGLRRSPYARRSQPYRGAEPPGGAGASPELQLHPRLRSLAVCVQDVAPNLQRCERLPDGRGTYQCKANVFLSLRAADCLAA

SEQ ID NO: 7161 - protein, 151 aa, unidentified
MRFLAATFLLLALSTAAQAEPVQFKDCGSVDGVIKEVNVSPCPTQPCQLSKGQSYSVNVTFTSNIQSKSSKAVVHGILMGVPVPFPIPEPDGCKSGINCPIQKDKTYSYLNKLPVKSEYPSIKLVVEWQLQDDKNQSLFCWEIPVQIVSHL

SEQ ID NO: 7162 - protein, 522 aa, unidentified; identical to SEQ ID NO: 2876

SEQ ID NO: 7163 - protein, 1241 aa, unidentified; identical to SEQ ID NO: 2878

SEQ ID NO: 7164 - protein, 565 aa, unidentified
MDFLLALVLVSSLYLQAAAEFDGRWPRQIVSSIGLCRYGGRIDCCWGWARQSWGQCQPVCQPRCKHGECIGPNKCKCHPGYAGKTCNQDLNECGLKPRPCKHRCMNTYGSYKCYCLNGYMLMPDGSCSSALTCSMANCQYGCDVVKGQIRCQCPSPGLQLAPDGRTCVDVDECATGRASCPRFRQCVNTFGSYICKCHKGFDLMYIGGKYQCHDIDECSLGQYQCSSFARCYNIRGSYKCKCKEGYQGDGLTCVYIPKVMIEPSGPIHVPKGNGTILKGDTGNNNWIPDVGSTWWPPKTPYIPPIITNRPTSKPTTRPTPKPTPIPTPPPPPPLPTELRTPLPPTTPERPTTGLTTIAPAASTPPGGITVDNRVQTDPQKPRGDVFIPRQPSNDLFEIFEIERGVSADDEAKDDPGVLVHSCNFDHGLCGWIREKDNDLHWEPIRDPAGGQYLTVSAAKAPGGKAARLVLPLGRLMHSGDLCLSFRHKVTGLHSGTLQVFVRKHGAHGAALWGRNGGHGWRQTQITLRGADIKSVVFKGEKRRGHTGEIGLDDVSLKKGHCSEER

SEQ ID NO: 7165 - protein, 151 aa, unidentified
MSSFSTTTVSFLLLLAFQLLGQTRANPMYNAVSNADLMDFKNLLDHLEEKMPLEDEVVPPQVLSEPNEEAGAALSPLPEVPPWTGEVSPAQRDGGALGRGPWDSSDRSALLKSKLRALLTAPRSLRRSSCFGGRMDRIGAQSGLGCNSFRY

SEQ ID NO: 7166 - protein, 134 aa, unidentified
MDPQTAPSRALLLLLFLHLAFLGGRSHPLGSPGSASDLETSGLQEQRNHLQGKLSELQVEQTSLEPLQESPRPTGVWKSREVATEGIRGHRKMVLYTLRAPRSPKMVQGSGCFGRKMDRISSSSGLGCKVLRRH

SEQ ID NO: 7167 - protein, 126 aa, unidentified
MHLSQLLACALLLTLLSLRPSEAKPGAPPKVPRTPPAEELAEPQAAGGGQKKGDKAPGGGGANLKGDRSRLLRDLRVDTKSRAAWARLLQEHPNARKYKGANKKGLSKGCFGLKLDRIGSMSGLGC

SEQ ID NO: 7168 - protein, 89 aa, unidentified
MISSVKLNLILVLSLSTMHVFWCYPVPSSKVSGKSDYFLILLNSCPTRLDRSKELAFLKPILEKMFVKRSFRNGVGTGMKKTSFQRAKS

SEQ ID NO: 7169 - protein, 432 aa, unidentified
MPAGRAARTCALLALCLLGAGAQDFGPTRFICTSVPVDADMCAASVAAGGAEELRSSVLQLRETVLQQKETILSQKETIRELTAKLGRCESQSTLDPGAGEARAGGGRKQPGSGKNTMGDLSRTPAAETLSQLGQTLQSLKTRLENLEQYSRLNSSSQTNSLKDLLQSKIDELERQVLSRVNTLEEGKGGPRNDTEERVKIETALTSLHQRISELEKGQKDNRPGDKFQLTFPLRTNYMYAKVKKSLPEMYAFTVCMWLKSSATPGVGTPFSYAVPGQANELVLIEWGNNPMEILINDKVAKLPFVINDGKWHHICVTWTTRDGVWEAYQDGTQGGSGENLAPYHPIKPQGVLVLGQEQDTLGGGFDATQAFVGELAHFNIWDRKLTPGEVYNLATCSTKALSGNVIAWAESHIEIYGGATKWTFEACRQIN

SEQ ID NO: 7170 - protein, 431 aa, unidentified
MLALLAASVALAVAAGAQDSPAPGSRFVCTALPPEAVHAGCPLPAMPMQGGAQSPEEELRAAVLQLRETVVQQKETLGAQREAIRELTGKLARCEGLAGGKARGAGATGKDTMGDLPRDPGHVVEQLSRSLQTLKDRLESLEHQLRANVSNAGLPGDFREVLQQRLGELERQLLRKVAELEDEKSLLHNETSAHRQKTESTLNALLQRVTELERGNSAFKSPDAFKVSLPLRTNYLYGKIKKTLPELYAFTICLWLRSSASPGIGTPFSYAVPGQANEIVLIEWGNNPIELLINDKVAQLPLFVSDGKWHHICVTWTTRDGMWEAFQDGEKLGTGENLAPWHPIKPGGVLILGQEQDTVGGRFDATQAFVGELSQFNIWDRVLRAQEIVNIANCSTNMPGNIIPWVDNNVDVFGGASKWPVETCEERLLDL

SEQ ID NO: 7171 - protein, 500 aa, unidentified
MKFLAVLLAAGMLAFLGAVICIIASVPLAASPARALPGGADNASVASGAAASPGPQRSLSALHGAGGSAGPPALPGAPAASAHPLPPGPLFSRFLCTPLAAACPSGAQQGDAAGAAPGEREELLLLQSTAEQLRQTALQQEARIRADQDTIRELTGKLGRCESGLPRGLQGAGPRRDTMADGPWDSPALILELEDAVRALRDRIDRLEQELPARVNLSAAPAPVSAVPTGLHSKMDQLEGQLLAQVLALEKERVALSHSSRRQRQEVEKELDVLQGRVAELEHGSSAYSPPDAFKISIPIRNNYMYARVRKALPELYAFTACMWLRSRSSGTGQGTPFSYSVPGQANEIVLLEAGHEPMELLINDKVAQLPLSLKDNGWHHICIAWTTRDGLWSAYQDGELQGSGENLAAWHPIKPHGILILGQEQDTLGGRFDATQAFVGDIAQFNLWDHALTPAQVLGIANCTAPLLGNVLPWEDKLVEAFGGATKAAFDVCKGRAKA

SEQ ID NO: 7172 - protein, 196 aa, unidentified [sequence omitted]

SEQ ID NO: 7173 - protein, 165 aa, unidentified
MAWRPGERGAPASRPRLALLLLLLLLPLPSGAWYKHVASPRYHTVGRAAGLLMGLRRSPYLWRRALRAAAGPLARDTLSPEPAAREAPLLLPSWVQELWETRRRSSQAGIPVRAPRSPRAPEPALEPESLDFSGAGQRLRRDVSRPAVDPAANRLGLPCLAPGPF

SEQ ID NO: 7174 - protein, 97 aa, unidentified
MLGNKRLGLSGLTLALSLLVCLGALAEAYPSKPDNPGEDAPAEDMARYYSALRHYINLITRQRYGKRSSPETLISDLLMRESTENVPRTRLEDPAMW

SEQ ID NO: 7175 - protein, 231 aa, unidentified
MAGKKVLIVYAHQEPKSFNGSLKNVAVDELSRQGCTVTVSDLYAMNLEPRATDKDITGTLSNPEVFNYGVETHEAYKQRSLASDITDEQKKVREADLVIFQFPLYWFSVPAILKGWMDRVLCQGFAFDIPGFYDSGLLQGKLALLSVTTGGTAEMYTKTGVNGDSRYFLWPLQHGTLHFCGFKVLAPQISFAPEIASEEERKGMVAAWSQRLQTIWKEEPIPCTAHWHFGQ

SEQ ID NO: 7176 - protein, 1304 aa, unidentified; identical to SEQ ID NO: 2898

SEQ ID NO: 7177 - protein, 640 aa, unidentified; identical to SEQ ID NO: 2900

SEQ ID NO: 7178 - protein, 165 aa, unidentified
MMRCCRRRCCCRQPPHALRPLLLLPLVLLPPLAAAAAGPNRCDTIYQGFAECLIRLGDSMGRGGELETICRSWNDFHACASQVLSGCPEEAAAVWESLQQEARQAPRPNNLHTLCGAPVHVRERGTGSETNQETLRATAPALPMAPAPPLLAAALALAYLLRPLA

SEQ ID NO: 7179 - protein, 923 aa, unidentified; identical to SEQ ID NO: 2907

SEQ ID NO: 7180 - protein, 931 aa, unidentified; identical to SEQ ID NO: 2908

SEQ ID NO: 7181 - protein, 197 aa, unidentified
MQRWKAAALASVLCSSVLSIWMCREGLLLSHRLGPALVPLHRLPRTLDARIARLAQYRALLQGAPDAMELRELTPWAGRPPGPRRRAGPRRRRARARLGARPCGLRELEVRVSELGLGYASDETVLFRYCAGACEAAARVYDLGLRRLRQRRRLRRERVRAQPCCRPTAYEDEVSFLDAHSRYHTVHELSARECACV

SEQ ID NO: 7182 - protein, 1477 aa, unidentified; identical to SEQ ID NO: 2912

SEQ ID NO: 7183 - protein, 1712 aa, unidentified; identical to SEQ ID NO: 2913

SEQ ID NO: 7184 - protein, 336 aa, unidentified
MRAPSMDRAAVARVGAVASASVCALVAGVVLAQYIFTLKRKTGRKTKIIEMMPEFQKSSVRIKNPTRVEEIICGLIKGGAAKLQIITDFDMTLSRFSYKGKRCPTCHNIIDNCKLVTDECRKKLLQLKEKYYAIEVDPVLTVEEKYPYMVEWYTKSHGLLVQQALPKAKLKEIVAESDVMLKEGYENFFDKLQQHSIPVFIFSAGIGDVLEEVIRQAGVYHPNVKVVSNFMDFDETGVLKGFKGELIHVFNKHDGALRNTEYFNQLKDNSNIILLGDSQGDLRMADGVANVEHILKIGYLNDRVDELLEKYMDSYDIVLVQDESLEVANSILQKIL

SEQ ID NO: 7185 - protein, 548 aa, unidentified
MTMAAAAVVARGAGARAATAAALRGGCGTAARGRPCAGPARPLCTAPGTAPDMKRYLWERYREAKRSTEELVPSIMSNLLNPDAIFSNNEMSLSDIEIYGFDYDYTLVFYSKHLHTLIFNAARDLLINEHRYPAEIRKYEYDPNFAIRGLHYDVQRAVLMKIDAFHYIQLGTVYRGLSVVPDEEVIEMYEGSHVPLEQMSDFYGKSSHGNTMKQFMDIFSLPEMTLLSCVNEYFLKNNIDYEPVHLYKDVKDSIRDVHIKGIMYRAIEADIEKYICYAEQTRAVLAKLADHGKKMFLITNSPSSFVDKGMSYIVGKDWRDLFDVVIVQAEKPNFFNDKRRPFRKMNEKGVLLWDKIHKLQKGQIYKQGNLYEFLKLTGWRGSRVLYFGDHIYSDLADLTLKHGWRTGAIIPELRSELKIMNTEQYIQTMTWLQTLTGLLEQMQVHRDAESQLVLQEWKKERKEMREMTKSFFNAQFGSLFRTDQNPTYFLRRLSRFADIYMASLSCLLNYDVSHTFYPRRTPLQHELPAWSERPPTFGTPLLQEAQAK

SEQ ID NO: 7186 - protein, 574 aa, unidentified; identical to SEQ ID NO: 2916

SEQ ID NO: 7187 - protein, 257 aa, unidentified
MSILFYVIFLAYLRGIQGNNMDQRSLPEDSLNSLIIKLIQADILKNKLSKQMVDVKENYQSTLPKAEAPREPERGGPAKSAFQPVIAMDTELLRQQRRYNSPRVLLSDSTPLEPPPLYLMEDYVGSPVVANRTSRRKRYAEHKSHRGEYSVCDSESLWVTDKSSAIDIRGHQVTVLGEIKTGNSPVKQYFYETRCKEARPVKNGCRGIDDKHWNSQCKTSQTYVRALTSENNKLVGWRWIRIDTSCVCALSRKIGRT

SEQ ID NO: 7188 - protein, 210 aa, unidentified
MLPLPSCSLPILLLFLLPSVPIESQPPPSTLPPFLAPEWDLLSPRVVLSRGAPAGPPLLFLLEAGAFRESAGAPANRSRRGVSETAPASRRGELAVCDAVSGWVTDRRTAVDLRGREVEVLGEVPAAGGSPLRQYFFETRCKADNAEEGGPGAGGGGCRGVDRRHWVSECKAKQSYVRALTADAQGRVGWRWIRIDTACVCTLLSRTGRA

SEQ ID NO: 7189 - protein, 344 aa, unidentified; identical to SEQ ID NO: 2917

SEQ ID NO: 7190 - protein, 604 aa, unidentified
MMRAVWEALAALAAVACLVGAVRGGPGLSMFAGQAAQPDPCSDENGHPRRCIPDFVNAAFGKDVRVSSTCGRPPARYCVVSERGEERLRSCHLCNASDPKKAHPPAFLTDLNNPHNLTCWQSENYLQFPHNVTLTLSLGKKFEVTYVSLQFCSPRPESMAIYKSMDYGRTWVPFQFYSTQCRKMYNRPHRAPITKQNEQEAVCTDSHTDMRPLSGGLIAFSTLDGRPSAHDFDNSPVLQDWVTATDIRVAFSRLHTFGDENEDDSELARDSYFYAVSDLQVGGRCKCNGHAARCVRDRDDSLVCDCRHNTAGPECDRCKPFHYDRPWQRATAREANECVACNCNLHARRCRFNMELYKLSGRKSGGVCLNCRHNTAGRHCHYCKEGYYRDMGKPITHRKACKACDCHPVGAAGKTCNQTTGQCPCKDGVTGITCNRCAKGYQQSRSPIAPCIKIPVAPPTTAASSVEEPEDCDSYCKASKGKLKINMKKYCKKDYAVQIHILKADKAGDWWKFTVNIISVYKQGTSRIRRGDQSLWIRSRDIACKCPKIKPLKKYLLLGNAEDSPDQSGIVADKSSLVIQWRDTWARRLRKFQQREKKGKCKKA

SEQ ID NO: 7191 - protein, 580 aa, unidentified
MPGWPWGLLLTAGTLFAALSPGPPAPADPCHDEGGAPRGCVPGLVNAALGREVLASSTCGRPATRACDASDPRRAHSPALLTSPGGTASPLCWRSESLPRAPLNVTLTVPLGKAFELVFVSLRFCSAPPASVALLKSQDHGRSWAPLGFFSSHCDLDYGRLPAPANGPAGPGPEALCFPAPLAQPDGSGLLAFSMQDSSPPGLDLDSSPVLQDWVTATDVRVVLTRPSTAGDPRDMEAVVPYSYAATDLQVGGRCKCNGHASRCLLDTQGHLICDCRHGTEGPDCGRCKPFYCDRPWQRATARESHACLACSCNGHARRCRFNMELYRLSGRRSGGVCLNCRHNTAGRHCHYCREGFYRDPGRALSDRRACRACDCHPVGAAGKTCNQTTGQCPCKDGVTGLTCNRCAPGFQQSRSPVAPCVKTPIPGPTEDSSPVQPQDCDSHCKPARGSYRISLKKFCKKDYAVQVAVGARGEARGAWTRFPVAVLAVFRSGEERARRGSSALWVPAGDAACGCPRLLPGRRYLLLGGGPGAAAGGAGGRGPGLIAARGSLVLPWRDAWTRRLRRLQRRERRGRCSAA

SEQ ID NO: 7192 - protein, 628 aa, unidentified
MGSCARLLLLWGCTVVAAGLSGVAGVSSRCEKACNPRMGNLALGRKLWADTTCGQNATELYCFYSENTDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTSKYSSPFPCTGGEVIFKALSPPYDTENPYSAKVQEQLKITNLRVQLLKRQSCPCQRNDLNEEPQHFTHYAIYDFIVKGSCFCNGHADQCIPVHGFRPVKAPGTFHMVHGKCMCKHNTAGSHCQHCAPLYNDRPWEAADGKTGAPNECRTCKCNGHADTCHFDVNVWEASGNRSGGVCDDCQHNTEGQYCQRCKPGFYRDLRRPFSAPDACKPCSCHPVGSAVLPANSVTFCDPSNGDCPCKPGVAGRRCDRCMVGYWGFGDYGCRPCDCAGSCDPITGDCISSHTDIDWYHEVPDFRPVHNKSEPAWEWEDAQGFSALLHSGKCECKEQTLGNAKAFCGMKYSYVLKIKILSAHDKGTHVEVNVKIKKVLKSTKLKIFRGKRTLYPESWTDRGCTCPILNPGLEYLVAGHEDIRTGKLIVNMKSFVQHWKPSLGRKVMDILKRECK

SEQ ID NO: 7193 - protein, 489 aa, unidentified
MPVTFALLLLLGQATADPCYDPQGRPQFCLPPVTQLAAVAASCPQACALSPGNHLGARETCNGSLTLALGGPFLLTSVSLRFCTPGPPALILSAAWASGGPWRLLWHRPAWPGALGGPERVTFHSTPGPKATVAASHLRVEFGGQAGLAAAGLRGRCQCHGHAARCAARARPPRCHCRHHTTGPGCESCRPSHRDWPWRPATPRHPHPCLPCSCNQHARRCRFNSELFRLSGGRSGGVCERCRHHTAGRHCHYCQPGFWRDPSQPIFSRRACRACQCHPIGATGGTCNQTSGQCTCKLGVTGLTCNRCGPGYQQSRSPRMPCQRIPEATTTLATTPGAYSSDPQCQNYCNMSDTRVHMSLRRYCQQDHVLRAQVLASEAAGPAWQRLAVRVLAVYKQRAQPVRRGDQDAWVPRADLTCGCLRLQPGTDYLLLGSAVGDPDPTRLILDRHGLALPWRPRWARPLKRLQQEERAGGCRGVRAPTPSPRPEH

SEQ ID NO: 7194 - protein, 539 aa, unidentified
MYLSRFLSIHALWVTVSSVMQPYPLVWGHYDLCKTQIYTEEGKVWDYMACQPESTDMTKYLKVKLDPPDITCGDPPETFCAMGNPYMCNNECDASTPELAHPPELMFDFEGRHPSTFWQSATWKEYPKPLQVNITLSWSKTIELTDNIVITFESGRPDQMILEKSLDYGRTWQPYQYYATDCLDAFHMDPKSVKDLSQHTVLEIICTEEYSTGYTTNSKIIHFEIKDRFAFFAGPRLRNMASLYGQLDTTKKLRDFFTVTDLRIRLLRPAVGEIFVDELHLARYFYAISDIKVRGRCKCNLHATVCVYDNSKLTCECEHNTTGPDCGKCKKNYQGRPWSPGSYLPIPKGTANTCIPSISSIGNCECFGHSNRCSYIDLLNTVICVSCKHNTRGQHCELCRLGYFRNASAQLDDENVCIECYCNPLGSIHDRCNGSGFCECKTGTTGPKCDECLPGNSWHYGCQPNVCDNELLHCQNGGTCHNNVRCLCPAAYTGILCEKLRCEEAGSCGSDSGQGAPPHGSPALLLLTTLLGTASPLVF

SEQ ID NO: 7195 - protein, 530 aa, unidentified
MLHLLALFLHCLPLASGDYDICKSWVTTDEGPTWEFYACQPKVMRLKDYVKVKVEPSGITCGDPPERFCSHENPYLCSNECDASNPDLAHPPRLMFDKEEEGLATYWQSITWSRYPSPLEANITLSWNKTVELTDDVVMTFEYGRPTVMVLEKSLDNGRTWQPYQFYAEDCMEAFGMSARRARDMSSSSAHRVLCTEEYSRWAGSKKEKHVRFEVRDRFAIFAGPDLRNMDNLYTRLESAKGLKEFFTLTDLRMRLLRPALGGTYVQRENLYKYFYAISNIEVIGRCKCNLHANLCSMREGSLQCECEHNTTGPDCGKCKKNFRTRSWRAGSYLPLPHGSPNACATAGSFGNCECYGHSNRCSYIDFLNVVTCVSCKHNTRGQHCQHCRLGYYRNGSAELDDENVCIECNCNQIGSVHDRCNETGFCECREGAAGPKCDDCLPTHYWRQGCYPNVCDDDQLLCQNGGTCLQNQRCACPRGYTGVRCEQPRCDPADDDGGLDCDRAPGAAPRPATLLGCLLLLGLAARLGR

SEQ ID NO: 7196 - protein, 170 aa, unidentified
MMAGMKIQLVCMLLLAFSSWSLCSDSEEEMKALEADFLTNMHTSKISKAHVPSWKMTLLNVCSLVNNLNSPAEETGEVHEEELVARRKLPTALDGFSLEAMLTIYQLHKICHSRAFQHWELIQEDILDTGNDKNGKEEVIKRKIPYILKRQLYENKPRRPYILKRDSYYY

SEQ ID NO: 7197 - protein, 319 aa, unidentified
MGIWQRLLLFGGVSLRAGGGATAPLGGSRAMVCGRQLSGAGSETLKQRRTQIMSRGLPKQKPIEGVKQVIVVASGKGGVGKSTTAVNLALALAANDSSKAIGLLDVDVYGPSVPKMMNLKGNPELSQSNLMRPLLNYGIACMSMGFLVEESEPVVWRGLMVMSAIEKLLRQVDWGQLDYLVVDMPPGTGDVQLSVSQNIPITGAVIVSTPQDIALMDAHKGAEMFRRVHVPVLGLVQNMSVFQCPKCKHKTHIFGADGARKLAQTLGLEVLGDIPLHLNIREASDTGQPIVFSQPESDEAKAYLRIAVEVVRRLPSPSE

SEQ ID NO: 7198 - protein, 461 aa, unidentified
MPPSGPRGTLLLLPLLLLLLLRAVLAVPLERGAPNKEETPATESPDTGLYYHRYLQEVIDVLETDGHFREKLQAANAEDIKSGKLSRELDFVSHHVRTKLDELKRQEVSRLRMLLKAKMDAEQDPNVQVDHLNLLKQFEHLDPQNQHTFEARDLELLIQTATRDLAQYDAAHHEEFKRYEMLKEHERRRYLESLGEEQRKEAERKLEEQQRRHREHPKVNVPGSQAQLKEVWEELDGLDPNRFNPKTFFILHDINSDGVLDEQELEALFTKELEKVYDPKNEEDDMREMEEERLRMREHVMKNVDTNQDRLVTLEEFLASTQRKEFGDTGEGWETVEMHPAYTEEELRRFEEELAAREAELNAKAQRLSQETEALGRSQGRLEAQKRELQQAVLHMEQRKQQQQQQQGHKAPAAHPEGQLKFHPDTDDVPVPAPAGDQKEVDTSEKKLLERLPEVEVPQHL

SEQ ID NO: 7199 - protein, 420 aa, unidentified
MRWRTILLQYCFLLITCLLTALEAVPIDIDKTKVQNIHPVESAKIEPPDTGLYYDEYLKQVIDVLETDKHFREKLQKADIEEIKSGRLSKELDLVSHHVRTKLDELKRQEVGRLRMLIKAKLDSLQDIGMDHQALLKQFDHLNHLNPDKFESTDLDMLIKAATSDLEHYDKTRHEEFKKYEMMKEHERREYLKTLNEEKRKEEESKFEEMKKKHENHPKVNHPGSKDQLKEVWEETDGLDPNDFDPKTFFKLHDVNSDGFLDEQELEALFTKELEKVYDPKNEEDDMVEMEEERLRMREHVMNEVDTNKDRLVTLEEFLKATEKKEFLEPDSWETLDQQQFFTEEELKEYENIIALQENELKKKADELQKQKEELQRQHDQLEAQKLEYHQVIQQMEQKKLQQGIPPSGPAGELKFEPHI

SEQ ID NO: 7200 - protein, 375 aa, unidentified
MSSSLRPGPSRWRRAASIVLAAGWSRPETATPPSRPPPAEGFRLLLLQRSPHQGFMPGAHVFSGGVLDAADRSADWLGLFAPHHGPPRFGLGPAPFSRTAFPSLPDTDDHKTDNTGTLPEDVAFRICAVREAFEEAGVLLLRPRTSPPGPAPGPGLALEPPPGLASWRDRVRQDPRHFLRLCAHLDCTPDIWALHNWSAWLTPFLRGTTRRFDTAFFLCCLREPPPVYPDLAEVVGYQWSSPSEATESFLSKEIWLPPPQFYEVRRLANFASLSDLHKFCLGRALEGLERWLPIILLTADGMVHLLPGDELYLEDSDFLENLMSTEKKTEEIMKEGKQFHRIVTYHRHLYDIHVTVQPKYKHVYPKNSVVRKSHL

SEQ ID NO: 7201 - protein, 350 aa, unidentified
MAGRLLGKALAAVSLSLALASVTIRSSRCRGIQAFRNSFSSSWFHLNTNVMSGSNGSKENSHNKARTSPYPGSKVERSQVPNEKVGWLVEWQDYKPVEYTAVSVLAGPRWADPQISESNFSPKFNEKDGHVERKSKNGLYEIENGRPRNPAGRTGLVGRGLLGRWGPNHAADPIITRWKRDSSGNKIMHPVSGKHILQFVAIKRKDCGEWAIPGGMVDPGEKISATLKREFGEEALNSLQKTSAEKREIEEKLHKLFSQDHLVIYKGYVDDPRNTDNAWMETEAVNYHDETGEIMDNLMLEAGDDAGKVKWVDINDKLKLYASHSQFIKLVAEKRDAHWSEDSEADCHAL

SEQ ID NO: 7202 - protein, 1391 aa, unidentified
MPSSLLGAAMPASTSAAALQEALENAGRLIDRQLQEDRMYPDLSELLMVSAPNNPTVSGMSDMDYPLQGPGLLSVPNLPEISSIRRVPLPPELVEQFGHMQCNCMMGVFPPISRAWLTIDSDIFMWNYEDGGDLAYFDGLSETILAVGLVKPKAGIFQPHVRHLLVLATPVDIVILGLSYANLQTGSGVLNDSLSGGMQLLPDPLYSLPTDNTYLLTITSTDNGRIFLAGKDGCLYEVAYQAEAGWFSQRCRKINHSKSSLSFLVPSLLQFTFSEDDPILQIAIDNSRNILYTRSEKGVIQVYDLGQDGQGMSRVASVSQNAIVSAAGNIARTIDRSVFKPIVQIAVIENSESLDCQLLAVTHAGVRLYFSTCPFRQPLARPNTLTLVHVRLPPGFSASSTVEKPSKVHRALYSKGILLMAASENEDNDILWCVNHDTFPFQKPMMETQMTAGVDGHSWALSAIDELKVDKIITPLNKDHIPITDSPVVVQQHMLPPKKFVLLSAQGSLMFHKLRPVDQLRHLLVSNVGGDGEEIERFFKLHQEDQACATCLILACSTAACDREVSAWATRAFFRYGGEAQMRFPTTLPPPSNVGPILGSPVYSSSPVPSGSPYPNPSFLGTPSHGIQPPAMSTPVCALGNPATQATNMSCVTGPEIVYSGKHNGICIYFSRIMGNIWDASLVVERIFKSGNREITAIESSVPCQLLESVLQELKGLQEFLDRNSQFAGGPLGNPNTTAKVQQRLIGFMRPENGNPQQMQQELQRKFHEAQLSEKISLQAIQQLVRKSYQALALWKLLCEHQFTIIVAELQKELQEQLKITTFKDLVIRDKELTGALIASLINCYIRDNAAVDGISLHLQDICPLLYSTDDAICSKANELLQRSRQVQNKTEKERMLRESLKEYQKISNQVDLSNVCAQYRQVRFYEGVVELSLTAAEKKDPQGLGLHFYKHGEPEEDIVGLQAFQERLNSYKCITDTLQELVNQSKAAPQSPSVPKKPGPPVLSSDPNMLSNEEAGHHFEQMLKLSQRSKDELFSIALYNWLIQVDLADKLLQVASPFLEPHLVRMAKVDQNRVRYMDLLWRYYEKNRSFSNAARVLSRLADMHSTEISLQQRLEYIARAILSAKSSTAISSIAADGEFLHELEEKMEVARIQLQIQETLQRQYSHHSSVQDAVSQLDSELMDITKLYGEFADPFKLAECKLAIIHCAGYSDPILVQTLWQDIIEKELSDSVTLSSSDRMHALSLKIVLLGKIYAGTPRFFPLDFIVQFLEQQVCTLNWDVGFVIQTMNEIGVPLPRLLEVYDQLFKSRDPFWNRMKKPLHLLDCIHVLLIRYVENPSQVLNCERRRFTNLCLDAVCGYLVELQSMSSSVAVQAITGNFKSLQAKLERLH

SEQ ID NO: 7203 - protein, 2090 aa, unidentified
MGDEMDAMIPEREMKDFQFRALKKVRIFDSPEELPKERSSLLAVSNKYGLVFAGGASGLQIFPTKNLLIQNKPGDDPNKIVDKVQGLLVPMKFPIHHLALSCDNLTLSACMMSSEYGSIIAFFDVRTFSNEAKQQKRPFAYHKLLKDAGGMVIDMKWNPTVPSMVAVCLADGSIAVLQVTETVKVCATLPSTVAVTSVCWSPKGKQLAVGKQNGTVVQYLPTLQEKKVIPCPPFYESDHPVRVLDVLWIGTYVFAIVYAAADGTLETSPDVVMALLPKKEEKHPEIFVNFMEPCYGSCTERQHHYYLSYIEEWDLVLAASAASTEVSILARQSDQINWESWLLEDSSRAELPVTDKSDDSLPMGVVVDYTNQVEITISDEKTLPPAPVLMLLSTDGVLCPFYMINQNPGVKSLIKTPERLSLEGERQPKSPGSTPTTPTSSQAPQKLDASAAAAPASLPPSSPAAPIATFSLLPAGGAPTVFSFGSSSLKSSATVTGEPPSYSSGSDSSKAAPGPGPSTFSFVPPSKASLAPTPAASPVAPSAASFSFGSSGFKPTLESTPVPSVSAPNIAMKPSFPPSTSAVKVNLSEKFTAAATSTPVSSSQSAPPMSPFSSASKPAASGPLSHPTPLSAPPSSVPLKSSVLPSPSGRSAQGSSSPVPSMVQKSPRITPPAAKPGSPQAKSLQPAVAEKQGHQWKDSDPVMAGIGEEIAHFQKELEELKARTSKACFQVGTSEEMKMLRTESDDLHTFLLEIKETTESLHGDISSLKTTLLEGFAGVEEAREQNERNRDSGYLHLLYKRPLDPKSEAQLQEIRRLHQYVKFAVQDVNDVLDLEWDQHLEQKKKQRHLLVPERETLFNTLANNREIINQQRKRLNHLVDSLQQLRLYKQTSLWSLSSAVPSQSSIHSFDSDLESLCNALLKTTIESHTKSLPKVPAKLSPMKQAQLRNFLAKRKTPPVRSTAPASLSRSAFLSQRYYEDLDEVSSTSSVSQSLESEDARTSCKDDEAVVQAPRHAPVVRTPSIQPSLLPHAAPFAKSHLVHGSSPGVMGTSVATSASKIIPQGADSTMLATKTVKHGAPSPSHPISAPQAAAAAALRRQMASQAPAVNTLTESTLKNVPQVVNVQELKNNPATPSTAMGSSVPYSTAKTPHPVLTPVAANQAKQGSLINSLKPSGPTPASGQLSSGDKASGTAKIETAVTSTPSASGQFSKPFSFSPSGTGFNFGIITPTPSSNFTAAQGATPSTKESSQPDAFSSGGGSKPSYEAIPESSPPSGITSASNTTPGEPAASSSRPVAPSGTALSTTSSKLETPPSKLGELLFPSSLAGETLGSFSGLRVGQADDSTKPTNKASSTSLTSTQPTKTSGVPSGFNFTAPPVLGKHTEPPVTSSATTTSVAPPAATSTSSTAVFGSLPVTSAGSSGVISFGGTSLSAGKTSFSFGSQQTNSTVPPSAPPPTTAATPLPTSFPTLSFGSLLSSATTPSLPMSAGRSTEEATSSALPEKPGDSEVSASAASLLEEQQSAQLPQAPPQTSDSVKKEPVLAQPAVSNSGTAASSTSLVALSAEATPATTGVPDARTEAVPPASSFSVPGQTAVTAAAISSAGPVAVETSSTPIASSTTSIVAPGPSAEAAAFGTVTSGSSVFAQPPAASSSSAFNQLTNNTATAPSATPVFGQVAASTAPSLFGQQTGSTASTAAATPQVSSSGFSSPAFGTTAPGVFGQTTFGQASVFGQSASSAASVFSFSQPGFSSVPAFGQPASSTPTSTSGSVFGAASSTSSSSSFSFGQSSPNTGGGLFGQSNAPAFGQSPGFGQGGSVFGGTSAATTTAATSGFSFCQASGFGSSNTGSVFGQAASTGGIVFGQQSSSSSGSVFGSGNTGRGGGFFSGLGGKPSQDAANKNPFSSASGGFGSTATSNTSNLFGNSGAKTFGGFASSSFGEQKPTGTFSSGGGSVASQGFGFSSPNKTGGFGAAPVFGSPPTFGGSPGFGGVPAFGSAPAFTSPLGSTGGKVFGEGTAAASAGGFGFGSSSNTTSFGTLASQNAPTFGSLSQQTSGFGTQSSGFSGFGSGTGGFSFGSNNSSVQGFGGWRS

SEQ ID NO: 7204 - protein, 656 aa, unidentified
MEELDGEPTVTLIPGVNSKKNQMYFDWGPGEMLVCETSFNKKEKSEMVPSCPFIYIIRKDVDVYSQILRKLFNESHGIFLGLQRIDEELTGKSRKSQLVRVSKNYRSVIRACMEEMHQVAIAAKDPANGRQFSSQVSILSAMELIWNLCEILFIEVAPAGPLLLHLLDWVRLHVCEVDSLSADVLGSENPSKHDSFWNLVTILVLQGRLDEARQMLSKEADASPASAGICRIMGDLMRTMPILSPGNTQTLTELELKWQHWHEECERYLQDSTFATSPHLESLLKIMLGDEAALLEQKELLSNWYHFLVTRLLYSNPTVKPIDLHYYAQSSLDLFLGGESSPEPLDNILLAAFEFDIHQVIKECSIALSNWWFVAHLTDLLDHCKLLQSHNLYFGSNMREFLLLEYASGLFAHPSLWQLGVDYFDYCPELGRVSLELHIERIPLNTEQKALKVLRICEQRQMTEQVRSICKILAMKAVRNNRLGSALSWSIRAKDAAFATLVSDRFLRDYCERGCFSDLDLIDNLGPAMMLSDRLTFLGKYREFHRMYGEKRFADAASLLLSLMTSRIAPRSFWMTLLTDALPLLEQKQVIFSAEQTYELMRCLEDLTSRRPVHGESDTEQLQDDDIETTKVEMLRLSLARNLARAIIREGSLEGS

SEQ ID NO: 7205 - protein, 559 aa, unidentified
MWTNFFKLRLFCCLLAVLMVVVLVINVTQVEYLDHETVSATFIDSSGQFVSSQVTGISRNPYCGYDQQTLSSQERMEEDSLLAALHRQVPDVGPVPFVKSTDPSSSYFVILNSAAFFKVGSQLEVLVHVQDFQRKPKKYGGDYLQARIHSLKLQAGAVGRVVDYQNGFYKVFFTLLWPGKVKVSVSLVHPSEGIRVLQRLQEDKPDRVYFKSLFRSGRISETTECNVCLPGNLPLCNFTDLYTGEPWFCFKPKKLPCSSRITHFKGGYLKGLLTAAESAFFQSGVNIKMPVNSSGPDWVTVIPRRIKETNSLELSQGSGTFPSGYYYKDQWRPRKFKMRQFNDPDNITECLQRKVVHLFGDSTIRQWFEYLTTFVPDLVEFNLGSPKNVGPFLAVDQKHNILLKYRCHGPPIRFTTVFSNELHYVANELNGIVGGKNTVVAIAVWSHFSTFPLEVYIRRLRNIRRAVVRLLDRSPKTVVVIRTANAQELGPEVSLFNSDWYNFQLDTILRRMFSGVGVYLVDAWEMTLAHYLPHKLHPDEVIVKNQLDMFLSFVCPLET

SEQ ID NO: 7206 - protein, 544 aa, unidentified
MKISMINYKSLLALLFILASWIIFTVFQNSTKVWSALNLSISLHYWNNSTKSLFPKTPLISLKPLTETELRIKEIIEKLDQQIPPRPFTHVNTTTSATHSTATILNPRDTYCRGDQLHILLEVRDHLGRRKQYGGDFLRARMSSPALMAGASGKVTDFNNGTYLVSFTLFWEGQVSLSLLLIHPSEGVSALWSARNQGYDRVIFTGQFVNGTSQVHSECGLILNTNAELCQYLDNRDQEGFYCVRPQHMPCAALTHMYSKNKKVSYLSKQEKSLFERSNVGVEIMEKFNTISVSKCNKETVAMKEKCKFGMTSTIPSGHVWRNTWNPVSCSLATVKMKECLRGKLIYLMGDSTIRQWMEYFKASINTLKSVDLHESGKLQHQLAVDLDRNINIQWQKYCYPLIGSMTYSVKEMEYLTRAIDRTGGEKNTVIVISLGQHFRPFPIDVFIRRALNVHKAIQHLLLRSPDTMVIIKTENIREMYNDAERFSDFHGYIQYLIIKDIFQDLSVSIIDAWDITIAYGTNNVHPPQHVVGNQINILLNYIC

SEQ ID NO: 7207 - protein, 271 aa, unidentified
MQAACWYVLFLLQPTVYLVTCANLTNGGKSELLKSGSSKSTLKHIWTESSKDLSISRLLSQTFRGKENDTDLDLRYDTPEPYSEQDLWDWLRNSTDLQEPRPRAKRRPIVKTGKFKKMFGWGDFHSNIKTVKLNLLITGKIVDHGNGTFSVYFRHNSTGQGNVSVSLVPPTKIVEFDLAQQTVIDAKDSKSFNCRIEYEKVDKATKNTLCNYDPSKTCYQEQTQSHVSWLCSKPFKVICIYISFYSTDYKLVQKVCPDYNYHSDTPYFPSG

SEQ ID NO: 7208 - protein, 264 aa, unidentified
MRLRPLPLVVVPGLLQLLFCDSKEVVHATEGLDWEDKDAPGTLVGNVVHSRIISPLRLFVKQSPVPKPGPMAYADSMENFWDWLANITEIQEPLARTKRRPIVKTGKFKKMFGWGDFHSNIKTVKLNLLITGKIVDHGNGTFSVYFRHNSTGLGNVSVSLVPPSKVVEFEVSPQSTLETKESKSFNCRIEYEKTDRAKKTALCNFDPSKICYQEQTQSHVSWLCSKPFKVICIYIAFYSVDYKLVQKVCPDYNYHSETPYLSSG

SEQ ID NO: 7209 - protein, 252 aa, unidentified
MQLTRCCFVFLVQGSLYLVICGQDDGPPGSEDPERDDHEGQPRPRVPRKRGHISPKSRPMANSTLLGLLAPPGEAWGILGQPPNRPNHSPPPSAKVKKIFGWGDFYSNIKTVALNLLVTGKIVDHGNGTFSVHFQHNATGQGNISISLVPPSKAVEFHQEQQIFIEAKASKIFNCRMEWEKVERGRRTSLCTHDPAKICSRDHAQSSATWSCSQPFKVVCVYIAFYSTDYRLVQKVCPDYNYHSDTPYYPSG

SEQ ID NO: 7210 - protein, 308 aa, unidentified
MRLLPEWFLLLFGPWLLRKAVSAQIPESGRPQYLGLRPAAAGAGAPGQQLPEPRSSDGLGVGRAWSWAWPTNHTGALARAGAAGALPAQRTKRKPSIKAARAKKIFGWGDFYFRVHTLKFSLLVTGKIVDHVNGTFSVYFRHNSSSLGNLSVSIVPPSKRVEFGGVWLPGPVPHPLQSTLALEGVLPGLGPPLGMAAAAAGPGLGGSLGGALAGPLGGALGVPGAKESRAFNCHVEYEKTNRARKHRPCLYDPSQVCFTEHTQSQAAWLCAKPFKVICIFVSFLSFDYKLVQKVCPDYNFQSEHPYFG

SEQ ID NO: 7211 - protein, 481 aa, unidentified
MKGRGMLVLLLHAVVLGLPSAWAVGACARACPAACACSTVERGCSVRCDRAGLLRVPAELPCEAVSIDLDRNGLRFLGERAFGTLPSLRRLSLRHNNLSFITPGAFKGLPRLAELRLAHNGDLRYLHARTFAALSRLRRLDLAACRLFSVPERLLAELPALRELAAFDNLFRRVPGALRGLANLTHAHLERGRIEAVASSSLQGLRRLRSLSLQANRVRAVHAGAFGDCGVLEHLLLNDNLLAELPADAFRGLRRLRTLNLGGNALDRVARAWFADLAELELLYLDRNSIAFVEEGAFQNLSGLLALHLNGNRLTVLAWVAFQPGFFLGRLFLFRNPWCCDCRLEWLRDWMEGSGRVTDVPCASPGSVAGLDLSQVTFGRSSDGLCVDPEELNLTTSSPGPSPEPAATTVSRFSSLLSKLLAPRVPVEEAANTTGGLANASLSDSLSSRGVGGAGRQPWFLLASCLLPSVAQHVVFGLQMD

SEQ ID NO: 7212 - protein, 273 aa, unidentified
MRLPGVPLARPALLLLLPLLAPLLGTGAPAELRVRVRLPDGQVTEESLQADSDADSISLELRKPDGTLVSFTADFKKDVKVFRALILGELEKGQSQFQALCFVTQLQHNEIIPSEAMAKLRQKNPRAVRQAEEVRGLEHLHMDVAVNFSQGALLSPHLHNVCAEAVDAIYTRQEDVRFWLEQGVDSSVFEALPKASEQAELPRCRQVGDHGKPCVCRYGLSLAWYPCMLKYCHSRDRPTPYKCGIRSCQKSYSFDFYVPQRQLCLWDEDPYPG

SEQ ID NO: 7213 - protein, 170 aa, unidentified
MKTLFLGVTLGLAAALSFTLEEEDITGTWYVKAMVVDKDFPEDRRPRKVSPVKVTALGGGNLEATFTFMREDRCIQKKILMRKTEEPGKFSAYGGRKLIYLQELPGTDDYVFYCKDQRRGGLRYMGKLVGRNPNTNLEALEEFKKLVQHKGLSEEDIFMPLQTGSCVLEH

SEQ ID NO: 7214 - protein, 170 aa, unidentified
MKTLFLGVTLGLAAALSFTLEEEDITGTWYVKAMVVDKDFPEDRRPRKVSPVKVTALGGGKLEATFTFMREDRCIQKKILMRKTEEPGKYSAYGGRKLMYLQELPRRDHYIFYCKDQHHGGLLHMGKLVGRNSDTNREALEEFKKLVQRKGLSEEDIFTPLQTGSCVPEH

SEQ ID NO: 7215 - protein, 477 aa, unidentified
MIAFLLTSVLMIPHAGGHPLDTPHLPQELPPGLPNNINITFFSGMFKNVESVAEIFDCLGPHFTWLQAVFTNFPVLIQFVNGMKCVAGLCPRDFEDYGCTCRFEMEGLPVDESDSCCFQHRRCYEEAAEMDCLQDPAKLSTEVNCVSKKIICESKDNCEHLLCTCDKAAIECLARSSLNSSLNLLDTSFCLAQTPETTIKEDLTTLLPRVVPVEPTDTSLTALSGEEAGHDQEGVGAARATSPPGSAEIVATRVTAKIVTLVPAGIKSLGLAVSSVENDPEETTEKACDRFTFLHLGSGDNMQVMPQLGEMLFCLTSRCPEEFESYGCYCGQEGRGEPRDDLDRCCLSHHCCLEQVRRLGCLLERLPWSPVVCVDHTPKCGGQSLCEKLLCACDQTAAECMTSASFNQSLKSPSRLGCPGQPAACEDSLHPVPAAPTLGSSSEEDSEEDPPQEDLGRAKRFLRKSLGPLGIGPLHGR

SEQ ID NO: 7216 - protein, 522 aa, unidentified; identical to SEQ ID NO: 2936

SEQ ID NO: 7217 - protein, 279 aa, unidentified
MKIIILLGFLGATLSAPLIPQRLMSASNSNELLLNLNNGQLLPLQLQGPLNSWIPPFSGILQQQQQAQIPGLSQFSLSALDQFAGLLPNQIPLTGEASFAQGAQAGQVDPLQLQTPPQTQPGPSHVMPYVFSFKMPQEQGQMFQYYPVYMVLPWEQPQQTVPRSPQQTRQQQYEEQIPFYAQFGYIPQLAEPAISGGQQQLAFDPQLGTAPEIAVMSTGEEIPYLQKEAINFRHDSAGVFMPSTSPKPSTTNVFTSAVDQTITPELPEEKDKTDSLREP

SEQ ID NO: 7218 - protein, 345 aa, unidentified
MPARALLPRRMGHRTLASTPALWASIPCPRSELRLDLVLPSGQSFRWREQSPAHWSGVLADQVWTLTQTEEQLHCTVYRGDKSQASRPTPDELEAVRKYFQLDVTLAQLYHHWGSVDSHFQEVAQKFQGVRLLRQDPIECLFSFICSSNNNIARITGMVERLCQAFGPRLIQLDDVTYHGFPSLQALAGPEVEAHLRKLGLGYRARYVSASARAILEEQGGLAWLQQLRESSYEEAHKALCILPGVGTKVADCICLMALDKPQAVPVDVHMWHIAQRDYSWHPTTSQAKGPSPQTNKELGNFFRSLWGPYAGWAQAVLFSADLRQSRHAQEPPAKRRKGSKGPEG

SEQ ID NO: 7219 - protein, 298 aa, unidentified
MKTLQSTLLLLLLVPLIKPAPPTQQDSRIIYDYGTDNFEESIFSQDYEDKYLDGKNIKEKETVIIPNEKSLQLQKDEAITPLPPKKENDEMPTCLLCVCLSGSVYCEEVDIDAVPPLPKESAYLYARFNKIKKLTAKDFADIPNLRRLDFTGNLIEDIEDGTFSKLSLLEELSLAENQLLKLPVLPPKLTLFNAKYNKIKSRGIKANAFKKLNNLTFLYLDHNALESVPLNLPESLRVIHLQFNNIASITDDTFCKANDTSYIRDRIEEIRLEGNPIVLGKHPNSFICLKRLPIGSYF

SEQ ID NO: 7220 - protein, 545 aa, unidentified
MPPFLLLTCLFITGTSVSPVALDPCSAYISLNEPWRNTDHQLDESQGPPLCDNHVNGEWYHFTGMAGDAMPTFCIPENHCGTHAPVWLNGSHPLEGDGIVQRQACASFNGNCCLWNTTVEVKACPGGYYVYRLTKPSVCFHVYCGHFYDICDEDCHGSCSDTSECTCAPGTVLGPDRQTCFDENECEQNNGGCSEICVNLKNSYRCECGVGRVLRSDGKTCEDVEGCHNNNGGCSHSCLGSEKGYQCECPRGLVLSEDNHTCQVPVLCKSNAIEVNIPRELVGGLELFLTNTSCRGVSNGTHVNILFSLKTCGTVVDVVNDKIVASNLVTGLPKQTPGSSGDFIIRTSKLLIPVTCEFPRLYTISEGYVPNLRNSPLEIMSRNHGIFPFTLEIFKDNEFEEPYREALPTLKLRDSLYFGIEPVVHVSGLESLVESCFATPTSKIDEVLKYYLIRDGCVSDDSVKQYTSRDHLAKHFQVPVFKFVGKDHKEVFLHCRVLVCGVLDERSRCAQGCHRRMRRGAGGEDSAGLQGQTLTGGPIRIDWED

SEQ ID NO: 7221 - protein, 485 aa, unidentified
MSVPLLKIGVVLSTMAMITNWMSQTLPSLVGLNTTKLSAAGGGTLDRSTGVLPTNPEESWQVYSSAQDSEGRCICTVVAPQQTMCSRDARTKQLRQLLEKVQNMSQSIEVLDRRTQRDLQYVEKMENQMKGLESKFKQVEESHKQHLARQFKAIKAKMDELRPLIPVLEEYKADAKLVLQFKEEVQNLTSVLNELQEEIGAYDYDELQSRVSNLEERLRACMQKLACGKLTGISDPVTVKTSGSRFGSWMTDPLAPEGDNRVWYMDGYHNNRFVREYKSMVDFMNTDNFTSHRLPHPWSGTGQVVYNGSIYFNKFQSHIIIRFDLKTETILKTRSLDYAGYNNMYHYAWGGHSDIDLMVDESGLWAVYATNQNAGNIVVSRLDPVSLQTLQTWNTSYPKRSAGEAFIICGTLYVTNGYSGGTKVHYAYQTNASTYEYIDIPFQNKYSHISMLDYNPKDRALYAWNNGHQILYNVTLFHVIRSDEL

SEQ ID NO: 7222 - protein, 454 aa, unidentified
MWPLTVPPPLLLLLCSGLAGQTLFQNPEEGWQLYTSAQAPDGKCICTAVIPAQSTCSRDGRSRELRQLMEKVQNVSQSMEVLELRTYRDLQYVRGMETLMRSLDARLRAADGSLSAKSFQELKDRMTELLPLSSVLEQYKADTRTIVRLREEVRNLSGSLAAIQEEMGAYGYEDLQQRVMALEARLHACAQKLGCGKLTGVSNPITVRAMGSRFGSWMTDTMAPSADSRVWYMDGYYKGRRVLEFRTLGDFIKGQNFIQHLLPQPWAGTGHVVYNGSLFYNKYQSNVVVKYHFRSRSVLVQRSLPGAGYNNTFPYSWGGFSDMDFMVDESGLWAVYTTNQNAGNIVVSRLDPHTLEVMRSWDTGYPKRSAGEAFMICGVLYVTNSHLAGAKVYFAYFTNTSSYEYTDVPFHNQYSHISMLDYNPRERALYTWNNGHQVLYNVTLFHVISTSGDP

SEQ ID NO: 7223 - protein, 478 aa, unidentified
MSPPLLKLGAVLSTMAMISNWMSQTLPSLVGLNTTRLSTPDTLTQISPKEGWQVYSSAQDPDGRCICTVVAPEQNLCSRDAKSRQLRQLLEKVQNMSQSIEVLNLRTQRDFQYVLKMETQMKGLKAKFRQIEDDRKTLMTKHFQELKEKMDELLPLIPVLEQYKTDAKLITQFKEEIRNLSAVLTGIQEEIGAYDYEELHQRVLSLETRLRDCMKKLTCGKLMKITGPVTVKTSGTRFGAWMTDPLASEKNNRVWYMDSYTNNKIVREYKSIADFVSGAESRTYNLPFKWAGTNHVVYNGSLYFNKYQSNIIIKYSFDMGRVLAQRSLEYAGFHNVYPYTWGGFSDIDLMADEIGLWAVYATNQNAGNIVISQLNQDTLEVMKSWSTGYPKRSAGESFMICGTLYVTNSHLTGAKVYYSYSTKTSTYEYTDIPFHNQYFHISMLDYNARDRALYAWNNGHQVLFNVTLFHIIKTEDDT

SEQ ID NO: 7224 - protein, 510 aa, unidentified
MRPGLSFLLALLFFLGQAAGDLGDVGPPIPSPGFSSFPGVDSSSSFSSSSRSGSSSSRSLGSGGSVSQLFSNFTGSVDDRGTCQCSVSLPDTTFPVDRVERLEFTAHVLSQKFEKELSKVREYVQLISVYEKKLLNLTVRIDIMEKDTISYTELDFELIKVEVKEMEKLVIQLKESFGGSSEIVDQLEVEIRNMTLLVEKLETLDKNNVLAIRREIVALKTKLKECEASKDQNTPVVHPPPTPGSCGHGGVVNISKPSVVQLNWRGFSYLYGAWGRDYSPQHPNKGLYWVAPLNTDGRLLEYYRLYNTLDDLLLYINARELRITYGQGSGTAVYNNNMYVNMYNTGNIARVNLTTNTIAVTQTLPNAAYNNRFSYANVAWQDIDFAVDENGLWVIYSTEASTGNMVISKLNDTTLQVLNTWYTKQYKPSASNAFMVCGVLYATRTMNTRTEEIFYYYDTNTGKEGKLDIVMHKMQEKVQSINYNPFDQKLYVYNDGYLLNYDLSVLQKPQ

SEQ ID NO: 7225 - protein, 402 aa, unidentified
MMVALRGASALLVLFLAAFLPPPQCTQDPAMVHYIYQRFRVLEQGLEKCTQATRAYIQEFQEFSKNISVMLGRCQTYTSEYKSAVGNLALRVERAQREIDYIQYLREADECIESEDKTLAEMLLQEAEEEKKIRTLLNASCDNMLMGIKSLKIVKKMMDTHGSWMKDAVYNSPKVYLLIGSRNNTVWEFANIRAFMEDNTKPAPRKQILTLSWQGTGQVIYKGFLFFHNQATSNEIIKYNLQKRTVEDRMLLPGGVGRALVYQHSPSTYIDLAVDEHGLWAIHSGPGTHSHLVLTKIEPGTLGVEHSWDTPCRSQDAEASFLLCGVLYVVYSTGGQGPHRITCIYDPLGTISEEDLPNLFFPKRPRSHSMIHYNPRDKQLYAWNEGNQIIYKLQTKRKLPLK

SEQ ID NO: 7226 - protein, 652 aa, unidentified
MAAAALPPRPLLLLPLVLLLSGRPTRADSKVFGDLDQVRMTSEGSDCRCKCIMRPLSKDACSRVRSGRARVEDFYTVETVSSGTDCRCSCTAPPSSLNPCENEWKMEKLKKQAPELLKLQSMVDLLEGTLYSMDLMKVHAYVHKVASQMNTLEESIKANLSRENEVVKDSVRHLSEQLRHYENHSAIMLGIKKELSRLGLQLLQKDAAAAPATPATGTGSKAQDTARGKGKDISKYGSVQKSFADRGLPKPPKEKLLQVEKLRKESGKGSFLQPTAKPRALAQQQAVIRGFTYYKAGKQEVTEAVADNTLQGTSWLEQLPPKVEGRSNSAEPNSAEQDEAEPRSSERVDLASGTPTSIPATTTTATTTPTPTTSLLPTEPPSGPEVSSQGREASCEGTLRAVDPPVRHHSYGRHEGAWMKDPAARDDRIYVTNYYYGNSLVEFRNLENFKQGRWSNMYKLPYNWIGTGHVVYQGAFYYNRAFTKNIIKYDLRQRFVASWALLPDVVYEDTTPWKWRGHSDIDFAVDESGLWVIYPAVDDRDEAQPEVIVLSRLDPGDLSVHRETTWKTRLRRNSYGNCFLVCGILYAVDTYNQQEGQVAYAFDTHTGTDARPQLPFLNEHAYTTQIDYNPKERVLYAWDNGHQLTYTLHFVV

SEQ ID NO: 7227 - protein, 750 aa, unidentified
MAKPRLLVLYFALIVVPAWVSSIVLTGTSEPPDAQTVAPAEDETLQNEADNQENVLSQLLGDYDKVKAMSEGSDCQCKCVVRPLGRDACQRINAGASRKEDFYTVETITSGSSCKCACVAPPSALNPCEGDFRLQKLREADSQDLKLSTIIDMLEGAFYGLDLLKLHSVTTKLVGRVDKLEEEVSKNLTKENEQIKEDMEEIRTEMNKRGKENCSENILDSMPDIRSALQRDAAAAYAHPEYEERFLQEETVSQQINSIELLQTRPLALPEVVKSQRPLQRQVHLRGRPASQPTVIRGITYYKAKVSEEENDIEEQQDEFFSGDNGVDLLIEDQLLRHNGLMTSVTRRPAATRQGHSTAVTSDLNARTAPWSSALPQPSTSDPSIANHASVGPTLQTTSVSPDPTRESVLQPSPQVPATTVAHTATQQPAAPAPPAVSPREALMEAMHTVPVPPTTVRTDSLGKDAPAGWGTTPASPTLSPEEEDDIRNVIGRCKDTLSTITGPTTQNTYGRNEGAWMKDPLAKDERIYVTNYYYGNTLVEFRNLENFKQGRWSNSYKLPYSWIGTGHVVYNGAFYYNRAFTRNIIKYDLKQRYVAAWAMLHDVAYEEATPWRWQGHSDVDFAVDENGLWLIYPALDDEGFSQEVIVLSKLNAADLSTQKETTWRTGLRRNFYGNCFVICGVLYAVDSYNQRNANISYAFDTHTNTQIVPRLLFENEYSYTTQIDYNPKDRLLYAWDNGHQVTYHVIFAY

SEQ ID NO: 7228 - protein, 406 aa, unidentified
MGPSTPLLILFLLSWSGPLQGQQHHLVEYMERRLAALEERLAQCQDQSSRHAAELRDFKNKMLPLLEVAEKEREALRTEADTISGRVDRLEREVDYLETQNPALPCVEFDEKVTGGPGTKGKGRRNEKYDMVTDCGYTISQVRSMKILKRFGGPAGLWTKDPLGQTEKIYVLDGTQNDTAFVFPRLRDFTLAMAARKASRVRVPFPWVGTGQLVYGGFLYFARRPPGRPGGGGEMENTLQLIKFHLANRTVVDSSVFPAEGLIPPYGLTADTYIDLAADEEGLWAVYATREDDRHLCLAKLDPQTLDTEQQWDTPCPRENAEAAFVICGTLYVVYNTRPASRARIQCSFDASGTLTPERAALPYFPRRYGAHASLRYNPRERQLYAWDDGYQIVYKLEMRKKEEEV

SEQ ID NO: 7229 - protein, 421 aa, unidentified
MGFLSPIYVIFFFFGVKVHCQYETYQWDEDYDQEPDDDYQTGFPFRQNVDYGVPFHQYTLGCVSECFCPTNFPSSMYCDNRKLKTIPNIPMHIQQLYLQFNEIEAVTANSFINATHLKEINLSHNKIKSQKIDYGVFAKLPNLLQLHLEHNNLEEFPFPLPKSLERLLLGYNEISKLQTNAMDGLVNLTMLDLCYNYLHDSLLKDKIFAKMEKLMQLNLCSNRLESMPPGLPSSLMYLSLENNSISSIPEKYFDKLPKLHTLRMSHNKLQDIPYNIFNLPNIVELSVGHNKLKQAFYIPRNLEHLYLQNNEIEKMNLTVMCPSIDPLHYHHLTYIRVDQNKLKEPISSYIFFCFPHIHTIYYGEQRSTNGQTIQLKTQVFRRFPDDDDESEDHDDPDNAHESPEQEGAEGHFDLHYYENQE

SEQ ID NO: 7230 - protein, 440 aa, unidentified
MEYQILKMSLCLFILLFLTPGILCICPLQCICTERHRHVDCSGRNLSTLPSGLQENIIHLNLSYNHFTDLHNQLTQYTNLRTLDISNNRLESLPAHLPRSLWNMSAANNNIKLLDKSDTAYQWNLKYLDVSKNMLEKVVLIKNTLRSLEVLNLSSNKLWTVPTNMPSKLHIVDLSNNSLTQILPGTLINLTNLTHLYLHNNKFTFIPDQSFDQLFQLQEITLYNNRWSCDHKQNITYLLKWMMETKAHVIGTPCSTQISSLKEHNMYPTPSGFTSSLFTVSGMQTVDTINSLSVVTQPKVTKIPKQYRTKETTFGATLSKDTTFTSTDKAFVPYPEDTSTETINSHEAAAATLTIHLQDGMVTNTSLTSSTKSSPTPMTLSITSGMPNNFSEMPQQSTTLNLWREETTTNVKTPLPSVANAWKVNASFLLLLNVVVMLAV

SEQ ID NO: 7231 - protein, 158 aa, unidentified
MALEVLMLLAVLIWTGAENLHVKISCSLDWLMVSVIPVAESRNLYIFADELHLGMGCPANRIHTYVYEFIYLVRDCGIRTRVVSEETLLFQTELYFTPRNIDHDPQEIHLECSTSRKSVWLTPVSTENEIKLDPSPFIADFQTTAEELGLLSSSPNLL

SEQ ID NO: 7232 - protein, 345 aa, unidentified
MGVCGYLFLPWKCLVVVSLRLLFLVPTGVPVRSGDATFPKAMDNVTVRQGESATLRCTIDDRVTRVAWLNRSTILYAGNDKWSIDPRVIILVNTPTQYSIMIQNVDVYDEGPYTCSVQTDNHPKTSRVHLIVQVPPQIMNISSDITVNEGSSVTLLCLAIGRPEPTVTWRHLSVKEGQGFVSEDEYLEISDIKRDQSGEYECSALNDVAAPDVRKVKITVNYPPYISKAKNTGVSVGQKGILSCEASAVPMAEFQWFKEETRLATGLDGMRIENKGRMSTLTFFNVSEKDYGNYTCVATNKLGNTNASITLYGPGAVIDGVNSASRALACLWLSGTLLAHFFIKF

SEQ ID NO: 7233 - protein, 248 aa, unidentified
MKLTFFLGLLALISCFTPSESQRFSRRPYLPGQLPPPPLYRPRWVPPSPPPPYDSRLNSPLSLPFVPGRVPPSSFSRFSQAVILSQLFPLESIRQPRLFPGYPNLHFPLRPYYVGPIRILKPPFPPIPFFLAIYLPISNPEPQINITTADTTITTNPPTTATATTSTSTKPTMTISSSTVPISSTPEPATSISAATPAASTENTTQILANRPHTVLLNATVQVTTSNQTILSSPAFKSFWQKLFAIFG

SEQ ID NO: 7234 - protein, 332 aa, unidentified
MRLLAFLSLLALVLQETGTASLPRKERKRREEQMPREGDSFEVLPLRNDVLNPDNYGEVIDLSNYEELTDYGDQLPEVKVTSLAPATSISPAKSTTAPGTPSSNPTMTRPTTAGLLLSSQPNHGLPTCLVCVCLGSSVYCDDIDLEDIPPLPRRTAYLYARFNRISRIRAEDFKGLTKLKRIDLSNNLISSIDNDAFRLLHALQDLILPENQLEALPVLPSGIEFLDVRLNRLQSSGIQPAAFRAMEKLQFLYLSDNLLDSIPGPLPLSLRSVHLQNNLIETMQRDVFCDPEEHKHTRRQLEDIRLDGNPINLSLFPSAYFCLPRLPIGRFT

SEQ ID NO: 7235 - protein, 201 aa, unidentified
MALSWVLTVLSLLPLLEAQIPLCANLVPVPITNATLDQITGKWFYIASAFRNEEYNKSVQEIQATFFYFTPNKTEDTIFLREYQTRQDQCIYNTTYLNVQRENGTISRYVGGQEHFAHLLILRDTKTYMLAFDVNDEKNWGLSVYADKPETTKEQLGEFYEALDCLRIPKSDVVYTDWKKDKCEPLEKQHEKERKQEEGES

SEQ ID NO: 7236 - protein, 201 aa, unidentified
MALSWVLTVLSLLPLLEAQIPLCANLVPVPITNATLDRITGKWFYIASAFRNEEYNKSVQEIQATFFYFTPNKTEDTIFLREYQTRQNQCFYNSSYLNVQRENGTVSRYEGGREHVAHLLFLRDTKTLMFGSYLDDEKNWGLSFYADKPETTKEQLGEFYEALDCLCIPRSDVMYTDWKKDKCEPLEKQHEKERKQEEGES

SEQ ID NO: 7237 - protein, 153 aa, unidentified; identical to SEQ ID NO: 3295

SEQ ID NO: 7238 - protein, 667 aa, unidentified
MAAETLLSSLLGLLLLGLLLPASLTGGVGSLNLEELSEMRYGIEILPLPVMGGQSQSSDVVIVSSKYKQRYECRLPAGAIHFQREREEETPAYQGPGIPELLSPMRDAPCLLKTKDWWTYEFCYGRHIQQYHMEDSEIKGEVLYLGYYQSAFDWDDETAKASKQHRLKRYHSQTYGNGSKCDLNGRPREAEVRFLCDEGAGISGDYIDRVDEPLSCSYVLTIRTPRLCPHPLLRPPPSAAPQAILCHPSLQPEEYMAYVQRQADSKQYGDKIIEELQDLGPQVWSETKSGVAPQKMAGASPTKDDSKDSDFWKMLNEPEDQAPGGEEVPAEEQDPSPEAADSASGAPNDFQNNVQVKVIRSPADLIRFIEELKGGTKKGKPNIGQEQPVDDAAEVPQREPEKERGDPERQREMEEEEDEDEDEDEDEDERQLLGEFEKELEGILLPSDRDRLRSEVKAGMERELENIIQETEKELDPDGLKKESERDRAMLALTSTLNKLIKRLEEKQSPELVKKHKKKRVVPKKPPPSPQPTEEDPEHRVRVRVTKLRLGGPNQDLTVLEMKRENPQLKQIEGLVKELLEREGLTAAGKIEIKIVRPWAEGTEEGARWLTDEDTRNLKEIFFNILVPGAEEAQKERQRQKELESNYRRVWGSPGGEGTGDLDEFDF

SEQ ID NO: 7239 - protein, 282 aa, unidentified; identical to SEQ ID NO: 3299

SEQ ID NO: 7240 - protein, 252 aa, unidentified
MGVLLTQRTLLSLVLALLFPSMASMAAIGSCSKEYRVLLGQLQKQTDLMQDTSRLLDPYIRIQGLDVPKLREHCRERPGAFPSEETLRGLGRRGFLQTLNATLGCVLHRLADLEQRLPKAQDLERSGLNIEDLEKLQMARPNILGLRNNIYCMAQLLDNSDTAEPTKAGRGASQPPTPTPASDAFQRKLEGCRFLHGYHRFMHSVGRVFSKWGESPNRSRRHSPHQALRKGVRRTRPSRKGKRLMTRGQLPR

SEQ ID NO: 7241 - protein, 979 aa, unidentified; identical to SEQ ID NO: 3300

SEQ ID NO: 7242 - protein, 133 aa, unidentified
MLDWRLASAHFILAVTLTLWSSGKVLSVDVTTTEAFDSGVIDVQSTPTVREEKSATDLTAKLLLLDELVSLENDVIETKKKRSFSGFGSPLDRLSAGSVDHKGKQRKVVDHPKRRFGIPMDRIGRNRLSNSRG

SEQ ID NO: 7243 - protein, 1153 aa, unidentified
MSQEPTTYSLFLFLFLSHGVSSYTVPNSRQDLHPLLQNMAEEIIDGSYLNALLDLIQFQSSHVWTDDLSHRVLAYLNSRNVAFTIPSLQAAVENHLEQRLHQPQKLLEDLRKTDAQQFRTAMKCLLEDKKDGLDLKDIIIDLGEIRERALQSPGVNRSLFLITLERCFQMLNSLECVEILGKVLRGSSGSFLQPDITERLPRDLREDAFKNLSAVFKDLYDKTSAHSQRALYSWMTGILQTSSNATDDSASWVSAEHLWVLGRYMVHLSFEEITKISPIEIGLFISYDNATKQLDMVYDITPELAQAFLERISSSNFNMRNTSTIHRQAHELWALEPFPKMLGLLVCFYNDLELLDATVAQVLLYQMIKCSHLRGFQAGVQKLKAELLDIAMENQTLNETLGSLSDAVVGLTYSQLESLSPEAVHGAISTLNQVSGWAKSQVIILSAKYLAHEKVLSFYNVSQMGALLAGVSTQAFCSMKRKDISQVLRSAVSQYVSDLSPAQQQGILSKMVQAEDTAPGIVEIQGAFFKEVSLFDLRRQPGFNSTVLKDKELGRSQALFLYELLLKTTRRPEELLSAGQLVKGVTCSHIDAMSTDFFLAHFQDFQNNFALLSPYQVNCLAWKYWEVSRLSMPPFLLAALPARYLASVPASQCVPFLISLGKSWLDSLVLDSHKKTSVLRKVQQCLDDSIADEYTVDIMGNLLCHLPAAIIDRGISPRAWATALHGLRDCPDLNPEQKAAVRLKLLGQYGLPQHWTAETTKDLGPFLVLFSGDELSSIATKFPEILLQAASKMARTLPTKEFLWAVFQSVRNSSDKIPSYDPMPGCHGVVAPSSDDIFKLAEANACWALEDLRCMEEDTFIRTVELLGAVQGFSRPQLMTLKEKAIQVWDMPSYWREHHIVSLGRIALALNESELEQLDLSSIDTVASLSWQTEWTPGQAESILQGYLDDSGYSIQDLKSFHLVGLGATLCAINITEIPLIKISEFRVVVARIGTLLCSTHVLAEFKRKAEVVFGDPTEWTSSVLQELGTIAAGLTKAELRMLDKDLMPYFQPSAIKCLPDEIFKELSAEQIASLGPENAAAVTHAQRRRLSPLQLQSLQQALDGAKTHSWQDAPASAGPTRTSSSRSPAGALQSWGLWLGCPLLVLMAKLLW

SEQ ID NO: 7244 - protein, 2925 aa, unidentified
MGVLASALCWLLCVWLPWGEQAAESLRVQRLGERVVDSGRSGARGMRNVKGMRNGPAQTRVSSSSSHQEATLAMGDKATVVGGQQAEAPDSVAMSSWERRLHRAKCAPSYLFSCFNGGECVHPAFCDCRRFNATGPRCQMVYNAGPERDSICRAWGQHHVETFDGLYYYLSGKGSYTLVGRHEPEGQSFSIQVHNDPQCGSSPYTCSRAVSLFFVGEQEIHLAKEVTHGGMRVQLPHVMGSARLQQLAGYVIVRHQSAFTLAWDGASAVYIKMSPELLGWTHGLCGNNNADPKDDLVTSSGKLTDDVVEFVHSWQEQAPNQPPGPTTSSLPRPPCLQQNPGTMQGVYEQCEALLRPPFDACHAYVSPLPFTASCTSDLCQSMGDVATWCRALAEYARACAQAGRPLQGWRTQLRQCTVHCKEKAFTYNECIACCPASCHPRASCVDSEIACVDGCYCPNGLIFEDGGCVAPAECPCEFHGTLYPPGSVVKEDCNTCTCTSGKWECSTAVCPAECSVTGDIHFTTFDGRRYTFPATCQYILAKSRSSGTFTVTLQNAPCGLNQDGACVQSVSVILHQDPRRQVTLTQAGDVLLFDQYKIIPPYTDDAFEIRRLSSVFLRVRTNVGVRVLYDREGLRLYLQVDQRWVEDTVGLCGTFNGNTQDDFLSPVGVPESTPQLFGNSWKTLSACSPLVSGSPLDPCDVHLQAASYSVQACSVLTGEMFAPCSAFLSPVPYFEQCRRDACRCGQPCLCATLAHYAHLCRRHGLPVDFRARLPACALSCEASKEYSPCVAPCGRTCQDLASPEACGVDGGDDLSRDECVEGCACPPDTYLDTQADLCVPRNQCSCHFQGVDYPPGDSDIPSLGHCHCKDGVMSCDSRAPAAACPAGQVFVNCSDLHTDLELSRERTCEQQLLNLSVSARGPCLSGCACPQGLLRHGDACFLPEECPCTWKGKEYFPGDQVMSPCHTCVCQRGSFQCTLHPCASTCTAYGDRHYRTFDGLPFDFVGACKVHLVKSTSDVSFSVIVENVNCYSSGMICRKFISINVGNSLIVFDDDSGNPSPESFLDDKQEVHTWRVGFFTLVHFPQEHITLLWDQRTTVHVQAGPQWQGQLAGLCGNFDLKTINEMRTPENLELTNPQEFGSSWAAVECPDTLDPRDMCVLNPLREPFAKKECSILLSEVFEICHPVVDVTWFYSNCLTDTCGCSQGGDCECFCASVSAYAHQCCQHGVAVDWRTPRLCPYDCDFFNKVLGKGPYQLSSLAAGGALVGMKAVGDDIVLVRTEDVAPADIVSFLLTAALYKAKAHDPDVVSLEAADRPNFFLHVTANGSLELAKWQGRDTFQQHASFLLHRGTRQAGLVALESLAKPSSFLYVSGAVLALRLYEHTEVFRRGTLFRLLDAKPSGAAYPICEWRYDACASPCFQTCRDPRAASCRDVPRVEGCVPVCPTPQVLDEVTQRCVYLEDCVEPAVWVPTEALGNETLPPSQGLPTPSDEEPQLSQESPRTPTHRPALTPAAPLTTALNPPVTATEEPVVSPGPTQTTLQQPLELTASQLPAGPTESPASKGVTASLLAIPHTPESSSLPVALQTPTPGMVSGAMETTRVTVIFAGSPNITVSSRSPPAPRFPLMTKAVTVRGHGSLPVRTTPPQPSLTASPSSRPVASPGAISRSPTSSGSHKAVLTPAVTKVISRTGVPQPTQAQSASSPSTPLTVAGTAAEQVPVSPLATRSLEIVLSTEKGEAGHSQPMGSPASPQPHPLPSAPPRPAQHTTMATRSPALPPETPAAASLSTATDGLAATPFMSLESTRPSQLLSGLPPDTSLPLAKVGTSAPVATPGPKASVITTPLQPQATTLPAQTLSPVLPFTPAAMTQAHPPTHIAPPAAGTAPGLLLGATLPTSGVLPVAEGTASMVSVVPRKSTTGKVAILSKQVSLPTSMYGSAEGGPTELTPATSHPLTPLVAEPEGAQAGTALPVPTSYALSRVSARTAPQDSMLVLLPQLAEAHGTSAGPHLAAEPVDEATTEPSGRSAPALSIVEGLAEALATTTEANTSTTCVPIAEQDCVRHICLEGQLIRVNQSQHCPQGAAPPRCGILGLAVRVGGDRCCPLWECACRCSIFPDLSFVTFDGSHVALFKEAIYILSQSPDEMLTVHVLDCKSANLGHLNWPPFCLVMLNMTHLAHQVTIDRFNRKVTVDLQPVWPPVSRYGFRIEDTGHMYMILTPSDIQIQWLHSSGLMIVEASKTSKAQGHGLCGICDGDAANDLTLKDGSVVGGAEDPAPFLDSWQVPSSLTSVGQTRFRPDSCATTDCSPCLRMVSNRTFSACHRFVPPESFCELWIRDTKYVQQPCVALTVYVAMCHKFHVCIEWRRSDYCPFLCSSDSTYQACVTACEPPKTCQDGILGPLDPEHCQVLGEGCVCSEGTILHRRHSALCIPEAKCACTDSMGVPRALGETWNSSLSGCCQHQCQAPDTIVPVDLGCPSPRPESCLRFGEVALLLPTKDPCCLGTVCVCNQTLCEGLAPTCRPGHRLLTHFQEDSCCPSYSCECDPDLCEAELVPSCRQDQILITGRLGDSCCTSYFCACGDCPDSIPECQEGEALTVHRNTTELCCPLYQCVCENFRCPQVQCGLGTALVEVWSPDRCCPYKSCECDCDTIPVPRCHLWEKSQLDEEFMHSVENVCGCAKYECVKAPVCLSRELGVMQPGQTVVELSADGVCHTSRCTTVLDPLTNFYQINTTSVLCDIHCEANQEYEHPRDLAACCGSCRNVSCLFTFPNGTTSLFLPGASWIADCARHHCSSTPLGAVLVRSPISCPPLNETECAKVGGSVVPSLEGCCRTCKEDGRSCKKVTIRMTIRKNECRSSTPVNLVSCDGRCPSASIYNYNINTYARFCKCCREVGLQRRSVQLFCATNATWVPYTVQEPTDCACQWS

SEQ ID NO: 7245 - protein, 477 aa, unidentified
MWMFSWLCAILIILAIAGMNTIAKTTPHTKFTKKSEEREMPKGLKPSSGPPPEEEETLFTEMAEMAEPITKPSALDSVFGTATLSPFENFTLDPADFFLNCCDCCSPVPGQKGEPGETGQPGPKGEAGNLGIPGPPGVVGPQGPRGYKGEKGLKGERGDQGVPGYPGKPGAQGEPGPKGDKGNIGLGGVKGQKGSKGDTCGNCTKGEKGDQGAMGSPGLHGGPGAKGEKGEMGEKGEMGDKGCCGDSGERGGKGQKGEGGMKGEKGSKGDSGMEGKSGRNGLPGAKGDPGIKGEKGELGPPGLLGPTGPKGDIGNKGVRGPTGKKGSRGFKGSKGELARVPRSAFSAGLSKPFPPPNIPIKFEKILYNDQGNYSPVTGKFNCSIPGTYVFSYHITVRGRPARISLVAQNKKQFKSRETLYGQEIDQASLLVILKLSAGDQVWLEVSKDWNGVYVSAEDDSIFTGFLLYPEETSGISP

SEQ ID NO: 7246 - protein, 128 aa, unidentified
MARILLLFLPGLVAVCAVHGIFMDRLASKKLCADDECVYTISLASAQEDYNAPDCRFINVKKGQQIYVYSKLVKENGAGEFWAGSVYGDGQDEMGVVGYFPRNLVKEQRVYQEATKEVPTTDIDFFCE

SEQ ID NO: 7247 - protein, 89 aa, unidentified
MQACMVPGLALCLLLGPLAGAKPVQEEGDPYAELPAMPYWPFSTSDFWNYVQHFQALGAYPQIEDMARTFFAHFPLGSTLGFHVPYQED

SEQ ID NO: 7248 - protein, 1134 aa, unidentified
MGLLASAGLLLLLVIGHPRSLGLKCGIRMVNMKSKEPAVGSRFFSRISSWRNSTVTGHPWQVSLKSDEHHFCGGSLIQEDRVVTAAHCLDSLSEKQLKNITVTSGEYSLFQKDKQEQNIPVSKIITHPEYNSREYMSPDIALLYLKHKVKFGNAVQPICLPDSDDKVEPGILCLSSGWGKISKTSEYSNVLQEMELPIMDDRACNTVLKSMNLPPLGRTMLCAGFPDWGMDACQGDSGGPLVCRRGGGIWILAGITSWVAGCAGGSVPVRNNHVKASLGIFSKVSELMDFITQNLFTGLDRGQPLSKVGSRYITKALSSVQEVNGSQRGKGILDMEKQVGCDHDYVSLRSSSGVLFNQRSLMEDDGKQNKRVCGKILPSPLLAETSEAMVPFVSDTEDSGSGFELTVTAVQKSEAGSGCGSLAILVEEGTNHSAKYPDLYPSNIRCHWFICAPEKHIIKLTFEDFAVKFSPNCIYDAVVIYGDSEEKHKLAKLCGMLTITSIFSSSNMTVIYFKSDGKNRLQGFKARFTILPSESLNKFEPKLPPQNNPVSTVKAILHDVCGIPPFSPQWLSRRIAGGEEACPHCWPWQVGLRFLGDYQCGGAIINPVWILTAAHCVQLKNNPLSWTIIAGDHDRNLKESTEQVRRAKHIIVHEDFNTLSYDSDIALIQLSSPLEYNSVVRPVCLPHSAEPLFSSEICAVTGWGSISADGGLASRLQQIQVHVLEREVCEHTYYSAHPGGITEKMICAGFAASGEKDFCQGDSGGPLVCRHENGPFVLYGIVSWGAGCVQPWKPGVFARVMIFLDWIQSKINGPASLQTNNKCKTLKQQLPPPTPSPDSASWPGCCSEAELEKPRGFFPTPRYLLDYRGRLECSWVLRVSPSSMAKFTIEYLSLLGSPVCQDSVLIIYEERHSKRKTAGGLHGRRLYSMTFMSPGPLVRVTFHALVRGAFGISYIDLKVLGPKDSKITRLSQSSNREHLVPCEDVLLTKPEGIMQIPRNSHRTTMGCQWRLVAPLNHIIQLNIINFPMKPTTFVCHGHLRVYEGFGPGKKLIASFAGTLAMILTKDILKREKLNFINTYIMHIWENSVYDNVRSVGKRKQKKFASNLSYSMEAEKSRIQVPADLVPAKGSLSGS

SEQ ID NO: 7249 - protein, 678 aa, unidentified
MWKLLLWVGLVLVLKHHDGAAHKLVCYFTNWAHSRPGPASILPHDLDPFLCTHLIFAFASMNNNQIVAKDLQDEKILYPEFNKLKERNRELKTLLSIGGWNFGTSRFTTMLSTFANREKFIASVISLLRTHDFDGLDLFFLYPGLRGSPMHDRWTFLFLIEELLFAFRKEALLTMRPRLLLSAAVSGVPHIVQTSYDVRFLGRLLDFINVLSYDLHGSWERFTGHNSPLFSLPEDPKSSAYAMNYWRKLGAPSEKLIMGIPTYGRTFRLLKASKNGLQARAIGPASPGKYTKQEGFLAYFEICSFVWGAKKHWIDYQYVPYANKGKEWVGYDNAISFSYKAWFIRREHFGGAMVWTLDMDDVRGTFCGTGPFPLVYVLNDILVRAEFSSTSLPQFWLSSAVNSSSTDPERLAVTTAWTTDSKILPPGGEAGVTEIHGKCENMTITPRGTTVTPTKETVSLGKHTVALGEKTEITGAMTMTSVGHQSMTPGEKALTPVGHQSVTTGQKTLTSVGYQSVTPGEKTLTPVGHQSVTPVSHQSVSPGGTTMTPVHFQTETLRQNTVAPRRKAVAREKVTVPSRNISVTPEGQTMPLRGENLTSEVGTHPRMGNLGLQMEAENRMMLSSSPVIQLPEQTPLAFDNRFVPIYGNHSSVNSVTPQTSPLSLKKEIPENSAVDEEA

SEQ ID NO: 7250 - protein, 520 aa, unidentified
MAALKLLSSGLRLCASARGSGATWYKGCVCSFSTSAHRHTKFYTDPVEAVKDIPDGATVLVGGFGLCGIPENLIDALLKTGVKGLTAVSNNAGVDNFGLGLLLRSKQIKRMVSSYVGENAEFERQYLSGELEVELTPQGTLAERIRAGGAGVPAFYTPTGYGTLVQEGGSPIKYNKDGSVAIASKPREVREFNGQHFILEEAITGDFALVKAWKADRAGNVIFRKSARNFNLPMCKAAETTVVEVEEIVDIGAFAPEDIHIPQIYVHRLIKGEKYEKRIERLSIRKEGDGEAKSAKPGDDVRERIIKRAALEFEDGMYANLGIGIPLLASNFISPNITVHLQSENGVLGLGPYPRQHEADADLINAGKETVTILPGASFFSSDESFAMIRGGHVDLTMLGAMQVSKYGDLANWMIPGKMVKGMGGAMDLVSSAKTKVVVTMEHSAKGNAHKIMEKCTLPLTGKQCVNRIITEKAVFDVDKKKGLTLIELWEGLTVDDVQKSTGCDFAVSPKLMPMQQIAN

SEQ ID NO: 7251 - protein, 517 aa, unidentified
MAALRLLASVLGRGVPAGGSGLALSQGCARCFATSPRLRAKFYADPVEMVKDISDGATVMIGGFGLCGIPENLIAALLRTRVKDLQVVSSNVGVEDFGLGLLLAARQVRRIVCSYVGENTLCESQYLAGELELELTPQGTLAERIRAGGAGVPAFYTPTGYGTLVQEGGAPIRYTPDGHLALMSQPREVREFNGDHFLLERAIRADFALVKGWKADRAGNVVFRRSARNFNVPMCKAADVTAVEVEEIVEVGAFPPEDIHVPNIYVDRVIKGQKYEKRIERLTILKEEDGDAGKEEDARTRIIRRAALEFEDGMYANLGIGIPLLASNFISPSMTVHLHSENGILGLGPFPTEDEVDADLINAGKQTVTVLPGGCFFASDDSFAMIRGGHIQLTMLGAMQVSKYGDLANWMIPGKKVKGMGGAMDLVSSQKTRVVVTMQHCTKDNTPKIMEKCTMPLTGKRCVDRIITEKAVFDVHRKKELTLRELWEGLTVDDIKKSTGCAFAVSPNLRPMQQVAP

SEQ ID NO: 7252 - protein, 312 aa, unidentified
MACAAVMIPGLLRCSVGAIRIEAASLRLTLSTLRHLTLTSIMKSKRKTDHMERTASVLRREIVSAAKVCGAASESPSVKSLRLLVADQDFSFKAGQWVDFFIPGVSVVGGFSICSSPRLLEQERVIELAVKYTNHPPALWVHNTCTLDCEVAVRVGGEFFFDPQPADASRNLVLIAGGVGINPLLSILRHAADLLREQANKRNGYEIGTIKLFYSAKNTSELLFKKNILDLVNEFPEKIACSLHVTKQTTQINAELKPYITEGRITEKEIRDHISKETLFYICGPPPMTDFFSKQLENNHVPKEHICFEKWW

SEQ ID NO: 7253 - protein, 125 aa, unidentified
MAGPSLACCLLGLLALTSACYIQNCPLGGKRAAPDLDVRKCLPCGPGGKGRCFGPNICCAEELGCFVGTAEALRCQEENYLPSPCQSGQKACGSGGRCAVLGLCCSPDGCHADPACDAEATFSQR

SEQ ID NO: 7254 - protein, 736 aa, unidentified
MAVRALKLLTTLLAVVAAASQAEVESEAGWGMVTPDLLFAEGTAAYARGDWPGVVLSMERALRSRAALRALRLRCRTQCAADFPWELDPDWSPSPAQASGAAALRDLSFFGGLLRRAACLRRCLGPPAAHSLSEEMELEFRKRSPYNYLQVAYFKINKLEKAVAAAHTFFVGNPEHMEMQQNLDYYQTMSGVKEADFKDLETQPHMQEFRLGVRLYSEEQPQEAVPHLEAALQEYFVAYEECRALCEGPYDYDGYNYLEYNADLFQAITDHYIQVLNCKQNCVTELASHPSREKPFEDFLPSHYNYLQFAYYNIGNYTQAVECAKTYLLFFPNDEVMNQNLAYYAAMLGEEHTRSIGPRESAKEYRQRSLLEKELLFFAYDVFGIPFVDPDSWTPEEVIPKRLQEKQKSERETAVRISQEIGNLMKEIETLVEEKTKESLDVSRLTREGGPLLYEGISLTMNSKLLNGSQRVVMDGVISDHECQELQRLTNVAATSGDGYRGQTSPHTPNEKFYGVTVFKALKLGQEGKVPLQSAHLYYNVTEKVRRIMESYFRLDTPLYFSYSHLVCRTAIEEVQAERKDDSHPVHVDNCILNAETLVCVKEPPAYTFRDYSAILYLNGDFDGGNFYFTELDAKTVTAEVQPQCGRAVGFSSGTENPHGVKAVTRGQRCAIALWFTLDPRHSERDRVQADDLVKMLFSPEEMDLSQEQPLDAQQGPPEPAQESLSGSESKPKDEL

SEQ ID NO: 7255 - protein, 708 aa, unidentified
MRERIWAPPLLLLLPLLLPPPLWGGPPDSPRRELELEPGPLQPFDLLYASGAAAYYSGDYERAVRDLEAALRSHRRLREIRTRCARHCAARHPLPPPPPGEGPGAELPLFRSLLGRARCYRSCETQRLGGPASRHRVSEDVRSDFQRRVPYNYLQRAYIKLNQLEKAVEAAHTFFVANPEHMEMQQNIENYRATAGVEALQLVDREAKPHMESYNAGVKHYEADDFEMAIRHFEQALREYFVEDTECRTLCEGPQRFEEYEYLGYKAGLYEAIADHYMQVLVCQHECVRELATRPGRLSPIENFLPLHYDYLQFAYYRVGEYVKALECAKAYLLCHPDDEDVLDNVDYYESLLDDSIDPASIEAREDLTMFVKRHKLESELIKSAAEGLGFSYTEPNYWIRYGGRQDENRVPSGVNVEGAEVHGFSMGKKLSPKIDRDLREGGPLLYENITFVYNSEQLNGTQRVLLDNVLSEEQCRELHSVASGIMLVGDGYRGKTSPHTPNEKFEGATVLKALKSGYEGRVPLKSARLFYDISEKARRIVESYFMLNSTLYFSYTHMVCRTALSGQQDRRNDLSHPIHADNCLLDPEANECWKEPPAYTFRDYSALLYMNDDFEGGEFIFTEMDAKTVTASIKPKCGRMISFSSGGENPHGVKAVTKGKRCAVALWFTLDPLYRELERIQADEVIAILDQEQQGKHELNINPKDEL

SEQ ID NO: 7256 - protein, 736 aa, unidentified
MLRLLRPLLLLLLLPPPGSPEPPGLTQLSPGAPPQAPDLLYADGLRAYAAGAWAPAVALLREALRSQAALGRVRLDCGASCAADPGAALPAVLLGAPEPDSGPGPTQGSWERQLLRAALRRADCLTQCAARRLGPGGAARLRVGSALRDAFRRREPYNYLQRAYYQLKKLDLAAAAAHTFFVANPMHLQMREDMAKYRRMSGVRPQSFRDLETPPHWAAYDTGLELLGRQEAGLALPRLEEALQGSLAQMESCRADCEGPEEQQGAEEEEDGAASQGGLYEAIAGHWIQVLQCRQRCVGETATRPGRSFPVPDFLPNQLRRLHEAHAQVGNLSQAIENVLSVLLFYPEDEAAKRALNQYQAQLGEPRPGLGPREDIQRFILRSLGEKRQLYYAMEHLGTSFKDPDPWTPAALIPEALREKLREDQEKRPWDHEPVKPKPLTYWKDVLLLEGVTLTQDSRQLNGSERAVLDGLLTPAECGVLLQLAKDAAGAGARSGYRGRRSPHTPHERFEGLTVLKAAQLARAGTVGSQGAKLLLEVSERVRTLTQAYFSPERPLHLSFTHLVCRSAIEGEQEQRMDLSHPVHADNCVLDPDTGECWREPPAYTYRDYSGLLYLNDDFQGGDLFFTEPNALTVTARVRPRCGRLVAFSSGVENPHGVWAVTRGRRCALALWHTWAPEHREQEWIEAKELLQESQEEEEEEEEEMPSKDPSPEPPSRRHQRVQDKTGRAPRVREEL

SEQ ID NO: 7257 - protein, 437 aa, unidentified
MARVAWGLLWLLLGSAGAQYEKYSFRGFPPEDLMPLAAAYGHALEQYEGESWRESARYLEAALRLHRLLRDSEAFCHANCSGPAPAAKPDPDGGRADEWACELRLFGRVLERAACLRRCKRTLPAFQVPYPPRQLLRDFQSRLPYQYLHYALFKANRLEKAVAAAYTFLQRNPKHELTAKYLNYYQGMLDVADESLTDLEAQPYEAVFLRAVKLYNSGDFRSSTEDMERALSEYLAVFARCLAGCEGAHEQVDFKDFYPAIADLFAESLQCKVDCEANLTPNVGGYFVDKFVATMYHYLQFAYYKLNDVRQAARSAASYMLFDPKDSVMQQNLVYYRFHRARWGLEEEDFQPREEAMLYHNQTAELRELLEFTHMYLQSDDEMELEETEPPLEPEDALSDAEFEGEGDYEEGMYADWWQEPDAKGDEAEAEPEPELA

SEQ ID NO: 7258 - protein, 534 aa, unidentified
MIWYILIIGILLPQSLAHPGFFTSIGQMTDLIHTEKDLVTSLKDYIKAEEDKLEQIKKWAEKLDRLTSTATKDPEGFVGHPVNAFKLMKRLNTEWSELENLVLKDMSDGFISNLTIQRQYFPNDEDQVGAAKALLRLQDTYNLDTDTISKGNLPGVKHKSFLTAEDCFELGKVAYTEADYYHTELWMEQALRQLDEGEISTIDKVSVLDYLSYAVYQQGDLDKALLLTKKLLELDPEHQRANGNLKYFEYIMAKEKDVNKSASDDQSDQKTTPKKKGVAVDYLPERQKYEMLCRGEGIKMTPRRQKKLFCRYHDGNRNPKFILAPAKQEDEWDKPRIIRFHDIISDAEIEIVKDLAKPRLRRATISNPITGDLETVHYRISKSAWLSGYENPVVSRINMRIQDLTGLDVSTAEELQVANYGVGGQYEPHFDFARKDEPDAFKELGTGNRIATWLFYMSDVSAGGATVFPEVGASVWPKKGTAVFWYNLFASGEGDYSTRHAACPVLVGNKWVSNKWLHERGQEFRRPCTLSELE

SEQ ID NO: 7259 - protein, 535 aa, unidentified
MKLWVSALLMAWFGVLSCVQAEFFTSIGHMTDLIYAEKELVQSLKEYILVEEAKLSKIKSWANKMEALTSKSAADAEGYLAHPVNAYKLVKRLNTDWPALEDLVLQDSAAGFIANLSVQRQFFPTDEDEIGAAKALMRLQDTYRLDPGTISRGELPGTKYQAMLSVDDCFGMGRSAYNEGDYYHTVLWMEQVLKQLDAGEEATTTKSQVLDYLSYAVFQLGDLHRALELTRRLLSLDPSHERAGGNLRYFEQLLEEEREKTLTNQTEAELATPEGIYERPVDYLPERDVYESLCRGEGVKLTPRRQKRLFCRYHHGNRAPQLLIAPFKEEDEWDSPHIVRYYDVMSDEEIERIKEIAKPKLARATVRDPKTGVLTVASYRVSKSSWLEEDDDPVVARVNRRMQHITGLTVKTAELLQVANYGVGGQYEPHFDFSRNDERDTFKHLGTGNRVATFLNYMSDVEAGGATVFPDLGAAIWPKKGTAVFWYNLLRSGEGDYRTRHAACPVLVGCKWVSNKWFHERGQEFLRPCGSTEVD

SEQ ID NO: 7260 - protein, 544 aa, unidentified
MGPGARLAALLAVLALGTGDPERAAARGDTFSALTSVARALAPERRLLGLLRRYLRGEEARLRDLTRFYDKVLSLHEDSTTPVANPLLAFTLIKRLQSDWRNVVHSLEASENIRALKDGYEKVEQDLPAFEDLEGAARALMRLQDVYMLNVKGLARGVFQRVTGSAITDLYSPKRLFSLTGDDCFQVGKVAYDMGDYYHAIPWLEEAVSLFRGSYGEWKTEDEASLEDALDHLAFAYFRAGNVSCALSLSREFLLYSPDNKRMARNVLKYERLLAESPNHVVAEAVIQRPNIPHLQTRDTYEGLCQTLGSQPTLYQIPSLYCSYETNSNAYLLLQPIRKEVIHLEPYIALYHDFVSDSEAQKIRELAEPWLQRSVVASGEKQLQVEYRISKSAWLKDTVDPKLVTLNHRIAALTGLDVRPPYAEYLQVVNYGIGGHYEPHFDHATSPSSPLYRMKSGNRVATFMIYLSSVEAGGATAFIYANLSVPVVRNAALFWWNLHRSGEGDSDTLHAGCPVLVGDKWVANKWIHEYGQEFRRPCSSSPED

SEQ ID NO: 7261 - protein, 508 aa, unidentified
MLRRALLCLAVAALVRADAPEEEDHVLVLRKSNFAEALAAHKYLLVEFYAPWCGHCKALAPEYAKAAGKLKAEGSEIRLAKVDATEESDLAQQYGVRGYPTIKFFRNGDTASPKEYTAGREADDIVNWLKKRTGPAATTLPDGAAAESLVESSEVAVIGFFKDVESDSAKQFLQAAEAIDDIPFGITSNSDVFSKYQLDKDGVVLFKKFDEGRNNFEGEVTKENLLDFIKHNQLPLVIEFTEQTAPKIFGGEIKTHILLFLPKSVSDYDGKLSNFKTAAESFKGKILFIFIDSDHTDNQRILEFFGLKKEECPAVRLITLEEEMTKYKPESEELTAERITEFCHRFLEGKIKPHLMSQELPEDWDKQPVKVLVGKNFEDVAFDEKKNVFVEFYAPWCGHCKQLAPIWDKLGETYKDHENIVIAKMDSTANEVEAVKVHSFPTLKFFPASADRTVIDYNGERTLDGFKKFLESGGQDGAGDDDDLEDLEEAEEPDMEEDDDQKAVKDEL

SEQ ID NO: 7262 - protein, 180 aa, unidentified
MLCLLLTLGVALVCGVPAMDIPQTKQDLELPKLAGTWHSMAMATNNISLMATLKAPLRVHITSLLPTPEDNLEIVLHRWENNSCVEKKVLGEKTENPKKFKINYTVANEATLLDTDYDNFLFLCLQDTTTPIQSMMCQYLARVLVEDDEIMQGFIRAFRPLPRHLWYLLDLKQMEEPCRF

SEQ ID NO: 7263 - protein, 973 aa, unidentified [sequence omitted]

SEQ ID NO: 7264 - protein, 720 aa, unidentified
MELGCWTQLGLTFLQLLLISSLPREYTVINEACPGAEWNIMCRECCEYDQIECVCPGKREVVGYTIPCCRNEENECDSCLIHPGCTIFENCKSCRNGSWGGTLDDFYVKGFYCAECRAGWYGGDCMRCGQVLRAPKGQILLESYPLNAHCEWTIHAKPGFVIQLRFVMLSLEFDYMCQYDYVEVRDGDNRDGQIIKRVCGNERPAPIQSIGSSLHVLFHSDGSKNFDGFHAIYEEITACSSSPCFHDGTCVLDKAGSYKCACLAGYTGQRCENLLEERNCSDPGGPVNGYQKITGGPGLINGRHAKIGTVVSFFCNNSYVLSGNEKRTCQQNGEWSGKQPICIKACREPKISDLVRRRVLPMQVQSRETPLHQLYSAAFSKQKLQSAPTKKPALPFGDLPMGYQHLHTQLQYECISPFYRRLGSSRRTCLRTGKWSGRAPSCIPICGKIENITAPKTQGLRWPWQAAIYRRTSGVHDGSLHKGAWFLVCSGALVNERTVVVAAHCVTDLGKVTMIKTADLKVVLGKFYRDDDRDEKTIQSLQISAIILHPNYDPILLDADIAILKLLDKARISTRVQPICLAASRDLSTSFQESHITVAGWNVLADVRSPGFKNDTLRSGVVSVVDSLLCEEQHEDHGIPVSVTDNMFCASWEPTAPSDICTAETGGIAAVSFPGRASPEPRWHLMGLVSWSYDKTCSHRLSTAFTKVLPFKDWIERNMK

SEQ ID NO: 7265 - protein, 1278 aa, unidentified
MRLLLLVPLLLAPAPGSSAPKVRRQSDTWGPWSQWSPCSRTCGGGVSFRERPCYSQRRDGGSSCVGPARSHRSCRTESCPDGARDFRAEQCAEFDGAEFQGRRYRWLPYYSAPNKCELNCIPKGENFYYKHREAVVDGTPCEPGKRDVCVDGSCRVVGCDHELDSSKQEDKCLRCGGDGTTCYPVAGTFDANDLSRGYNQILIVPMGATSILIDEAAASRNFLAVKNVRGEYYLNGHWTIEAARALPAASTILHYERGAEGDLAPERLHARGPTSEPLVIELISQEPNPGVHYEYHLPLRRPSPGFSWSHGSWSDCSAECGGGHQSRLVFCTIDHEAYPDHMCQRQPRPADRRSCNLHPCPETKRWKAGPWAPCSASCGGGSQSRSVYCISSDGAGIQEAVEEAECAGLPGKPPAIQACNLQRCAAWSPEPWGECSVSCGVGVRKRSVTCRGERGSLLHTAACSLEDRPPLTEPCVHEDCPLLSDQAWHVGTWGLCSKSCSSGTRRRQVICAIGPPSHCGSLQHSKPVDVEPCNTQPCHLPQEVPSMQDVHTPASNPWMPLGPQESPASDSRGQWWAAQEHPSARGDHRGERGDPRGDQGTHLSALGPAPSLQQPPYQQPLRSGSGPHDCRHSPHGCCPDGHTASLGPQWQGCPGAPCQQSRYGCCPDRVSVAEGPHHAGCTKSYGGDSTGGMPRSRAVASTVHNTHQPQAQQNEPSECRGSQFGCCYDNVATAAGPLGEGCVGQPSHAYPVRCLLPSAHGSCADWAARWYFVASVGQCNRFWYGGCHGNANNFASEQECMSSCQGSLHGPRRPQPGASGRSTHTDGGGSSPAGEQEPSQHRTGAAVQRKPWPSGGLWRQDQQPGPGEAPHTQAFGEWPWGQELGSRAPGLGGDAGSPAPPFHSSSYRISLAGVEPSLVQAALGQLVRLSCSDDTAPESQAAWQKDGQPISSDRHRLQFDGSLIIHPLQAEDAGTYSCGSTRPGRDSQKIQLRIIGGDMAVLSEAELSRFPQPRDPAQDFGQAGAAGPLGAIPSSHPQPANRLRLDQNQPRVVDASPGQRIRMTCRAEGFPPPAIEWQRDGQPVSSPRHQLQPDGSLVISRVAVEDGGFYTCVAFNGQDRDQRWVQLRVLGELTISGLPPTVTVPEGDTARLLCVVAGESVNIRWSRNGLPVQADGHRVHQSPDGTLLIYNLRARDEGSYTCSAYQGSQAVSRSTEVKVVSPAPTAQPRDPGRDCVDQPELANCDLILQAQLCGNEYYSSFCCASCSRFQPHAQPIWQ

SEQ ID NO: 7266 - protein, 1627 aa, unidentified
MRLWSWVLHLGLLSAALGCGLAERPRRARRDPRAGRPPRPAAGPATCATRAARGRRASPPPPPPPGGAWEAVRVPRRRQQREARGATEEPSPPSRALYFSGRGEQLRLRADLELPRDAFTLQVWLRAEGGQRSPAVITGLYDKCSYISRDRGWVVGIHTISDQDNKDPRYFFSLKTDRARQVTTINAHRSYLPGQWVYLAATYDGQFMKLYVNGAQVATSGEQVGGIFSPLTQKCKVLMLGGSALNHNYRGYIEHFSLWKVARTQREILSDMETHGAHTALPQLLLQENWDNVKHAWSPMKDGSSPKVEFSNAHGFLLDTSLEPPLCGQTLCDNTEVIASYNQLSSFRQPKVVRYRVVNLYEDDHKNPTVTREQVDFQHHQLAEAFKQYNISWELDVLEVSNSSLRRRLILANCDISKIGDENCDPECNHTLTGHDGGDCRHLRHPAFVKKQHNGVCDMDCNYERFNFDGGECCDPEITNVTQTCFDPDSPHRAYLDVNELKNILKLDGSTHLNIFFAKSSEEELAGVATWPWDKEALMHLGGIVLNPSFYGMPGHTHTMIHEIGHSLGLYHVFRGISEIQSCSDPCMETEPSFETGDLCNDTNPAPKHKSCGDPGPGNDTCGFHSFFNTPYNNFMSYADDDCTDSFTPNQVARMHCYLDLVYQGWQPSRKPAPVALAPQVLGHTTDSVTLEWFPPIDGHFFERELGSACHLCLEGRILVQYASNASSPMPCSPSGHWSPREAEGHPDVEQPCKSSVRTWSPNSAVNPHTVPPACPEPQGCYLELEFLYPLVPESLTIWVTFVSTDWDSSGAVNDIKLLAVSGKNISLGPQNVFCDVPLTIRLWDVGEEVYGIQIYTLDEHLEIDAAMLTSTADTPLCLQCKPLKYKVVRDPPLQMDVASILHLNRKFVDMDLNLGSVYQYWVITISGTEESEPSPAVTYIHGSGYCGDGIIQKDQGEQCDDMNKINGDGCSLFCRQEVSFNCIDEPSRCYFHDGDGVCEEFEQKTSIKDCGVYTPQGFLDQWASNASVSHQDQQCPGWVIIGQPAASQVCRTKVIDLSEGISQHAWYPCTISYPYSQLAQTTFWLRAYFSQPMVAAAVIVHLVTDGTYYGDQKQETISVQLLDTKDQSHDLGLHVLSCRNNPLIIPVVHDLSQPFYHSQAVRVSFSSPLVAISGVALRSFDNFDPVTLSSCQRGETYSPAEQSCVHFACEKTDCPELAVENASLNCSSSDRYHGAQCTVSCRTGYVLQIRRDDELIKSQTGPSVTVTCTEGKWNKQVACEPVDCSIPDHHQVYAASFSCPEGTTFGSQCSFQCRHPAQLKGNNSLLTCMEDGLWSFPEALCELMCLAPPPVPNADLQTARCRENKHKVGSFCKYKCKPGYHVPGSSRKSKKRAFKTQCTQDGSWQEGACVPVTCDPPPPKFHGLYQCTNGFQFNSECRIKCEDSDASQGLGSNVIHCRKDGTWNGSFHVCQEMQGQCSVPNELNSNLKLQCPDGYAIGSECATSCLDHNSESIILPMNVTVRDIPHWLNPTRVERVVCTAGLKWYPHPALIHCVKGCEPFMGDNYCDAINNRAFCNYDGGDCCTSTVKTKKVTPFPMSCDLQGDCACRDPQAQEHSRKDLRGYSHG

SEQ ID NO: 7267 - protein, 1791 aa, unidentified; identical to SEQ ID NO: 3340

SEQ ID NO: 7268 - protein, 678 aa, unidentified
MAAPGPLPAAALSPGAPTPRELMHGVAGVTSRAGRDREAGSVLPAGNRGARKASRRSSSRSMSRDNKFSKKDCLSIRNVVASIQTKEGLNLKLISGDVLYIWADVIVNSVPMNLQLGGGPLSRAFLQKAGPMLQKELDDRRRETEEKVGNIFMTSGCNLDCKAVLHAVAPYWNNGAETSWQIMANIIKKCLTTVEVLSFSSITFPMIGTGSLQFPKAVFAKLILSEVFEYSSSTRPITSPLQEVHFLVYTNDDEGCQAFLDEFTNWSRINPNKARIPMAGDTQGVVGTVSKPCFTAYEMKIGAITFQVATGDIATEQVDVIVNSTARTFNRKSGVSRAILEGAGQAVESECAVLAAQPHRDFIITPGGCLKCKIIIHVPGGKDVRKTVTSVLEECEQRKYTSVSLPAIGTGNAGKNPITVADNIIDAIVDFSSQHSTPSLKTVKVVIFQPELLNIFYDSMKKRDLSASLNFQSTFSMTTCNLPEHWTDMNHQLFCMVQLEPGQSEYNTIKDKFTRTCSSYAIEKIERIQNAFLWQSYQVKKRQMDIKNDHKNNERLLFHGTDADSVPYVNQHGFNRSCAGKNAVSYGKGTYFAVDASYSAKDTYSKPDSNGRKHMYVVRVLTGVFTKGRAGLVTPPPKNPHNPTDLFDSVTNNTRSPKLFVVFFDNQAYPEYLITFTA

SEQ ID NO: 7269 - protein, 364 aa, unidentified; identical to SEQ ID NO: 3351

SEQ ID NO: 7270 - protein, 126 aa, unidentified
MDKSLLLELPILLCCFRALSGSLSMRNDAVNEIVAVKNNFPVIEIVQCRMCHLQFPGEKCSRGRGICTATTEEACMVGRMFKRDGNPWLTFMGCLKNCADVKGIRWSVYLVNFRCCRSHDLCNEDL

SEQ ID NO: 7271 - protein, 113 aa, unidentified
MLVLFLLGTVFLLCPYWGELHDPIKATEIMCYECKKYHLGLCYGVMTSCSLKHKQSCAVENFYILTRKGQSMYHYSKLSCMTSCEDINFLGFTKRVELICCDHSNYCNLPEGV

SEQ ID NO: 7272 - protein, 98 aa, unidentified
MNKHFLFLFLLYCLIVAVTSLQCITCHLRTRTDRCRRGFGVCTAQKGEACMLLRIYQRNTLQISYMVCQKFCRDMTFDLRNRTYVHTCCNYNYCNFKL

SEQ ID NO: 7273 - protein, 98 aa, unidentified
MRKMNTLLLVSLSFLYLKEVMGLKCNTCIYTEGWKCMAGRGTCIAKENELCSTTAYFRGDKHMYSTHMCKYKCREEESSKRGLLRVTLCCDRNFCNVF

SEQ ID NO: 7274 - protein, 543 aa, unidentified
MNCLEGPGKTCGPLASEEELVSACQLEKEEENEGEEEEEEEDEEDLDPDLDPDLEEEENDLGDPAVLGAVHNTQRALLSSPGVKAPGMLGMSLASLHFLWQTLDYLSPIPFWPTFPSTSSPAQHFGPRLPSPDPTLFCSLLTSWPPRFSHLTQLHPRHQRILQQQQHSQTPSPPAKKPWSQQPDPYANLMTRKEKDWVIKVQMVQLQSAKPRLDDYYYQEYYQKLEKKQADEELLGRRNRVESLKLVTPYIPKAEAYESVVRIEGSLGQVAVSTCFSPRRAIDAVPHGTQEQDIEAASSQRLRVLYRIEKMFLQLLEIEEGWKYRPPPPCFSEQQSNQVEKLFQTLKTQEQNNLEEAADGFLQVLSVRKGKALVARLLPFLPQDQAVTILLAITHHLPLLVRRDVADQALQMLFKPLGKCISHLTLHELLQGLQGLTLLPPGSSERPVTVVLQNQFGISLLYALLSHGEQLVSLHSSLEEPNSDHTAWTDMVVLIAWEIAQMPTASLAEPLAFPSNLLPLFCHHVDKQLVQQLEARMEFAWIY

SEQ ID NO: 7275 - protein, 417 aa, unidentified
MDMHCKADPFSAMHPGHGGVNQLGGVFVNGRPLPDVVRQRIVELAHQGVRPCDISRQLRVSHGCVSKILGRYYETGSIKPGVIGGSKPKVATPKVVDKIAEYKRQNPTMFAWEIRDRLLAEGICDNDTVPSVSSINRIIRTKVQQPFHPTPDGAGTGVTAPGHTIVPSTASPPVSSASNDPVGSYSINGILGIPRSNGEKRKRDEVEVYTDPAHIRGGGGLHLVWTLRDVSEGSVPNGDSQSGVDSLRKHLRADTFTQQQLEALDRVFERPSYPDVFQASEHIKSEQGNEYSLPALTPGLDEVKSSLSASTNPELGSNVSGTQTYPVVTGRDMASTTLPGYPPHVPPTGQGSYPTSTLAGMVPGSEFSGNPYSHPQYTAYNEAWRFSNPALLSSPYYYSAAPRGSAPAAAAAAYDRH

SEQ ID NO: 7276 - protein, 350 aa, unidentified
MHQDGISSMNQLGGLFVNGRPLPLDTRQQIVRLAVSGMRPCDISRILKVSNGCVSKILGRYYRTGVLEPKGIGGSKPRLATPPVVARIAQLKGECPALFAWEIQRQLCAEGLCTQDKTPSVSSINRVLRALQEDQGLPCTRLRSPAVLAPAVLTPHSGSETPRGTHPGTGHRNRTIFSPSQAEALEKEFQRGQYPDSVARGKLATATSLPEDTVRVWFSNRRAKWRRQEKLKWEMQLPGASQGLTVPRVAPGIISAQQSPGSVPTAALPALEPLGPSCYQLCWATAPERCLSDTPPKACLKPCWDCGSFLLPVIAPSCVDVAWPCLDASLAHHLIGGAGKATPTHFSHWP

SEQ ID NO: 7277 - protein, 539 aa, unidentified
MAAALRVAAVGARLSVLASGLRAAVRSLCSQATSVNERIENKRRTALLGGGQRRIDAQHKRGKLTARERISLLLDPGSFVESDMFVEHRCADFGMAADKNKFPGDSVVTGRGRINGRLVYVFSQDFTVFGGSLSGAHAQKICKIMDQAITVGAPVIGLNDSGGARIQEGVESLAGYADIFLRNVTASGVIPQISLIMGPCAGGAVYSPALTDFTFMVKDTSYLFITGPDVVKSVTNEDVTQEELGGAKTHTTMSGVAHRAFENDVDALCNLRDFFNYLPLSSQDPAPVRECHDPSDRLVPELDTIVPLESTKAYNMVDIIHSVVDEREFFEIMPNYAKNIIVGFARMNGRTVGIVGNQPKVASGCLDINSSVKGARFVRFCDAFNIPLITFVDVPGFLPGTAQEYGGIIRHGAKLLYAFAEATVPKVTVITRKAYGGAYDVMSSKHLCGDTNYAWPTAEIAVMGAKGAVEIIFKGHENVEAAQAEYIEKFANPFPAAVRGFVDDIIQPSSTRARICCDLDVLASKKVQRPWRKHANIPL

SEQ ID NO: 7278 - protein, 1060 aa, unidentified; identical to SEQ ID NO: 3355

SEQ ID NO: 7279 - protein, 1184 aa, unidentified; identical to SEQ ID NO: 3359

SEQ ID NO: 7280 - protein, 1955 aa, unidentified; identical to SEQ ID NO: 3360

SEQ ID NO: 7281 - protein, 950 aa, unidentified; identical to SEQ ID NO: 3367

SEQ ID NO: 7282 - protein, 948 aa, unidentified; identical to SEQ ID NO: 3368

SEQ ID NO: 7283 - protein, 949 aa, unidentified; identical to SEQ ID NO: 3369

SEQ ID NO: 7284 - protein, 950 aa, unidentified; identical to SEQ ID NO: 3376

SEQ ID NO: 7285 - protein, 795 aa, unidentified; identical to SEQ ID NO: 3385

SEQ ID NO: 7286 - protein, 935 aa, unidentified; identical to SEQ ID NO: 3398

SEQ ID NO: 7287 - protein, 1555 aa, unidentified
MSEQTPAEAGAAGAREDACRDYQSSLEDLTFNSKPHINMLTILAEENLPFAKEIVSLIEAQTAKAPSSEKLPVMYLMDSIVKNVGREYLTAFTKNLVATFICVFEKVDENTRKSLFKLRSTWDEIFPLKKLYALDVRVNSLDPAWPIKPLPPNVNTSSIHVNPKFLNKSPEEPSTPGTVVSSPSISTPPIVPDIQKNLTQEQLIRQQLLAKQKQLLELQQKKLELELEQAKAQLAVSLSVQQETSNLGPGSAPSKLHVSQIPPMAVKAPHQVPVQSEKSRPGPSLQIQDLKGTNRDPRLNRISQHSHGKDQSHRKEFLMNTLNQSDTKTSKTIPSEKLNSSKQEKSKSGEKITKKELDQLDSKSKSKSKSPSPLKNKLSHTKDLKNQESESMRLSDMNKRDPRLKKHLQDKTDGKDDDVKEKRKTAEKKDKDEHMKSSEHRLAGSRNKIINGIVQKQDTITEESEKQGTKPGRSSTRKRSRSRSPKSRSPIIHSPKRRDRRSPKRRQRSMSPTSTPKAGKIRQSGAKQSHMEEFTPPSREDRNAKRSTKQDIRDPRRMKKTEEERPQETTNQHSTKSGTEPKENVENWQSSKSAKRWKSGWEENKSLQQVDEHSKPPHLRHRESWSSTKGILSPRAPKQQQHRLSVDANLQIPKELTLASKRELLQKTSERLASGEITQDDFLVVVHQIRQLFQYQEGVREEQRSPFNDRFPLKRPRYEDSDKPFVDSPASRFAGLDTNQRLTALAEDRPLFDGPSRPSVARDGPTKMIFEGPNKLSPRIDGPPTPASLRFDGSPGQMGGGGPLRFEGPQGQLGGGCPLRFEGPPGPVGTPLRFEGPIGQAGGGGFRFEGSPGLRFEGSPGGLRFEGPGGQPVGGLRFEGHRGQPVGGLRFEGPHGQPVGGLRFDNPRGQPVGGLRFEGGHGPSGAAIRFDGPHGQPGGGIRFEGPLLQQGVGMRFEGPHGQSVAGLRFEGQHNQLGGNLRFEGPHGQPGVGIRFEGPLVQQGGGMRFEGPSVPGGGLRIEGPLGQGGPRFEGCHALRFDGQPGQPSLLPRFDGLHGQPGPRFERTPGQPGPQRFDGPPGQQVQPRFDGVPQRFDGPQHQQASRFDIPLGLQGTRFDNHPSQRLESVSFNQTGPYNDPPGNAFNAPSQGLQFQRHEQIFDSPQGPNFNGPHGPGNQSFSNPLNRASGHYFDEKNLQSSQFGNFGNIPAPMTVGNIQASQQVLSGVAQPVAFGQGQQFLPVHPQNPGFVQNPSGALPKAYPDNHLSQVDVNELFSKLLKTGILKLSQTDSATTQVSEVTAQPPPEEEEDQNEDQDVPDLTNFTVEELKQRYDSVINRLYTGIQCYSCGMRFTTSQTDVYADHLDWHYRQNRTEKDVSRKVTHRRWYYSLTDWIEFEEIADLEERAKSQFFEKVHEEVVLKTQEAAKEKEFQSVPAGPAGAVESCEICQEQFEQYWDEEEEEWHLKNAIRVDGKIYHPSCYEDYQNTSSFDCTPSPSKTPVENPLNIMLNIVKNELQEPCDSPKVKEERIDTPPACTEESIATPSEIKTENDTVESV

SEQ ID NO: 7288 - protein, 449 aa, unidentified
MLPAATASLLGPLLTACALLPFAQGQTPNYTRPVFLCGGDVKGESGYVASEGFPNLYPPNKECIWTITVPEGQTVSLSFRVFDLELHPACRYDALEVFAGSGTSGQRLGRFCGTFRPAPLVAPGNQVTLRMTTDEGTGGRGFLLWYSGRATSGTEHQFCGGRLEKAQGTLTTPNWPESDYPPGISCSWHIIAPPDQVIALTFEKFDLEPDTYCRYDSVSVFNGAVSDDSRRLGKFCGDAVPGSISSEGNELLVQFVSDLSVTADGFSASYKTLPRGTAKEGQGPGPKRGTEPKVKLPPKSQPPEKTEESPSAPDAPTCPKQCRRTGTLQSNFCASSLVVTATVKSMVREPGEGLAVTVSLIGAYKTGGLDLPSPPTGASLKFYVPCKQCPPMKKGVSYLLMGQVEENRGPVLPPESFVVLHRPNQDQILTNLSKRKCPSQPVRAAASQD

SEQ ID NO: 7289 - protein, 415 aa, unidentified
MRGANAWAPLCLLLAAATQLSRQQSPERPVFTCGGILTGESGFIGSEGFPGVYPPNSKCTWKITVPEGKVVVLNFRFIDLESDNLCRYDFVDVYNGHANGQRIGRFCGTFRPGALVSSGNKMMVQMISDANTAGNGFMAMFSAAEPNERGDQYCGGLLDRPSGSFKTPNWPDRDYPAGVTCVWHIVAPKNQLIELKFEKFDVERDNYCRYDYVAVFNGGEVNDARRIGKYCGDSPPAPIVSERNELLIQFLSDLSLTADGFIGHYIFRPKKLPTTTEQPVTTTFPVTTGLKPTVALCQQKCRRTGTLEGNYCSSDFVLAGTVITTITRDGSLHATVSIINIYKEGNLAIQQAGKNMSARLTVVCKQCPLLRRGLNYIIMGQVGEDGRGKIMPNSFIMMFKTKNQKLLDALKNKQC

SEQ ID NO: 7290 - protein, 753 aa, unidentified
MERRAWSLQCTAFVLFCAWCALNSAKAKRQFVNEWAAEIPGGPEAASAIAEELGYDLLGQIGSLENHYLFKHKNHPRRSRRSAFHITKRLSDDDRVIWAEQQYEKERSKRSALRDSALNLFNDPMWNQQWYLQDTRMTAALPKLDLHVIPVWQKGITGKGVVITVLDDGLEWNHTDIYANYDPEASYDFNDNDHDPFPRYDPTNENKHGTRCAGEIAMQANNHKCGVGVAYNSKVGGIRMLDGIVTDAIEASSIGFNPGHVDIYSASWGPNDDGKTVEGPGRLAQKAFEYGVKQGRQGKGSIFVWASGNGGRQGDNCDCDGYTDSIYTISISSASQQGLSPWYAEKCSSTLATSYSSGDYTDQRITSADLHNDCTETHTGTSASAPLAAGIFALALEANPNLTWRDMQHLVVWTSEYDPLANNPGWKKNGAGLMVNSRFGFGLLNAKALVDLADPRTWRSVPEKKECVVKDNDFEPRALKANGEVIIEIPTRACEGQENAIKSLEHVQFEATIEYSRRGDLHVTLTSAAGTSTVLLAERERDTSPNGFKNWDFMSVHTWGENPIGTWTLRITDMSGRIQNEGRIVNWKLILHGTSSQPEHMKQPRVYTSYNTVQNDRRGVEKMVDPGEEQPTQENPKENTLVSKSPSSSSVGGRRDELEEGAPSQAMLRLLQSAFSKNSPPKQSPKKSPSAKLNIPYENFYEALEKLNKPSQLKDSEDSLYNDYVDVFYNTKPYKHRDDRLLQALVDILNEEN

SEQ ID NO: 7291 - protein, 260 aa, unidentified
MAGSPLLWGPRAGGVGLLVLLLLGLFRPPPALCARPVKEPRGLSAASPPLAETGAPRRFRRSVPRGEAAGAVQELARALAHLLEAERQERARAEAQEAEDQQARVLAQLLRVWGAPRNSDPALGLDDDPDAPAAQLARALLRARLDPAALAAQLVPAPVPAAALRPRPPVYDDGPAGPDAEEAGDETPDVDPELLRYLLGRILAGSADSEGVAAPRRLRRAADHDVGSELPPEGVLGALLRVKRLETPAPQVPARRLLPP

SEQ ID NO: 7292 - protein, 638 aa, unidentified
MKGGCVSQWKAAAGFLFCVMVFASAERPVFTNHFLVELHKGGEDKARQVAAEHGFGVRKLPFAEGLYHFYHNGLAKAKRRRSLHHKQQLERDPRVKMALQQEGFDRKKRGYRDINEIDINMNDPLFTKQWYLINTGQADGTPGLDLNVAEAWELGYTGKGVTIGIMDDGIDYLHPDLASNYNAEASYDFSSNDPYPYPRYTDDWFNSHGTRCAGEVSAAANNNICGVGVAYNSKVAGIRMLDQPFMTDIIEASSISHMPQLIDIYSASWGPTDNGKTVDGPRELTLQAMADGVNKGRGGKGSIYVWASGDGGSYDDCNCDGYASSMWTISINSAINDGRTALYDESCSSTLASTFSNGRKRNPEAGVATTDLYGNCTLRHSGTSAAAPEAAGVFALALEANLGLTWRDMQHLTVLTSKRNQLHDEVHQWRRNGVGLEFNHLFGYGVLDAGAMVKMAKDWKTVPERFHCVGGSVQDPEKIPSTGKLVLTLTTDACEGKENFVRYLEHVQAVITVNATRRGDLNINMTSPMGTKSILLSRRPRDDDSKVGFDKWPFMTTHTWGEDARGTWTLELGFVGSAPQKGVLKEWTLMLHGTQSAPYIDQVVRDYQSKLAMSKKEELEEELDEAVERSLKSILNKN

SEQ ID NO: 7293 - protein, 755 aa, unidentified; identical to SEQ ID NO: 3422

SEQ ID NO: 7294 - protein, 1860 aa, unidentified; identical to SEQ ID NO: 3423

SEQ ID NO: 7295 - protein, 692 aa, unidentified
MGTVSSRRSWWPLPLLLLLLLLLGPAGARAQEDEDGDYEELVLALRSEEDGLAEAPEHGTTATFHRCAKDPWRLPGTYVVVLKEETHLSQSERTARRLQAQAARRGYLTKILHVFHGLLPGFLVKMSGDLLELALKLPHVDYIEEDSSVFAQSIPWNLERITPPRYRADEYQPPDGGSLVEVYLLDTSIQSDHREIEGRVMVTDFENVPEEDGTRFHRQASKCDSHGTHLAGVVSGRDAGVAKGASMRSLRVLNCQGKGTVSGTLIGLEFIRKSQLVQPVGPLVVLLPLAGGYSRVLNAACQRLARAGVVLVTAAGNFRDDACLYSPASAPEVITVGATNAQDQPVTLGTLGTNFGRCVDLFAPGEDIIGASSDCSTCFVSQSGTSQAAAHVAGIAAMMLSAEPELTLAELRQRLIHFSAKDVINEAWFPEDQRVLTPNLVAALPPSTHGAGWQLFCRTVWSAHSGPTRMATAVARCAPDEELLSCSSFSRSGKRRGERMEAQGGKLVCRAHNAFGGEGVYAIARCCLLPQANCSVHTAPPAEASMGTRVHCHQQGHVLTGCSSHWEVEDLGTHKPPVLRPRGQPNQCVGHREASIHASCCHAPGLECKVKEHGIPAPQEQVTVACEEGWTLTGCSALPGTSHVLGAYAVDNTCVVRSRDVSTTGSTSEGAVTAVAICCRSRHLAQASQELQ

SEQ ID NO: 7296 - protein, 505 aa, unidentified
MGRVVAELVSSLLGLWLLLCSCGCPEGAELRAPPDKIAIIGAGIGGTSAAYYLRQKFGKDVKIDLFEREEVGGRLATMMVQGQEYEAGGSVIHPLNLHMKRFVKDLGLSAVQASGGLLGIYNGETLVFEESNWFIINVIKLVWRYGFQSLRMHMWVEDVLDKFMRIYRYQSHDYAFSSVEKLLHALGGDDFLGMLNRTLLETLQKAGFSEKFLNEMIAPVMRVNYGQSTDINAFVGAVSLSCSDSGLWAVEGGNKLVCSGLLQASKSNLISGSVMYIEEKTKTKYTGNPTKMYEVVYQIGTETRSDFYDIVLVATPLNRKMSNITFLNFDPPIEEFHQYYQHIVTTLVKGELNTSIFSSRPIDKFGLNTVLTTDNSDLFINSIGIVPSVREKEDPEPSTDGTYVWKIFSQETLTKAQILKLFLSYDYAVKKPWLAYPHYKPPEKCPSIILHDRLYYLNGIECAASAMEMSAIAAHNAALLAYHRWNGHTDMIDQDGLYEKLKTEL

SEQ ID NO: 7297 - protein, 494 aa, unidentified
MARAAPLLAALTALLAAAAAGGDAPPGKIAVVGAGIGGSAVAHFLQQHFGPRVQIDVYEKGTVGGRLATISVNKQHYESGAASFHSLSLHMQDFVKLLGLRHRREVVGRSAIFGGEHFMLEETDWYLLNLFRLWWHYGISFLRLQMWVEEVMEKFMRIYKYQAHGYAFSGVEELLYSLGESTFVNMTQHSVAESLLQVGVTQRFIDDVVSAVLRASYGQSAAMPAFAGAMSLAGAQGSLWSVEGGNKLVCSGLLKLTKANVIHATVTSVTLHSTEGKALYQVAYENEVGNSSDFYDIVVIATPLHLDNSSSNLTFAGFHPPIDDVQGSFQPTVVSLVHGYLNSSYFGFPDPKLFPFANILTTDFPSFFCTLDNICPVNISASFRRKQPQEAAVWRVQSPKPLFRTQLKTLFRSYYSVQTAEWQAHPLYGSRPTLPRFALHDQLFYLNALEWAASSVEVMAVAAKNVALLAYNRWYQDLDKIDQKDLMHKVKTEL

SEQ ID NO: 7298 - protein, 220 aa, unidentified
MASERLPNRPACLLVASGAAEGVSAQSFLHCFTMASTAFNLQVATPGGKAMEFVDVTESNARWVQDFRLKAYASPAKLESIDGARYHALLIPSCPGALTDLASSGSLARILQHFHSESKPICAVGHGVAALCCATNEDRSWVFDSYSLTGPSVCELVRAPGFARLPLVVEDFVKDSGACFSASEPDAVHVVLDRHLVTGQNASSTVPAVQNLLFLCGSRK

SEQ ID NO: 7299 - protein, 933 aa, unidentified
MAASRLDFGEVETFLDRHPELFEDYLMRKGKQEMVEKWLQRHSQGQGALGPRPSLAGTSSLAHSTCRGGSSVGGGTGPNGSAHSQPLPGGGDCGGVPLSPSWAGGSRGDGNLQRRASQKELRKSFARSKAIHVNRTYDEQVTSRAQEPLSSVRRRALLRKASSLPPTTAHILSALLESRVNLPRYPPTAIDYKCHLKKHNERQFFLELVKDISNDLDLTSLSYKILIFVCLMVDADRCSLFLVEGAAAGKKTLVSKFFDVHAGTPLLPCSSTENSNEVQVPWGKGIIGYVGEHGETVNIPDAYQDRRFNDEIDKLTGYKTKSLLCMPIRSSDGEIIGVAQAINKIPEGAPFTEDDEKVMQMYLPFCGIAISNAQLFAASRKEYERSRALLEVVNDLFEEQTDLEKIVKKIMHRAQTLLKCERCSVLLLEDIESPVVKFTKSFELMSPKCSADAENSFKESMEKSSYSDWLINNSIAELVASTGLPVNISDAYQDPRFDAEADQISGFHIRSVLCVPIWNSNHQIIGVAQVLNRLDGKPFDDADQRLFEAFVIFCGLGINNTIMYDQVKKSWAKQSVALDVLSYHATCSKAEVDKFKAANIPLVSELAIDDIHFDDFSLDVDAMITAALRMFMELGMVQKFKIDYETLCRWLLTVRKNYRMVLYHNWRHAFNVCQLMFAMLTTAGFQDILTEVEILAVIVGCLCHDLDHRGTNNAFQAKSGSALAQLYGTSATLEHHHFNHAVMILQSEGHNIFANLSSKEYSDLMQLLKQSILATDLTLYFERRTEFFELVSKGEYDWNIKNHRDIFRSMLMTACDLGAVTKPWEISRQVAELVTSEFFEQGDRERLELKLTPSAIFDRNRKDELPRLQLEWIDSICMPLYQALVKVNVKLKPMLDSVATNRSKWEELHQKRLLASTASSSPASVMVAKEDRN

SEQ ID NO: 7300 - protein, 941 aa, unidentified
MGQACGHSILCRSQQYPAARPAEPRGQQVFLKPDEPPPPPQPCADSLQDALLSLGSVIDISGLQRAVKEALSAVLPRVETVYTYLLDGESQLVCEDPPHELPQEGKVREAIISQKRLGCNGLGFSDLPGKPLARLVAPLAPDTQVLVMPLADKEAGAVAAVILVHCGQLSDNEEWSLQAVEKHTLVALRRVQVLQQRGPREAPRAVQNPPEGTAEDQKGGAAYTDRDRKILQLCGELYDLDASSLQLKVLQYLQQETRASRCCLLLVSEDNLQLSCKVIGDKVLGEEVSFPLTGCLGQVVEDKKSIQLKDLTSEDVQQLQSMLGCELQAMLCVPVISRATDQVVALACAFNKLEGDLFTDEDEHVIQHCFHYTSTVLTSTLAFQKEQKLKCECQALLQVAKNLFTHLDDVSVLLQEIITEARNLSNAEICSVFLLDQNELVAKVFDGGVVDDESYEIRIPADQGIAGHVATTGQILNIPDAYAHPLFYRGVDDSTGFRTRNILCFPIKNENQEVIGVAELVNKINGPWFSKFDEDLATAFSIYCGISIAHSLLYKKVNEAQYRSHLANEMMMYHMKVSDDEYTKLLHDGIQPVAAIDSNFASFTYTPRSLPEDDTSMAILSMLQDMNFINNYKIDCPTLARFCLMVKKGYRDPPYHNWMHAFSVSHFCYLLYKNLELTNYLEDIEIFALFISCMCHDLDHRGTNNSFQVASKSVLAALYSSEGSVMERHHFAQAIAILNTHGCNIFDHFSRKDYQRMLDLMRDIILATDLAHHLRIFKDLQKMAEVGYDRNNKQHHRLLLCLLMTSCDLSDQTKGWKTTRKIAELIYKEFFSQGDLEKAMGNRPMEMMDREKAYIPELQISFMEHIAMPIYKLLQDLFPKAAELYERVASNREHWTKVSHKFTIRGLPSNNSLDFLDEEYEVPDLDGTRAPINGCCSLDAE

SEQ ID NO: 7301 - protein, 482 aa, unidentified
MEVCYQLPVLPLDRPVPQHVLSRRGAISFSSSSALFGCPNPRQLSQRRGAISYDSSDQTALYIRMLGDVRVRSRAGFESERRGSHPYIDFRIFHSQSEIEVSVSARNIRRLLSFQRYLRSSRFFRGTAVSNSLNILDDDYNGQAKCMLEKVGNWNFDIFLFDRLTNGNSLVSLTFHLFSLHGLIEYFHLDMMKLRRFLVMIQEDYHSQNPYHNAVHAADVTQAMHCYLKEPKLANSVTPWDILLSLIAAATHDLDHPGVNQPFLIKTNHYLATLYKNTSVLENHHWRSAVGLLRESGLFSHLPLESRQQMETQIGALILATDISRQNEYLSLFRSHLDRGDLCLEDTRHRHLVLQMALKCADICNPCRTWELSKQWSEKVTEEFFHQGDIEKKYHLGVSPLCDRHTESIANIQIGFMTYLVEPLFTEWARFSNTRLSQTMLGHVGLNKASWKGLQREQSSSEDTDAAFELNSQLLPQENRLS

SEQ ID NO: 7302 - protein, 243 aa, unidentified
MARLWGALSLWPLWAAVPWGGAAAVGVRACSSTAAPDGVEGPALRRSYWRHLRRLVLGPPEPPFSHVCQVGDPVLRGVAAPVERAQLGGPELQRLTQRLVQVMRRRRCVGLSAPQLGVPRQVLALELPEALCRECPPRQRALRQMEPFPLRVFVNPSLRVLDSRLVTFPEGCESVAGFLACVPRFQAVQISGLDPNGEQVVWQASGWAARIIQHEMDHLQGCLFIDKMDSRTFTNVYWMKVND

SEQ ID NO: 7303 - protein, 211 aa, unidentified [sequence omitted]

SEQ ID NO: 7304 - protein, 241 aa, unidentified
MNRCWALFLSLCCYLRLVSAEGDPIPEELYEMLSDHSIRSFDDLQRLLHGDPGEEDGAELDLNMTRSHSGGELESLARGRRSLGSLTIAEPAMIAECKTRTEVFEISRRLIDRTNANFLVWPPCVEVQRCSGCCNNRNVQCRPTQVQLRPVQVRKIEIVRKKPIFKKATVTLEDHLACKCETVAAARPVTRSPGGSQEQRAKTPQTRVTIRTVRVRRPPKGKHRKFKHTHDKTALKETLGA

SEQ ID NO: 7305 - protein, 345 aa, unidentified
MSLFGLLLLTSALAGQRQGTQAESNLSSKFQFSSNKEQNGVQDPQHERIITVSTNGSIHSPRFPHTYPRNTVLVWRLVAVEENVWIQLTFDERFGLEDPEDDICKYDFVEVEEPSDGTILGRWCGSGTVPGKQISKGNQIRIRFVSDEYFPSEPGFCIHYNIVMPQFTEAVSPSVLPPSALPLDLLNNAITAFSTLEDLIRYLEPERWQLDLEDLYRPTWQLLGKAFVFGRKSRVVDLNLLTEEVRLYSCTPRNFSVSIREELKRTDTIFWPGCLLVKRCGGNCACCLHNCNECQCVPSKVTKKYHEVLQLRPKTGVRGLHKSLTDVALEHHEECDCVCRGSTGG

SEQ ID NO: 7306 - protein, 370 aa, unidentified
MHRLIFVYTLICANFCSCRDTSATPQSASIKALRNANLRRDESNHLTDLYRRDETIQVKGNGYVQSPRFPNSYPRNLLLTWRLHSQENTRIQLVFDNQFGLEEAENDICRYDFVEVEDISETSTIIRGRWCGHKEVPPRIKSRTNQIKITFKSDDYFVAKPGFKIYYSLLEDFQPAAASETNWESVTSSISGVSYNSPSVTDPTLIADALDKKIAEFDTVEDLLKYFNPESWQEDLENMYLDTPRYRGRSYHDRKSKVDLDRLNDDAKRYSCTPRNYSVNIREELKLANVVFFPRCLLVQRCGGNCGCGTVNWRSCTCNSGKTVKKYHEVLQFEPGHIKRRGRAKTMALVDIQLDHHERCDCICSSRPPR

SEQ ID NO: 7307 - protein, 1089 aa, unidentified; identical to SEQ ID NO: 3429

SEQ ID NO: 7308 - protein, 1106 aa, unidentified; identical to SEQ ID NO: 3430

SEQ ID NO: 7309 - protein, 375 aa, unidentified
MKVWLLLGLLLVHEALEDVTGQHLPKNKRPKEPGENRIKPTNKKVKPKIPKMKDRDSANSAPKTQSIMMQVLDKGRFQKPAATLSLLAGQTVELRCKGSRIGWSYPAYLDTFKDSRLSVKQNERYGQLTLVNSTSADTGEFSCWVQLCSGYICRKDEAKTGSTYIFFTEKGELFVPSPSYFDVVYLNPDRQAVVPCRVTVLSAKVTLHREFPAKEIPANGTDIVYDMKRGFVYLQPHSEHQGVVYCRAEAGGRSQISVKYQLLYVAVPSGPPSTTILASSNKVKSGDDISVLCTVLGEPDVEVEFTWIFPGQKDERPVTIQDTWRLIHRGLGHTTRISQSVITVEDFETIDAGYYICTAQNLQGQTTVATTVEFS

SEQ ID NO: 7310 - protein, 390 aa, unidentified
MRKMLAAVSRVLSGASQKPASRVLVASRNFANDATFEIKKCDLHRLEEGPPVTTVLTREDGLKYYRMMQTVRRMELKADQLYKQKIIRGFCHLCDGQEACCVGLEAGINPTDHLITAYRAHGFTFTRGLSVREILAELTGRKGGCAKGKGGSMHMYAKNFYGGNGIVGAQVPLGAGIALACKYNGKDEVCLTLYGDGAANQGQIFEAYNMAALWKLPCIFICENNRYGMGTSVERAAASTDYYKRGDFIPGLRVDGMDILCVREATRFAAAYCRSGKGPILMELQTYRYHGHSMSDPGVSYRTREEIQEVRSKSDPIMLLKDRMVNSNLASVEELKEIDVEVRKEIEDAAQFATADPEPPLEELGYHIYSSDPPFEVRGANQWIKFKSVS

SEQ ID NO: 7311 - protein, 525 aa, unidentified
MSRQLLPVLLLLLLRASCPWGQEQGARSPSEEPPEEEIPKEDGILVLSRHTLGLALREHPALLVEFYAPWCGHCQALAPEYSKAAAVLAAESMVVTLAKVDGPAQRELAEEFGVTEYPTLKFFRNGNRTHPEEYTGPRDAEGIAEWLRRRVGPSAMRLEDEAAAQALIGGRDLVVIGFFQDLQDEDVATFLALAQDALDMTFGLTDRPRLFQQFGLTKDTVVLFKKFDEGRADFPVDEELGLDLGDLSRFLVTHSMRLVTEFNSQTSAKIFAARILNHLLLFVNQTLAAHRELLAGFGEAAPRFRGQVLFVVVDVAADNEHVLQYFGLKAEAAPTLRLVNLETTKKYAPVDGGPVTAASITAFCHAVLNGQVKPYLLSQEIPPDWDQRPVKTLVGKNFEQVAFDETKNVFVKFYAPWCTHCKEMAPAWEALAEKYQDHEDIIIAELDATANELDAFAVHGFPTLKYFPAGPGRKVIEYKSTRDLETFSKFLDNGGVLPTEEPPEEPAAPFPEPPANSTMGSKEEL

SEQ ID NO: 7312 - protein, 505 aa, unidentified
MRLRRLALFPGVALLLAAARLAAASDVLELTDDNFESRISDTGSAGLMLVEFFAPWCGHCKRLAPEYEAAATRLKGIVPLAKVDCTANTNTCNKYGVSGYPTLKIFRDGEEAGAYDGPRTADGIVSHLKKQAGPASVPLRTEEEFKKFISDKDASIVGFFDDSFSEAHSEFLKAASNLRDNYRFAHTNVESLVNEYDDNGEGIILFRPSHLTNKFEDKTVAYTEQKMTSGKIKKFIQENIFGICPHMTEDNKDLIQGKDLLIAYYDVDYEKNAKGSNYWRNRVMMVAKKFLDAGHKLNFAVASRKTFSHELSDFGLESTAGEIPVVAIRTAKGEKFVMQEEFSRDGKALERFLQDYFDGNLKRYLKSEPIPESNDGPVKVVVAENFDEIVNNENKDVLIEFYAPWCGHCKNLEPKYKELGEKLSKDPNIVIAKMDATANDVPSPYEVRGFPTIYFSPANKKLNPKKYEGGRELSDFISYLQREATNPPVIQEEKPKKKKKAQEDL

SEQ ID NO: 7313 - protein, 645 aa, unidentified
MRPRKAFLLLLLLGLVQLLAVAGAEGPDEDSSNRENAIEDEEEEEEEDDDEEEDDLEVKEENGVLVLNDANFDNFVADKDTVLLEFYAPWCGHCKQFAPEYEKIANILKDKDPPIPVAKIDATSASVLASRFDVSGYPTIKILKKGQAVDYEGSRTQEEIVAKVREVSQPDWTPPPEVTLVLTKENFDEVVNDADIILVEFYAPWCGHCKKLAPEYEKAAKELSKRSPPIPLAKVDATAETDLAKRFDVSGYPTLKIFRKGRPYDYNGPREKYGIVDYMIEQSGPPSKEILTLKQVQEFLKDGDDVIIIGVFKGESDPAYQQYQDAANNLREDYKFHHTFSTEIAKFLKVSQGQLVVMQPEKFQSKYEPRSHMMDVQGSTQDSAIKDFVLKYALPLVGHRKVSNDAKRYTRRPLVVVYYSVDFSFDYRAATQFWRSKVLEVAKDFPEYTFAIADEEDYAGEVKDLGLSESGEDVNAAILDESGKKFAMEPEEFDSDTLREFVTAFKKGKLKPVIKSQPVPKNNKGPVKVVVGKTFDSIVMDPKKDVLIEFYAPWCGHCKQLEPVYNSLAKKYKGQKGLVIAKMDATANDVPSDRYKVEGFPTIYFAPSGDKKNPVKFEGGDRDLEHLSKFIEEHATKLSRTKEEL

SEQ ID NO: 7314 - protein, 519 aa, unidentified
MARAGPAWLLLAIWVVLPSWLSSAKVSSLIERISDPKDLKKLLRTRNNVLVLYSKSEVAAENHLRLLSTVAQAVKGQGTICWVDCGDAESRKLCKKMKVDLSPKDKKVELFHYQDGAFHTEYNRAVTFKSIVAFLKDPKGPPLWEEDPGAKDVVHLDSEKDFRRLLKKEEKPLLIMFYAPWCSMCKRMMPHFQKAATQLRGHAVLAGMNVYSSEFENIKEEYSVRGFPTICYFEKGRFLFQYDNYGSTAEDIVEWLKNPQPPQPQVPETPWADEGGSVYHLTDEDFDQFVKEHSSVLVMFHAPWCGHCKKMKPEFEKAAEALHGEADSSGVLAAVDATVNKALAERFHISEFPTLKYFKNGEKYAVPVLRTKKKFLEWMQNPEAPPPPEPTWEEQQTSVLHLVGDNFRETLKKKKHTLVMFYAPWCPHCKKVIPHFTATADAFKDDRKIACAAVDCVKDKNQDLCQQEAVKGYPTFHYYHYGKFAEKYDSDRTELGFTNYIRALREGDHERLGKKKEEL

SEQ ID NO: 7315 - protein, 440 aa, unidentified; identical to SEQ ID NO: 3431

SEQ ID NO: 7316 - protein, 584 aa, unidentified
MDLLWMPLLLVAACVSAVHSSPEVNAGVSSIHITKPVHILEERSLLVLTPAGLTQMLNQTRFLMVLFHNPSSKQSRNLAEELGKAVEIMGKGKNGIGFGKVDITIEKELQQEFGITKAPELKLFFEGNRSEPISCKGVVESAALVVWLRRQISQKAFLFNSSEQVAEFVISRPLVIVGFFQDLEEEVAELFYDVIKDFPELTFGVITIGNVIGRFHVTLDSVLVFKKGKIVNRQKLINDSTNKQELNRVIKQHLTDFVIEYNTENKDLISELHIMSHMLLFVSKSSESYGIIIQHYKLASKEFQNKILFILVDADEPRNGRVFKYFRVTEVDIPSVQILNLSSDARYKMPSDDITYESLKKFGRSFLSKNATKHQSSEEIPKYWDQGLVKQLVGKNFNVVVFDKEKDVFVMFYAPWSKKCKMLFPLLEELGRKYQNHSTIIIAKIDVTANDIQLMYLDRYPFFRLFPSGSQQAVLYKGEHTLKGFSDFLESHIKTKIEDEDELLSVEQNEVIEEEVLAEEKEVPMMRKGLPEQQSPELENMTKYVSKLEEPAGKKKTSEEVVVVVAKPKGPPVQKKKPKVKEEL

SEQ ID NO: 7317 - protein, 254 aa, unidentified [sequence omitted]

SEQ ID NO: 7318 - protein, 1154 aa, unidentified
MGLLLMILASAVLGSFLTLLAQFFLLYRRQPEPPADEAARAGEGFRYIKPVPGLLLREYLYGGGRDEEPSGAAPEGGATPTAAPETPAPPTRETCYFLNATILFLFRELRDTALTRRWVTKKIKVEFEELLQTKTAGRLLEGLSLRDVFLGETVPFIKTIRLVRPVVPSATGEPDGPEGEALPAACPEELAFEAEVEYNGGFHLAIDVDLVFGKSAYLFVKLSRVVGRLRLVFTRVPFTHWFFSFVEDPLIDFEVRSQFEGRPMPQLTSIIVNQLKKIIKRKHTLPNYKIRFKPFFPYQTLQGFEEDEEHIHIQQWALTEGRLKVTLLECSRLLIFGSYDREANVHCTLELSSSVWEEKQRSSIKTVELIKGNLQSVGLTLRLVQSTDGYAGHVIIETVAPNSPAAIADLQRGDRLIAIGGVKITSTLQVLKLIKQAGDRVLVYYERPVGQSNQGAVLQDNFGQLEENFLSSSCQSGYEEEAAGLTVDTESRELDSEFEDLASDVRAQNEFKDEAQSLSHSPKRVPTTLSIKPLGAISPVLNRKLAVGSHPLPPKIQSKDGNKPPPLKTSEITDPAQVSKPTQGSAFKPPVPPRPQAKVPLPSADAPNQAEPDVLVEKPEKVVPPPLVDKSAEKQAKNVDAIDDAAAPKQFLAKQEVAKDVTSETSCPTKDSSDDRQTWESSEILYRNKLGKWTRTRASCLFDIEACHRYLNIALWCRDPFKLGGLICLGHVSLKLEDVALGCLATSNTEYLSKLRLEAPSPKAIVTRTALRNLSMQKGFNDKFCYGDITIHFKYLKEGESDHHVVTNVEKEKEPHLVEEVSVLPKEEQFVGQMGLTENKHSFQDTQFQNPTWCDYCKKKVWTKAASQCMFCAYVCHKKCQEKCLAETSVCGATDRRIDRTLKNLRLEGQETLLGLPPRVDAEASKSVNKTTGLTRHIINTSSRLLNLRQVSKTRLSEPGTDLVEPSPKHTPNTSDNEGSDTEVCGPNSPSKRGNSTGIKLVRKEGGLDDSVFIAVKEIGRDLYRGLPTEERIQKLEFMLDKLQNEIDQELEHNNSLVREEKETTDTRKKSLLSAALAKSGERLQALTLLMIHYRAGIEDIETLESLSLDQHSKKISKYTDDTEEDLDNEISQLIDSQPFSSISDDLFGPSESV

SEQ ID NO: 7319 - protein, 1036 aa, unidentified
MGFALERFAEAVDPALECKLCGQVLEEPLCTPCGHVFCASCLLPWAVRRRRCPLQCQPLAPGELYRVLPLRSLIQKLRVQCDYRARGCGHSVRLHELEAHVEHCDFGPARRLRSRGGCASGLGGGEVPARGGCGPTPRAGRGGGARGGPPGGRWGRGRGPGPRVLAWRRREKALLAQLWALQGEVQLTARRYQEKFTQYMAHVRNFVGDLGGGHRRDGEHKPFTIVLERENDTLGFNIIGGRPNQNNQEGTSTEGIYVSKILENGPADRADGLEIHDKIMEVNGKDLSKATHEEAVEAFRNAKEPIVVQVLRRTPLSRPAYGMASEVQLMNASTQTDITFEHIMALAKLRPPTPPVPDICPFLLSDSCHSLHPMEHEFYEDNEYISSLPADADRTEDFEYEEVELCRVSSQEKLGLTVCYRTDDEEDTGIYVSEVDPNSIAAKDGRIREGDRILQINGEDVQNREEAVALLSNDECKRIVLLVARPEIQLDEGWLEDERNEFLEELNLEMLEEEHNEAMQPTANEVEQPKKQEEEEGTTDTATSSSNNHEKDSGVGRTDESLRNDESSEQENAAEDPNSTSLKSKRDLGQSQDTLGSVELQYNESLVSGEYIDSDCIGNPDEDCERFRQLLELKCKIRNHGEYDLYYSSSTIECNQGEQEGVEHELQLLNEELRNIELECQNIMQAHRLQKVTDQYGDIWTLHDGGFRNYNTSIDMQRGKLDDIMEHPEKSDKDSSSAYNTAESCRSTPLTVDRSPDSSLPRVINLTNKKNLRSTMAATQSSSGQSSKESTSTKAKTTEQGCSAESKEKVLEGSKLPDQEKAVSEHIPYLSPYHSSSYRYANIPAHARHYQSYMQLIQQKSAVEYAQSQLSLVSMCKESQKCSEPKMEWKVKIRSDGTRYITKRPVRDRILKERALKIKEERSGMTTDDDTMSEMKMGRYWSKEERKQHLVRAKEQRRRREFMMRSRLECLKESPQSGSEGKKEINIIELSHKKMMKKRNKKILDNWMTIQELMTHGAKSPDGTRVHNAFLSVTTV

SEQ ID NO: 7320 - protein, 1037 aa, unidentified; identical to SEQ ID NO: 3436

SEQ ID NO: 7321 - protein, 227 aa, unidentified
MGWTMRLVTAALLLGLMMVVTGDEDENSPCAHEALLDEDTLFCQGLEVFYPELGNIGCKVVPDCNNYRQKITSWMEPIVKFPGAVDGATYILVMVDPDAPSRAEPRQRFWRHWLVTDIKGADLKKGKIQGQELSAYQAPSPPAHSGFHRYQFFVYLQEGKVISLLPKENKTRGSWKMDRFLNRFHLGEPEASTQFMTQNYQDSPTLQAPRERASEPKHKNQAEIAAC

SEQ ID NO: 7322 - protein, 267 aa, unidentified
MARFLTLCTWLLLLGPGLLATVRAECSQDCATCSYRLVRPADINFLACVMECEGKLPSLKIWETCKELLQLSKPELPQDGTSTLRENSKPEESHLLAKRYGGFMKRYGGFMKKMDELYPMEPEEEANGSEILAKRYGGFMKKDAEEDDSLANSSDLLKELLETGDNRERSHHQDGSDNEEEVSKRYGGFMRGLKRSPQLEDEAKELQKRYGGFMRRVGRPEWWMDYQKRYGGFLKRFAEALPSDEEGESYSKEVPEMEKRYGGFMRF

SEQ ID NO: 7323 - protein, 81 aa, unidentified
MSRSSKVVLGLSVLLTAATVAGVHVKQQWDQQRLRDGVIRDIERQIRKKENIRLLGEQIILTEQLEAEREKMLLAKGSQKS

SEQ ID NO: 7324 - protein, 101 aa, unidentified
MSSAAGFCASRPGLLFLGLLLLPLVVAFASAEAEEDGDLQCLCVKTTSQVRPRHITSLEVIKAGPHCPTAQLIATLKNGRKICLDLQAPLYKKIIKKLLES

SEQ ID NO: 7325 - protein, 104 aa, unidentified
MSSAARSRLTRATRQEMLFLALLLLPVVVAFARAEAEEDGDLQCLCVKTTSQVRPRHITSLEVIKAGPHCPTAQLIATLKNGRKICLDLQALLYKKIIKEHLES

SEQ ID NO: 7326 - protein, 784 aa, unidentified
MDADDSRAPKGSLRKFLEHLSGAGKAIGVLTSGGDAQGMNAAVRAVVRMGIYVGAKVYFIYEGYQGMVDGGSNIAEADWESVSSILQVGGTIIGSARCQAFRTREGRLKAACNLLQRGITNLCVIGGDGSLTGANLFRKEWSGLLEELARNGQIDKEAVQKYAYLNVVGMVGSIDNDFCGTDMTIGTDSALHRIIEVVDAIMTTAQSHQRTFVLEVMGRHCGYLALVSALACGADWVFLPESPPEEGWEEQMCVKLSENRARKKRLNIIIVAEGAIDTQNKPITSEKIKELVVTQLGYDTRVTILGHVQRGGTPSAFDRILASRMGVEAVIALLEATPDTPACVVSLNGNHAVRLPLMECVQMTQDVQKAMDERRFQDAVRLRGRSFAGNLNTYKRLAIKLPDDQIPKTNCNVAVINVGAPAAGMNAAVRSAVRVGIADGHRMLAIYDGFDGFAKGQIKEIGWTDVGGWTGQGGSILGTKRVLPGKYLEEIATQMRTHSINALLIIGGFEAYLGLLELSAAREKHEEFCVPMVMVPATVSNNVPGSDFSIGADTALNTITDTCDRIKQSASGTKRRVFIIETMGGYCGYLANMGGLAAGADAAYIFEEPFDIRDLQSNVEHLTEKMKTTIQRGLVLRNESCSENYTTDFIYQLYSEEGKGVFDCRKNVLGHMQQGGAPSPFDRNFGTKISARAMEWITAKLKEARGRGKKFTTDDSICVLGISKRNVIFQPVAELKKQTDFEHRIPKEQWWLKLRPLMKILAKYKASYDVSDSGQLEHVQPWSV

SEQ ID NO: 7327 - protein, 140 aa, unidentified
MAGWNAYIDNLMADGTCQDAAIVGYKDSPSVWAAVPGKTFVNITPAEVGVLVGKDRSSFYVNGLTLGGQKCSVIRDSLLQDGEFSMDLRTKSTGGAPTFNVTVTKTDKTLVLLMGKEGVHGGLINKKCYEMASHLRRSQY

SEQ ID NO: 7328 - protein, 388 aa, unidentified
MKWLLLLGLVALSECIMYKVPLIRKKSLRRTLSERGLLKDFLKKHNLNPARKYFPQWKAPTLVDEQPLENYLDMEYFGTIGIGTPAQDFTVVFDTGSSNLWVPSVYCSSLACTNHNRFNPEDSSTYQSTSETVSITYGTGSMTGILGYDTVQVGGISDTNQIFGLSETEPGSFLYYAPFDGILGLAYPSISSSGATPVFDNIWNQGLVSQDLFSVYLSADDQSGSVVIFGGIDSSYYTGSLNWVPVTVEGYWQITVDSITMNGEAIACAEGCQAIVDTGTSLLTGPTSPIANIQSDIGASENSDGDMVVSCSAISSLPDIVFTINGVQYPVPPSAYILQSEGSCISGFQGMNLPTESGELWILGDVFIRQYFTVFDRANNQVGLAPVA

SEQ ID NO: 7329 - protein, 388 aa, unidentified
MKWLLLLGLVALSECIMYKVPLIRKKSLRRTLSERGLLKDFLKKHNLNPARKYFPQWEAPTLVDEQPLENYLDMEYFGTIGIGTPAQDFTVVFDTGSSNLWVPSVYCSSLACTNHNRFNPEDSSTYQSTSETVSITYGTGSMTGILGYDTVQVGGISDTNQIFGLSETEPGSFLYYAPFDGILGLAYPSISSSGATPVFDNIWNQGLVSQDLFSVYLSADDQSGSVVIFGGIDSSYYTGSLNWVPVTVEGYWQITVDSITMNGEAIACAEGCQAIVDTGTSLLTGPTSPIANIQSDIGASENSDGDMVVSCSAISSLPDIVFTINGVQYPVPPSAYILQSEGSCISGFQGMNLPTESGELWILGDVFIRQYFTVFDRANNQVGLAPVA

SEQ ID NO: 7330 - protein, 388 aa, unidentified
MKWLLLLGLVALSECIMYKVPLIRKKSLRRTLSERGLLKDFLKKHNLNPARKYFPQWEAPTLVDEQPLENYLDMEYFGTIGIGTPAQDFTVVFDTGSSNLWVPSVYCSSLACTNHNRFNPEDSSTYQSTSETVSITYGTGSMTGILGYDTVQVGGISDTNQIFGLSETEPGSFLYYAPFDGILGLAYPSISSSGATPVFDNIWNQGLVSQDLFSVYLSADDKSGSVVIFGGIDSSYYTGSLNWVPVTVEGYWQITVDSITMNGETIACAEGCQAIVDTGTSLLTGPTSPIANIQSDIGASENSDGDMVVSCSAISSLPDIVFTINGVQYPVPPSAYILQSEGSCISGFQGMNVPTESGELWILGDVFIRQYFTVFDRANNQVGLAPVA

SEQ ID NO: 7331 - protein, 289 aa, unidentified
MAFRQALQLAACGLAGGSAAVLFSAVAVGKPRAGGDAEPRPAEPPAWAGGARPGPGVWDPNWDRREPLSLINVRKRNVESGEEELASKLDHYKAKATRHIFLIRHSQYHVDGSLEKDRTLTPLGREQAELTGLRLASLGLKFNKIVHSSMTRAIETTDIISRHLPGVCKVSTDLLREGAPIEPDPPVSHWKPEAVQYYEDGARIEAAFRNYIHRADARQEEDSYEIFICHANVIRYIVCRALQFPPEGWLRLSLNNGSITHLVIRPNGRVALRTLGDTGFMPPDKITRS

SEQ ID NO: 7332 - protein, 320 aa, unidentified; identical to SEQ ID NO: 3454

SEQ ID NO: 7333 - protein, 388 aa, unidentified
MKWMVVVLVCLQLLEAAVVKVPLKKFKSIRETMKEKGLLGEFLRTHKYDPAWKYRFGDLSVTYEPMAYMDAAYFGEISIGTPPQNFLVLFDTGSSNLWVPSVYCQSQACTSHSRFNPSESSTYSTNGQTFSLQYGSGSLTGFFGYDTLTVQSIQVPNQEFGLSENEPGTNFVYAQFDGIMGLAYPALSVDEATTAMQGMVQEGALTSPVFSVYLSNQQGSSGGAVVFGGVDSSLYTGQIYWAPVTQELYWQIGIEEFLIGGQASGWCSEGCQAIVDTGTSLLTVPQQYMSALLQATGAQEDEYGQFLVNCNSIQNLPSLTFIINGVEFPLPPSSYILSNNGYCTVGVEPTYLSSQNGQPLWILGDVFLRSYYSVYDLGNNRVGFATAA

SEQ ID NO: 7334 - protein, 221 aa, unidentified
MPVMRLFPCFLQLLAGLALPAVPPQQWALSAGNGSSEVEVVPFQEVWGRSYCRALERLVDVVSEYPSEVEHMFSPSCVSLLRCTGCCGDENLHCVPVETANVTMQLLKIRSGDRPSYVELTFSQHVRCECRHSPGRQSPDMPGDFRADAPSFLPPRRSLPMLFRMEWGCALTGSQSAVWPSSPVPEEIPRMHPGRNGKKQQRKPLREKMKPERCGDAVPRR

SEQ ID NO: 7335 - protein, 196 aa, unidentified
MSRRSMLLAWALPSLLRLGAAQETEDPACCSPIVPRNEWKALASECAQHLSLPLRYVVVSHTAGSSCNTPASCQQQARNVQHYHMKTLGWCDVGYNFLIGEDGLVYEGRGWNFTGAHSGHLWNPMSIGISFMGNYMDRVPTPQAIRAAQGLLACGVAQGALRSNYVLKGHRDVQRTLSPGNQLYHLIQNWPHYRSP

SEQ ID NO: 7336 - protein, 576 aa, unidentified; identical to SEQ ID NO: 3455

SEQ ID NO: 7337 - protein, 341 aa, unidentified
MGTLPWLLAFFILGLQAWDTPTIVSRKEWGARPLACRALLTLPVAYIITDQLPGMQCQQQSVCSQMLRGLQSHSVYTIGWCDVAYNFLVGDDGRVYEGVGWNIQGLHTQGYNNISLGIAFFGNKIGSSPSPAALSAAEGLISYAIQKGHLSPRYIQPLLLKEETCLDPQHPVMPRKVCPNIIKRSAWEARETHCPKMNLPAKYVIIIHTAGTSCTVSTDCQTVVRNIQSFHMDTRNFCDIGYHFLVGQDGGVYEGVGWHIQGSHTYGFNDIALGIAFIGYFVEKPPNAAALEAAQDLIQCAVVEGYLTPNYLLMGHSDVVNILSPGQALYNIISTWPHFKH

SEQ ID NO: 7338 - protein, 373 aa, unidentified
MLPWLLVFSALGIQAWGDSSWNKTQAKQVSEGLQYLFENISQLTEKGLPTDVSTTVSRKAWGAEAVGCSIQLTTPVNVLVIHHVPGLECHDQTVCSQRLRELQAHHVHNNSGCDVAYNFLVGDDGRVYEGVGWNIQGVHTQGYNNISLGFAFFGTKKGHSPSPAALSAMENLITYAVQKGHLSSSYVQPLLGKGENCLAPRQKTSLKKACPGVVPRSVWGARETHCPRMTLPAKYGIIIHTAGRTCNISDECRLLVRDIQSFYIDRLKSCDIGYNFLVGQDGAIYEGVGWNVQGSSTPGYDDIALGITFMGTFTGIPPNAAALEAAQDLIQCAMVKGYLTPNYLLVGHSDVARTLSPGQALYNIISTWPHFKH

SEQ ID NO: 7339 - protein, 580 aa, unidentified
MDYPKMDYFLDVESAHRLLDVESAQRFFYSQGAQARRATLLLPPTLMAASSEDDIDRRPIRRVRSKSDTPYLAEARISFNLGAAEEVERLAAMRSDSLVPGTHTPPIRRRSKFANLGRIFKPWKWRKKKSEKFKHTSAALERKISMRQSREELIKRGVLKEIYDKDGELSISNEEDSLENGQSLSSSQLSLPALSEMEPVPMPRDPCSYEVLQPSDIMDGPDPGAPVKLPCLPVKLSPPLPPKKVMICMPVGGPDLSLVSYTAQKSGQQGVAQHHHTVLPSQIQHQLQYGSHGQHLPSTTGSLPMHPSGCRMIDELNKTLAMTMQRLESSEQRVPCSTSYHSSGLHSGDGVTKAGPMGLPEIRQVPTVVIECDDNKENVPHESDYEDSSCLYTREEEEEEEDEDDDSSLYTSSLAMKVCRKDSLAIKLSNRPSKRELEEKNILPRQTDEERLELRQQIGTKLTRRLSQRPTAEELEQRNILKPRNEQEEQEEKREIKRRLTRKLSQRPTVEELRERKILIRFSDYVEVADAQDYDRRADKPWTRLTAADKAAIRKELNEFKSTEMEVHELSRHLTRFHRP

SEQ ID NO: 7340 - protein, 272 aa, unidentified
MAAKVFESIGKFGLALAVAGGVVNSALYNVDAGHRAVIFDRFRGVQDIVVGEGTHFLIPWVQKPIIFDCRSRPRNVPVITGSKDLQNVNITLRILFRPVASQLPRIFTSIGEDYDERVLPSITTEILKSVVARFDAGELITQRELVSRQVSDDLTERAATFGLILDDVSLTHLTFGKEFTEAVEAKQVAQQEAERARFVVEKAEQQKKAAIISAEGDSKAAELIANSLATAGDGLIELRKLEAAEDIAYQLSRSRNITYLPAGQSVLLQLPQ

SEQ ID NO: 7341 - protein, 258 aa, unidentified
MIAISAVSSALLFSLLCEASTVVLLNSTDSSPPTNNFTDIEAALKAQLDSADIPKARRKRYISQNDMIAILDYHNQVRGKVFPPAANMEYMVWDENLAKSAEAWAATCIWDHGPSYLLRFLGQNLSVRTGRYRSILQLVKPWYDEVKDYAFPYPQDCNPRCPMRCFGPMCTHYTQMVWATSNRIGCAIHTCQNMNVWGSVWRRAVYLVCNYAPKGNWIGEAPYKVGVPCSSCPPSYGGSCTDNLCFPGVTSNYLYWFK

SEQ ID NO: 7342 - protein, 117 aa, unidentified
MRASSFLIVVVFLIAGTLVLEAAVTGVPVKGQDTVKGRVPFNGQDPVKGQVSVKGQDKVKAQEPVKGPVSTKPGSCPIILIRCAMLNPPNRCLKDTDCPGIKKCCEGSCGMACFVPQ

SEQ ID NO: 7343 - protein, 282 aa, unidentified; identical to SEQ ID NO: 3466

SEQ ID NO: 7344 - protein, 395 aa, unidentified; identical to SEQ ID NO: 3476

SEQ ID NO: 7345 - protein, 252 aa, unidentified
MEAMWLLCVALAVLAWGFLWVWDSSERMKSREQGGRLGAESRTLLVIAHPDDEAMFFAPTVLGLARLRHWVYLLCFSAGNYYNQGETRKKELLQSCDVLGIPLSSVMIIDNRDFPDDPGMQWDTEHVARVLLQHIEVNGINLVVTFDAGGVSGHSNHIALYAAVRALHSEGKLPKGCSVLTLQSVNVLRKYISLLDLPLSLLHTQDVLFVLNSKEVAQAKKAMSCHRSQLLWFRRLYIIFSRYMRINSLSFL

SEQ ID NO: 7346 - protein, 578 aa, unidentified; identical to SEQ ID NO: 3484

SEQ ID NO: 7347 - protein, 579 aa, unidentified; identical to SEQ ID NO: 3489

SEQ ID NO: 7348 - protein, 805 aa, unidentified
MAASGVPRGCDILIVYSPDAEEWCQYLQTLFLSSRQVRSQKILTHRLGPEASFSAEDLSLFLSTRCVVVLLSAELVQHFHKPALLPLLQRAFHPPHRVVRLLCGVRDSEEFLDFFPDWAHWQELTCDDEPETYVAAVKKAISEDSGCDSVTDTEPEDEKVVSYSKQQNLPTVTSPGNLMVVQPDRIRCGAETTVYVIVRCKLDDRVATEAEFSPEDSPSVRMEAKVENEYTISVKAPNLSSGNVSLKIYSGDLVVCETVISYYTDMEEIGNLLSNAANPVEFMCQAFKIVPYNTETLDKLLTESLKNNIPASGLHLFGINQLEEEDMMTNQRDEELPTLLHFAAKYGLKNLTALLLTCPGALQAYSVANKHGHYPNTIAEKHGFRDLRQFIDEYVETVDMLKSHIKEELMHGEEADAVYESMAHLSTDLLMKCSLNPGCDEDLYESMAAFVPAATEDLYVEMLQASTSNPIPGDGFSRATKDSMIRKFLEGNSMGMTNLERDQCHLGQEEDVYHTVDDDEAFSVDLASRPPVPVPRPETTAPGAHQLPDNEPYIFKVFAEKSQERPGNFYVSSESIRKGPPVRPWRDRPQSSIYDPFAGMKTPGQRQLITLQEQVKLGIVNVDEAVLHFKEWQLNQKKRSESFRFQQENLKRLRDSITRRQREKQKSGKQTDLEITVPIRHSQHLPAKVEFGVYESGPRKSVIPPRTELRRGDWKTDSTSSTASSTSNRSSTRSLLSVSSGMEGDNEDNEVPEVTRSRSPGPPQVDGTPTMSLERPPRVPPRAASQRPPTRETFHPPPPVPPRGR

SEQ ID NO: 7349 - protein, 263 aa, unidentified; identical to SEQ ID NO: 3490

SEQ ID NO: 7350 - protein, 303 aa, unidentified; identical to SEQ ID NO: 3491

SEQ ID NO: 7351 - protein, 227 aa, unidentified; identical to SEQ ID NO: 3492

SEQ ID NO: 7352 - protein, 204 aa, unidentified
MRLSRRPETFLLAFVLLCTLLGLGCPLHCEICTAAGSRCHGQMKTCSSDKDTCVLLVGKATSKGKELVHTYKGCIRSQDCYSGVISTTMGPKDHMVTSSFCCQSDGCNSAFLSVPLTNLTENGLMCPACTASFRDKCMGPMTHCTGKENHCVSLSGHVQAGIFKPRFAMRGCATESMCFTKPGAEVPTGTNVLFLHHIECTHSP

SEQ ID NO: 7353 - protein, 146 aa, unidentified
MRLLQLLFRASPATLLLVLCLQLGANKAQDNTRKIIIKNFDIPKSVRPNDEVTAVLAVQTELKECMVVKTYLISSIPLQGAFNYKYTACLCDDNPKTFYWDFYTNRTVQIAAVVDVIRELGICPDDAAVIPIKNNRFYTIEILKVE

SEQ ID NO: 7354 - protein, 852 aa, unidentified
MSGRARVKARGIARSPSATEVGRIQASPLPRSVDLSNNEASSSNGFLGTSRISTNDKYGISSGDAGSTFMERGVKNKQDFMDLSICTREKLAHVRNCKTGSSGIPVKLVTNLFNLDFPQDWQLYQYHVTYIPDLASRRLRIALLYSHSELSNKAKAFDGAILFLSQKLEEKVTELSSETQRGETIKMTITLKRELPSSSPVCIQVFNIIFRKILKKLSMYQIGRNFYNPSEPMEIPQHKLSLWPGFAISVSYFERKLLFSADVSYKVLRNETVLEFMTALCQRTGLSCFTQTCEKQLIGLIVLTRYNNRTYSIDDIDWSVKPTHTFQKRDGTEITYVDYYKQQYDITVSDLNQPMLVSLLKKKRNDNSEAQLAHLIPELCFLTGLTDQATSDFQLMKAVAEKTRLSPSGRQQRLARLVDNIQRNTNARFELETWGLHFGSQISLTGRIVPSEKILMQDHICQPVSAADWSKDIRTCKILNAQSLNTWLILCSDRTEYVAESFLNCLRRVAGSMGFNVDYPKIIKVQENPAAFVRAIQQYVDPDVQLVMCILPSNQKTYYDSIKKYLSSDCPVPSQCVLARTLNKQGMMMSIATKIAMQMTCKLGGELWAVEIPLKSLMVVGIDVCKDALSKDVMVVGCVASVNPRITRWFSRCILQRTMTDVADCLKVFMTGALNKWYKYNHDLPARIIVYRAGVGDGQLKTLIEYEVPQLLSSVAESSSNTSSRLSVIVVRKKCMPRFFTEMNRTVQNPPLGTVVDSEATRNEWYDFYLISQVACRGTVSPTYYNVIYDDNGLKPDHMQRLTFKLCHLYYNWPGIVSVPAPCQYAHKLTFLVAQSIHKEPSLELANHLFYL

SEQ ID NO: 7355 - protein, 493 aa, unidentified
MRRRRAAVAAGFCASFLLGSVLNVLFAPGSEPPRPGQSPEPSPAPGPGRRGGRGELARQIRARYEEVQRYSRGGPGPGAGRPERRRLMDLAPGGPGLPRPRPPWARPLSDGAPGWPPAPGPGSPGPGPRLGCAALRNVSGAQYMGSGYTKAVYRVRLPGGAAVALKAVDFSGHDLGSCVREFGVRRGCYRLAAHKLLKEMVLLERLRHPNVLQLYGYCYQDSEDIPDTLTTITELGAPVEMIQLLQTSWEDRFRICLSLGRLLHHLAHSPLGSVTLLDFRPRQFVLVDGELKVTDLDDARVEETPCAGSTDCILEFPARNFTLPCSAQGWCEGMNEKRNLYNAYRFFFTYLLPHSAPPSLRPLLDSIVNATGELAWGVDETLAQLEKVLHLYRSGQYLQNSTASSSTEYQCIPDSTIPQEDYRCWPSYHHGSCLLSVFNLAEAVDVCESHAQCRAFVVTNQTTWTGRQLVFFKTGWSQVVPDPNKTTYVKASG

SEQ ID NO: 7356 - protein, 4074 aa, unidentified; identical to SEQ ID NO: 3502

SEQ ID NO: 7357 - protein, 456 aa, unidentified
MPPGPWESCFWVGGLILWLSVGSSGDAPPTPQPKCADFQSANLFEGTDLKVQFLLFVPSNPSCGQLVEGSSDLQNSGFNATLGTKLIIHGFRVLGTKPSWIDTFIRTLLRATNANVIAVDWIYGSTGVYFSAVKNVIKLSLEISLFLNKLLVLGVSESSIHIIGVSLGAHVGGMVGQLFGGQLGQITGLDPAGPEYTRASVEERLDAGDALFVEAIHTDTDNLGIRIPVGHVDYFVNGGQDQPGCPTFFYAGYSYLICDHMRAVHLYISALENSCPLMAFPCASYKAFLAGRCLDCFNPFLLSCPRIGLVEQGGVKIEPLPKEVKVYLLTTSSAPYCMHHSLVEFHLKELRNKDTNIEVTFLSSNITSSSKITIPKQQRYGKGIIAHATPQCQINQVKFKFQSSNRVWKKDRTTIIGKFCTALLPVNDREKMVCLPEPVNLQASVTVSCDLKIACV

SEQ ID NO: 7358 - protein, 165 aa, unidentified
MGPLPVCLPIMLLLLLPSLLLLLLLPGPGSGEASRILRVHRRGILELAGTVGCVGPRTPIAYMKYGCFCGLGGHGQPRDAIDWCCHGHDCCYTRAEEAGCSPKTERYSWQCVNQSVLCGPAENKCQELLCKCDQEIANCLAQTEYNLKYLFYPQFLCEPDSPKCD

SEQ ID NO: 7359 - protein, 189 aa, unidentified
MALLSRPALTLLLLLMAAVVRCQEQAQTTDWRATLKTIRNGVHKIDTYLNAALDLLGGEDGLCQYKCSDGSKPFPRYGYKPSPPNGCGSPLFGVHLNIGIPSLTKCCNQHDRCYETCGKSKNDCDEEFQYCLSKICRDVQKTLGLTQHVQACETTVELLFDSVIHLGCKPYLDSQRAACRCHYEEKTDL

SEQ ID NO: 7360 - protein, 195 aa, unidentified
MKLASGFLVLWLSLGGGLAQSDTSPDTEESYSDWGLRHLRGSFESVNSYFDSFLELLGGKNGVCQYRCRYGKAPMPRPGYKPQEPNGCGSYFLGLKVPESMDLGIPAMTKCCNQLDVCYDTCGANKYRCDAKFRWCLHSICSDLKRSLGFVSKVEAACDSLVDTVFNTVWTLGCRPFMNSQRAACICAEEEKEEL

SEQ ID NO: 7361 - protein, 412 aa, unidentified; identical to SEQ ID NO: 3506

SEQ ID NO: 7362 - protein, 148 aa, unidentified
MKLLVLAVLLTVAAADSGISPRAVWQFRKMIKCVIPGSDPFLEYNNYGCYCGLGGSGTPVDELDKCCQTHDNCYDQAKKLDSCKFLLDNPYTHTYSYSCSGSAITCSSKNKECEAFICNCDRNAAICFSKAPYNKAHKNLDTKKYCQS

SEQ ID NO: 7363 - protein, 144 aa, unidentified
MKTLLLLAVIMIFGLLQAHGNLVNFHRMIKLTTGKEAALSYGFYGCHCGVGGRGSPKDATDRCCVTHDCCYKRLEKRGCGTKFLSYKFSNSGSRITCAKQDSCRSQLCECDKAAATCFARNKTTYNKKYQYYSNKHCRGSTPRC

SEQ ID NO: 7364 - protein, 150 aa, unidentified
MLIATSFFLFFSSVVAAPTHSSFWQFQRRVKHITGRSAFFSYYGYGCYCGLGDKGIPVDDTDSPSSPSPYEKLKEFSCQPVLNSYQFHIVNGAVVCGCTLGPGASCHCRLKACECDKQSVHCFKESLPTYEKNFKQFSSQPRCGRHKPWC

SEQ ID NO: 7365 - protein, 145 aa, unidentified
MELALLCGLVVMAGVIPIQGGILNLNKMVKQVTGKMPILSYWPYGCHCGLGGRGQPKDATDWCCQTHDCCYDHLKTQGCSIYKDYYRYNFSQGNIHCSDKGSWCEQQLCACDKEVAFCLKRNLDTYQKRLRFYWRPHCRGQTPGC

SEQ ID NO: 7366 - protein, 142 aa, unidentified
MKSPHVLVFLCLLVALVTGNLVQFGVMIEKMTGKSALQYNDYGCYCGIGGSHWPVDQTDWCCHAHDCCYGRLEKLGCEPKLEKYLFSVSERGIFCAGRTTCQRLTCECDKRAALCFRRNLGTYNRKYAHYPNKLCTGPTPPC

SEQ ID NO: 7367 - protein, 509 aa, unidentified
MGVQAGLFGMLGFLGVALGGSPALRWYRTSCHLTKAVPGNPLGYLSFLAKDAQGLALIHARWDAHRRLQSCSWEDEPELTAAYGALCAHETAWGSFIHTPGPELQRALATLQSQWEACRALEESPAGARKKRAAGQSGVPGGGHQREKRGWTMPGTLWCGVGDSAGNSSELGVFQGPDLCCREHDRCPQNISPLQYNYGIRNYRFHTISHCDCDTRFQQCLQNQHDSISDIVGVAFFNVLEIPCFVLEEQEACVAWYWWGGCRMYGTVPLARLQPRTFYNASWSSRATSPTPSSRSPAPPKPRQKQHLRKGPPHQKGSKRPSKANTTALQDPMVSPRLDVAPTGLQGPQGGLKPQGARWVCRSFRRHLDQCEHQIGPREIEFQLLNSAQEPLFHCNCTRRLARFLRLHSPPEVTNMLWELLGTTCFKLAPPLDCVEGKNCSRDPRAIRVSARHLRRLQQRRHQLQDKGTDERQPWPSEPLRGPMSFYNQCLQLTQAARRPDRQQKSWSQ

SEQ ID NO: 7368 - protein, 138 aa, unidentified
MKGLLPLAWFLACSVPAVQGGLLDLKSMIEKVTGKNALTNYGFYGCYCGWGGRGTPKDGTDWCCWAHDHCYGRLEEKGCNIRTQSYKYRFAWGVVTCEPGPFCHVNLCACDRKLVYCLKRNLRSYNPQYQYFPNILCS

SEQ ID NO: 7369 - protein, 441 aa, unidentified
MVPPKLHVLFCLCGCLAVVYPFDWQYINPVAHMKSSAWVNKIQVLMAAASFGQTKIPRGNGPYSVGCTDLMFDHTNKGTFLRLYYPSQDNDRLDTLWIPNKEYFWGLSKFLGTHWLMGNILRLLFGSMTTPANWNSPLRPGEKYPLVVFSHGLGAFRTLYSAIGIDLASHGFIVAAVEHRDRSASATYYFKDQSAAEIGDKSWLYLRTLKQEEETHIRNEQVRQRAKECSQALSLILDIDHGKPVKNALDLKFDMEQLKDSIDREKIAVIGHSFGGATVIQTLSEDQRFRCGIALDAWMFPLGDEVYSRIPQPLFFINSEYFQYPANIIKMKKCYSPDKERKMITIRGSVHQNFADFTFATGKIIGHMLKLKGDIDSNVAIDLSNKASLAFLQKHLGLHKDFDQWDCLIEGDDENLIPGTNINTTNQHIMLQNSSGIEKYN

SEQ ID NO: 7370 - protein, 1463 aa, unidentified; identical to SEQ ID NO: 3510

SEQ ID NO: 7371 - protein, 212 aa, unidentified
MKVFKFIGLMILLTSAFSAGSGQSPMTVLCSIDWFMVTVHPFMLNNDVCVHFHELHLGLGCPPNHVQPHAYQFTYRVTECGIRAKAVSQDMVIYSTEIHYSSKGTPSKFVIPVSCAAPQKSPWLTKPCSMRVASKSRATAQKDEKCYEVFSLSQSSQRPNCDCPPCVFSEEEHTQVPCHQAGAQEAQPLQPSHFLDISEDWSLHTDDMIGSM

SEQ ID NO: 7372 - protein, 97 aa, unidentified
MRPLLCALTGLALLRAAGSLAAAEPFSPPRGDSAQSTACDRHMAVQRRLDVMEEMVEKTVDHLGTEVKGLLGLLEELAWNLPPGPFSPAPDLLGDGF

SEQ ID NO: 7373 - protein, 562 aa, unidentified
MDAMKRGLCCVLLLCGAVFVSPSQEIHARFRRGARSYQVICRDEKTQMIYQQHQSWLRPVLRSNRVEYCWCNSGRAQCHSVPVKSCSEPRCFNGGTCQQALYFSDFVCQCPEGFAGKCCEIDTRATCYEDQGISYRGTWSTAESGAECTNWNSSALAQKPYSGRRPDAIRLGLGNHNYCRNPDRDSKPWCYVFKAGKYSSEFCSTPACSEGNSDCYFGNGSAYRGTHSLTESGASCLPWNSMILIGKVYTAQNPSAQALGLGKHNYCRNPDGDAKPWCHVLKNRRLTWEYCDVPSCSTCGLRQYSQPQFRIKGGLFADIASHPWQAAIFAKHRRSPGERFLCGGILISSCWILSAAHCFQERFPPHHLTVILGRTYRVVPGEEEQKFEVEKYIVHKEFDDDTYDNDIALLQLKSDSSRCAQESSVVRTVCLPPADLQLPDWTECELSGYGKHEALSPFYSERLKEAHVRLYPSSRCTSQHLLNRTVTDNMLCAGDTRSGGPQANLHDACQGDSGGPLVCLNDGRMTLVGIISWGLGCGQKDVPGVYTKVTNYLDWIRDNMRP

SEQ ID NO: 7374 - protein, 431 aa, unidentified
MRALLARLLLCVLVVSDSKGSNELHQVPSNCDCLNGGTCVSNKYFSNIHWCNCPKKFGGQHCEIDKSKTCYEGNGHFYRGKASTDTMGRPCLPWNSATVLQQTYHAHRSDALQLGLGKHNYCRNPDNRRRPWCYVQVGLKPLVQECMVHDCADGKKPSSPPEELKFQCGQKTLRPRFKIIGGEFTTIENQPWFAAIYRRHRGGSVTYVCGGSLISPCWVISATHCFIDYPKKEDYIVYLGRSRLNSNTQGEMKFEVENLILHKDYSADTLAHHNDIALLKIRSKEGRCAQPSRTIQTICLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 7375 - protein, 335 aa, unidentified; identical to SEQ ID NO: 3511

SEQ ID NO: 7376 - protein, 553 aa, unidentified
MTRGGPGGRPGLPQPPPLLLLLLLLPLLLVTAEPPKPAGVYYATAYWMPAEKTVQVKNVMDKNGDAYGFYNNSVKTTGWGILEIRAGYGSQTLSNEIIMFVAGFLEGYLTAPHMNDHYTNLYPQLITKPSIMDKVQDFMEKQDKWTRKNIKEYKTDSFWRHTGYVMAQIDGLYVGAKKRAILEGTKPMTLFQIQFLNSVGDLLDLIPSLSPTKNGSLKVFKRWDMGHCSALIKVLPGFENILFAHSSWYTYAAMLRIYKHWDFNVIDKDTSSSRLSFSSYPGFLESLDDFYILSSGLILLQTTNSVFNKTLLKQVIPETLLSWQRVRVANMMADSGKRWADIFSKYNSGTYNNQYMVLDLKKVKLNHSLDKGTLYIVEQIPTYVEYSEQTDVLRKGYWPSYNVPFHEKIYNWSGYPLLVQKLGLDYSYDLAPRAKIFRRDQGKVTDTASMKYIMRYNNYKKDPYSRGDPCNTICCREDLNSPNPSPGGCYDTKVADIYLASQYTSYAISGPTVQGGLPVFRWDRFNKTLHQGMPEVYNFDFITMKPILKLDIK

SEQ ID NO: 7377 - protein, 589 aa, unidentified
MVGQMYCYPGSHLARALTRALALALVLALLVGPFLSGLAGAIPAPGGRWARDGQVPPASRSRSVLLDVSAGQLLMVDGRHPDAVAWANLTNAIRETGWAFLELGTSGQYNDSLQAYAAGVVEAAVSEELIYMHWMNTVVNYCGPFEYEVGYCERLKSFLEANLEWMQEEMESNPDSPYWHQVRLTLLQLKGLEDSYEGRVSFPAGKFTIKPLGFLLLQLSGDLEDLELALNKTKIKPSLGSGSCSALIKLLPGQSDLLVAHNTWNNYQHMLRVIKKYWLQFREGPWGDYPLVPGNKLVFSSYPGTIFSCDDFYILGSGLVTLETTIGNKNPALWKYVRPRGCVLEWVRNIVANRLASDGATWADIFKRFNSGTYNNQWMIVDYKAFIPGGPSPGSRVLTILEQIPGMVVVADKTSELYQKTYWASYNIPSFETVFNASGLQALVAQYGDWFSYDGSPRAQIFRRNQSLVQDMDSMVRLMRYNDFLHDPLSLCKACNPQPNGENAISARSDLNPANGSYPFQALRQRSHGGIDVKVTSMSLARILSLLAASGPTWDQVPPFQWSTSPFSGLLHMGQPDLWKFAPVKVSWD

SEQ ID NO: 7378 - protein, 136 aa, unidentified
MEHKEVVLLLLLFLKSGQGEPLDDYVNTQGASLFSVTKKQLGAGSIEECAAKCEEDEEFTCRAFQYHSKEQQCVIMAENRKSSIIIRMRDVVLFEKKVYLSECKTGNGKNYRGTMSKTKNGITCQKWSSTSPHRPR

SEQ ID NO: 7379 - protein, 96 aa, unidentified
MEHKEVVLLLLLFLKSGQGEPLDDYVNTQGPSLFSVTKKQLGAGSREECAAKCEEDKEFTCRAFQYHSKEQQCVIMAENRKSSIIIRMRDAVLFEK

SEQ ID NO: 7380 - protein, 96 aa, unidentified; identical to SEQ ID NO: 7379

SEQ ID NO: 7381 - protein, 727 aa, unidentified
MRPLLLLALLGWLLLAEAKGDAKPEDNLLVLTVATKETEGFRRFKRSAQFFNYKIQALGLGEDWNVEKGTSAGGGQKVRLLKKALEKHADKEDLVILFADSYDVLFASGPRELLKKFRQARSQVVFSAEELIYPDRRLETKYPVVSDGKRFLGSGGFIGYAPNLSKLVAEWEGQDSDSDQLFYTKIFLDPEKREQINITLDHRCRIFQNLDGALDEVVLKFEMGHVRARNLAYDTLPVLIHGNGPTKLQLNYLGNYIPRFWTFETGCTVCDEGLRSLKGIGDEALPTVLVGVFIEQPTPFVSLFFQRLLRLHYPQKHMRLFIHNHEQHHKAQVEEFLAQHGSEYQSVKLVGPEVRMANADARNMGADLCRQDRSCTYYFSVDADVALTEPNSLRLLIQQNKNVIAPLMTRHGRLWSNFWGALSADGYYARSEDYVDIVQGRRVGVWNVPYISNIYLIKGSALRGELQSSDLFHHSKLDPDMAFCANIRQQDVFMFLTNRHTLGHLLSLDSYRTTHLHNDLWEVFSNPEDWKEKYIHQNYTKALAGKLVETPCPDVYWFPIFTEVACDELVEEMEHFGQWSLGNNKDNRIQGGYENVPTIDIHMNQIGFEREWHKFLLEYIAPMTEKLYPGYYTRAQFDLAFVVRYKPDEQPSLMPHHDASTFTINIALNRVGVDYEGGGCRFLRYNCSIRAPRKGWTLMHPGRLTHYHEGLPTTRGTRYIAVSFVDP

SEQ ID NO: 7382 - protein, 737 aa, unidentified; identical to SEQ ID NO: 3521

SEQ ID NO: 7383 - protein, 738 aa, unidentified
MTSSGPGPRFLLLLPLLLPPAASASDRPRGRDPVNPEKLLVITVATAETEGYLRFLRSAEFFNYTVRTLGLGEEWRGGDVARTVGGGQKVRWLKKEMEKYADREDMIIMFVDSYDVILAGSPTELLKKFVQSGSRLLFSAESFCWPEWGLAEQYPEVGTGKRFLNSGGFIGFATTIHQIVRQWKYKDDDDDQLFYTRLYLDPGLREKLSLNLDHKSRIFQNLNGALDEVVLKFDRNRVRIRNVAYDTLPIVVHGNGPTKLQLNYLGNYVPNGWTPEGGCGFCNQDRRTLPGGQPPPRVFLAVFVEQPTPFLPRFLQRLLLLDYPPDRVTLFLHNNEVFHEPHIADSWPQLQDHFSAVKLVGPEEALSPGEARDMAMDLCRQDPECEFYFSLDADAVLTNLQTLRILIEENRKVIAPMLSRHGKLWSNFWGALSPDEYYARSEDYVELVQRKRVGVWNVPYISQAYVIRGDTLRMELPQRDVFSGSDTDPDMAFCKSFRDKGIFLHLSNQHEFGRLLATSRYDTEHLHPDLWQIFDNPVDWKEQYIHENYSRALEGEGIVEQPCPDVYWFPLLSEQMCDELVAEMEHYGQWSGGRHEDSRLAGGYENVPTVDIHMKQVGYEDQWLQLLRTYVGPMTESLFPGYHTKARAVMNFVVRYRPDEQPSLRPHHDSSTFTLNVALNHKGLDYEGGGCRFLRYDCVISSPRKGWALLHPGRLTHYHEGLPTTWGTRYIMVSFVDP

SEQ ID NO: 7384 - protein, 1894 aa, unidentified; identical to SEQ ID NO: 3539

SEQ ID NO: 7385 - protein, 1838 aa, unidentified; identical to SEQ ID NO: 3541

SEQ ID NO: 7386 - protein, 502 aa, unidentified
MAQRCVCVLALVAMLLLVFPTVSRSMGPRSGEHQRASRIPSQFSKEERVAMKEALKGAIQIPTVTFSSEKSNTTALAEFGKYIHKVFPTVVSTSFIQHEVVEEYSHLFTIQGSDPSLQPYLLMAHFDVVPAPEEGWEVPPFSGLERDGIIYGRGTLDDKNSVMALLQALELLLIRKYIPRRSFFISLGHDEESSGTGAQRISALLQSRGVQLAFIVDEGGFILDDFIPNFKKPIALIAVSEKGSMNLMLQVNMTSGHSSAPPKETSIGILAAAVSRLEQTPMPIIFGSGTVVTVLQQLANEFPFPVNIILSNPWLFEPLISRFMERNPLTNAIIRTTTALTIFKAGVKFNVIPPVAQATVNFRIHPGQTVQEVLELTKNIVADNRVQFHVLSAFDPLPVSPSDDKALGYQLLRQTVQSVFPEVNITAPVTSIGNTDSRFFTNLTTGIYRFYPIYIQPEDFKRIHGVNEKISVQAYETQVKFIFELIQNADTDQEPVSHLHKL

SEQ ID NO: 7387 - protein, 165 aa, unidentified
MAKMNLSSYILILTFSLFSQGILLSASKSIRNLDDDMVFNTFRLGKGFQKEDTAEKSVIAPSLEQYKNDESSFMNEEENKVSKNTGSKHNFLNHGLPLNLAIKPYLALKGSVAFPAENGVQNTESTQEKREIGDEENSAKFPIGRRDFDMLRCMLGRVYRPCWQV

SEQ ID NO: 7388 - protein, 661 aa, unidentified; identical to SEQ ID NO: 3545

SEQ ID NO: 7389 - protein, 287 aa, unidentified; identical to SEQ ID NO: 3546

SEQ ID NO: 7390 - protein, 465 aa, unidentified
MLPLWTLSLLLGAVAGKEVCYERLGCFSDDSPWSGITERPLHILPWSPKDVNTRFLLYTNENPNNFQEVAADSSSISGSNFKTNRKTRFIIHGFIDKGEENWLANVCKNLFKVESVNCICVDWKGGSRTGYTQASQNIRIVGAEVAYFVEFLQSAFGYSPSNVHVIGHSLGAHAAGEAGRRTNGTIGRITGLDPAEPCFQGTPELVRLDPSDAKFVDVIHTDGAPIVPNLGFGMSQVVGHLDFFPNGGVEMPGCKKNILSQIVDIDGIWEGTRDFAACNHLRSYKYYTDSIVNPDGFAGFPCASYNVFTANKCFPCPSGGCPQMGHYADRYPGKTNDVGQKFYLDTGDASNFARWRYKVSVTLSGKKVTGHILVSLFGNKGNSKQYEIFKGTLKPDSTHSNEFDSDVDVGDLQMVKFIWYNNVINPTLPRVGASKIIVETNVGKQFNFCSPETVREEVLLTLTPC

SEQ ID NO: 7391 - protein, 467 aa, unidentified
MLIFWTITLFLLGAAKGKEVCYEDLGCFSDTEPWGGTAIRPLKILPWSPEKIGTRFLLYTNENPNNFQILLLSDPSTIEASNFQMDRKTRFIIHGFIDKGDESWVTDMCKKLFEVEEVNCICVDWKKGSQATYTQAANNVRVVGAQVAQMLDILLTEYSYPPSKVHLIGHSLGAHVAGEAGSKTPGLSRITGLDPVEASFESTPEEVRLDPSDADFVDVIHTDAAPLIPFLGFGTNQQMGHLDFFPNGGESMPGCKKNALSQIVDLDGIWAGTRDFVACNHLRSYKYYLESILNPDGFAAYPCTSYKSFESDKCFPCPDQGCPQMGHYADKFAGRTSEEQQKFFLNTGEASNFARWRYGVSITLSGRTATGQIKVALFGNKGNTHQYSIFRGILKPGSTHSYEFDAKLDVGTIEKVKFLWNNNVINPTLPKVGATKITVQKGEEKTVYNFCSEDTVREDTLLTLTPC

SEQ ID NO: 7392 - protein, 467 aa, unidentified
MLGIWIVAFLFFGTSRGKEVCYERLGCFKDGLPWTRTFSTELVGLPWSPEKINTRFLLYTIHNPNAYQEISAVNSSTIQASYFGTDKITRINIAGWKTDGKWQRDMCNVLLQLEDINCINLDWINGSREYIHAVNNLRVVGAEVAYFIDVLMKKFEYSPSKVHLIGHSLGAHLAGEAGSRIPGLGRITGLDPAGPFFHNTPKEVRLDPSDANFVDVIHTNAARILFELGVGTIDACGHLDFYPNGGKHMPGCEDLITPLLKFNFNAYKKEMASFFDCNHARSYQFYAESILNPDAFIAYPCRSYTSFKAGNCFFCSKEGCPTMGHFADRFHFKNMKTNGSHYFLNTGSLSPFARWRHKLSVKLSGSEVTQGTVFLRVGGAVRKTGEFAIVSGKLEPGMTYTKLIDADVNVGNITSVQFIWKKHLFEDSQNKLGAEMVINTSGKYGYKSTFCSQDIMGPNILQNLKPC

SEQ ID NO: 7393 - protein, 176 aa, unidentified
MKVLLCDLLLLSLFSSVFSSCQRDCLTCQEKLHPALDSFDLEVCILECEEKVFPSPLWTPCTKVMARSSWQLSPAAPEHVAAALYQPRASEMQHLRRMPRVRSLFQEQEEPEPGMEEAGEMEQKQLQKRFGGFTGARKSARKLANQKRFSEFMRQYLVLSMQSSQRRRTLHQNGNV

SEQ ID NO: 7394 - protein, 289 aa, unidentified
MENGYTYEDYKNTAEWLLSHTKHRPQVAIICGSGLGGLTDKLTQAQIFDYGEIPNFPRSTVPGHAGRLVFGFLNGRACVMMQGRFHMYEGYPLWKVTFPVRVFHLLGVDTLVVTNAAGGLNPKFEVGDIMLIRDHINLPGFSGQNPLRGPNDERFGDRFPAMSDAYDRTMRQRALSTWKQMGEQRELQEGTYVMVAGPSFETVAECRVLQKLGADAVGMSTVPEVIVARHCGLRVFGFSLITNKVIMDYESLEKANHEEVLAAGKQAAQKLEQFVSILMASIPLPDKAS

SEQ ID NO: 7395 - protein, 253 aa, unidentified
MKHINLSFAACGFLGIYHLGAASALCRHGKKLVKDVKAFAGASAGSLVASVLLTAPEKIEECNQFTYKFAEEIRRQSFGAVTPGYDFMARLRSGMESILPPSAHELAQNRLHVSITNAKTRENHLVSTFSSREDLIKVLLASSFVPIYAGLKLVEYKGQKWVDGGLTNALPILPVGRTVTISPFSGRLDISPQDKGQLDLYVNIAKQDIMLSLANLVRLNQALFPPSKRKMESLYQCGFDDTVKFLLKENWFE

SEQ ID NO: 7396 - protein, 512 aa, unidentified
MAESGLAMWPSLLLLLLLPGPPPVAGLEDAAFPHLGESLQPLPRACPLRCSCPRVDTVDCDGLDLRVFPDNITRAAQHLSLQNNQLQELPYNELSRLSGLRTLNLHNNLISSEGLPDEAFESLTQLQHLCVAHNKLSVAPQFLPRSLRVADLAANQVMEIFPLTFGEKPALRSVYLHNNQLSNAGLPPDAFRGSEAIATLSLSNNQLSYLPPSLPPSLERLHLQNNLISKVPRGALSRQTQLRELYLQHNQLTDSGLDATTFSKLHSLEYLDLSHNQLTTVPAGLPRTLAILHLGRNRIRQVEAARLHGARGLRYLLLQHNQLGSSGLPAGALRPLRGLHTLHLYGNGLDRVPPALPRRLRALVLPHNHVAALGARDLVATPGLTELNLAYNRLASARVHHRAFRRLRALRSLDLAGNQLTRLPMGLPTGLRTLQLQRNQLRMLEPEPLAGLDQLRELSLAHNRLRVGDIGPGTWHELQALQVRHRLVSHTVPRAPPSPCLPCHVPNILVSW

SEQ ID NO: 7397 - protein, 388 aa, unidentified
MGAAAWARPLSVSFLLLLLPLPGMPAGSWDPAGYLLYCPCMGRFGNQADHFLGSLAFAKLLNRTLAVPPWIEYQHHKPPFTNLHVSYQKYFKLEPLQAYHRVISLEDFMEKLAPTHWPPEKRVAYCFEVAAQRSPDKKTCPMKEGNPFGPFWDQFHVSFNKSELFTGISFSASYREQWSQRFSPKEHPVLALPGAPAQFPVLEEHRPLQKYMVWSDEMVKTGEAQIHAHLVRPYVGIHLRIGSDWKNACAMLKDGTAGSHFMASPQCVGYSRSTAAPLTMTMCLPDLKEIQRAVKLWVRSLDAQSVYVATDSESYVPELQQLFKGKVKVVSLKPEVAQVDLYILGQADHFIGNCVSSFTAFVKRERDLQGRPSSFFGMDRPPKLRDEF

SEQ ID NO: 7398 - protein, 429 aa, unidentified
MATLSFVFLLLGAVSWPPASASGQEFWPGQSAADILSGAASRRRYLLYDVNPPEGFNLRRDVYIRIASLLKTLLKTEEWVLVLPPWGRLYHWQSPDIHQVRIPWSEFFDLPSLNKNIPVIEYEQFIAESGGPFIDQVYVLQSYAEGWKEGTWEEKVDERPCIDQLLYSQDKHEYYRGWFWGYEETRGLNVSCLSVQGSASIVAPLLLRNTSARSVMLDRAENLLHDHYGGKEYWDTRRSMVFARHLREVGDEFRSRHLNSTDDADRIPFQEDWMKMKVKLGSALGGPYLGVHLRRKDFIWGHRQDVPSLEGAVRKIRSLMKTHRLDKVFVATDAVRKEYEELKKLLPEMVRFEPTWEELELYKDGGVAIIDQWICAHARFFIGTSVSTFSFRIHEEREILGLDPKTTYNRFCGDQEKACEQPTHWKITY

SEQ ID NO: 7399 - protein, 392 aa, unidentified
MEWWASSPLRLWLLLFLLPSAQGRQKESGSKWKVFIDQINRSLENYEPCSSQNCSCYHGVIEEDLTPFRGGISRKMMAEVVRRKLGTHYQITKNRLYRENDCMFPSRCSGVEHFILEVIGRLPDMEMVINVRDYPQVPKWMEPAIPVFSFSKTSEYHDIMYPAWTFWEGGPAVWPIYPTGLGRWDLFREDLVRSAAQWPWKKKNSTAYFRGSRTSPERDPLILLSRKNPKLVDAEYTKNQAWKSMKDTLGKPAAKDVHLVDHCKYKYLFNFRGVAASFRFKHLFLCGSLVFHVGDEWLEFFYPQLKPWVHYIPVKTDLSNVQELLQFVKANDDVAQEIAERGSQFIRNHLQMDDITCYWENLLSEYSKFLSYNVTRRKGYDQIIPKMLKTEL

SEQ ID NO: 7400 - protein, 575 aa, unidentified
MDPRGILKAFPKRQKIHADASSKVLAKIPRREEGEEAEEWLSSLRAHVVRTGIGRARAELFEKQIVQHGGQLCPAQGPGVTHIVVDEGMDYERALRLLRLPQLPPGAQLVKSAWLSLCLQERRLVDVAGFSIFIPSRYLDHPQPSKAEQDASIPPGTHEALLQTALSPPPPPTRPVSPPQKAKEAPNTQAQPISDDEASDGEETQVSAADLEALISGHYPTSLEGDCEPSPAPAVLDKWVCAQPSSQKATNHNLHITEKLEVLAKAYSVQGDKWRALGYAKAINALKSFHKPVTSYQEACSIPGIGKRMAEKIIEILESGHLRKLDHISESVPVLELFSNIWGAGTKTAQMWYQQGFRSLEDIRSQASLTTQQAIGLKHYSDFLERMPREEATEIEQTVQKAAQAFNSGLLCVACGSYRRGKATCGDVDVLITHPDGRSHRGIFSRLLDSLRQEGFLTDDLVSQEENGQQQKYLGVCRLPGPGRRHRRLDIIVVPYSEFACALLYFTGSAHFNRSMRALAKTKGMSLSEHALSTAVVRNTHGCKVGPGRVLPTPTEKDVFRLLGLPYREPAERDW

SEQ ID NO: 7401 - protein, 267 aa, unidentified
MPRSCCSRSGALLLALLLQASMEVRGWCLESSQCQDLTTESNLLECIRACKPDLSAETPMFPGNGDEQPLTENPRKYVMGHFRWDRFGRRNSSSSGSSGAGQKREDVSAGEDCGPLPEGGPEPRSDGAKPGPREGKRSYSMEHFRWGKPVGKKRRPVKVYPNGAEDESAEAFPLEFKRELTGQRLREGDGPDGPADDGAGAQADLEHSLLVAAEKKDEGPYRMEHFRWGSPPKDKRYGGFMTSEKSQTPLVTLFKNAIIKNAYKKGE

SEQ ID NO: 7402 - protein, 580 aa, unidentified
MHLSAVFNALLVSVLAAVLWKHVRLREHAATLEEELALSRQATEPAPALRIDYPKALQILMEGGTHMVCTGRTHTDRICRFKWLCYSNEAEEFIFFHGNTSVMLPNLGSRRFQPALLDLSTVEDHNTQYFNFVELPAAALRFMPKPVFVPDVALIANRFNPDNLMHVFHDDLLPLFYTLRQFPGLAHEARLFFMEGWGEGAHFDLYKLLSPKQPLLRAQLKTLGRLLCFSHAFVGLSKITTWYQYGFVQPQGPKANILVSGNEIRQFARFMTEKLNVSHTGVPLGEEYILVFSRTQNRLILNEAELLLALAQEFQMKTVTVSLEDHTFADVVRLVSNASMLVSMHGAQLVTTLFLPRGATVVELFPYAVNPDHYTPYKTLAMLPGMDLQYVAWRNMMPENTVTHPERPWDQGGITHLDRAEQARILQSREVPRHLCCRNPEWLFRIYQDTKVDIPSLIQTIRRVVKGRPGPRKQKWTVGLYPGKVREARCQASVHGASEARLTVSWQIPWNLKYLKVREVKYEVWLQEQGENTYVPYILALQNHTFTENIKPFTTYLVWVRCIFNKILLGPFADVLVCNT

SEQ ID NO: 7403 - protein, 355 aa, unidentified [sequence omitted]

SEQ ID NO: 7404 - protein, 354 aa, unidentified
MGRLVAVGLLGIALALLGERLLALRNRLKASREVESVDLPHCHLIKGIEAGSEDIDILPNGLAFFSVGLKFPGLHSFAPDKPGGILMMDLKEEKPRARELRISRGFDLASFNPHGISTFIDNDDTVYLFVVNHPEFKNTVEIFKFEEAENSLLHLKTVKHELLPSVNDITAVGPAHFYATNDHYFSDPFLKYLETYLNLHWANVVYYSPNEVKVVAEGFDSANGINISPDDKYIYVADILAHEIHVLEKHTNMNLTQLKVLELDTLVDNLSIDPSSGDIWVGCHPNGQKLFVYDPNNPPSSEVLRIQNILSEKPTVTTVYANNGSVLQGSSVASVYDGKLLIGTLYHRALYCEL

SEQ ID NO: 7405 - protein, 354 aa, unidentified
MGKLVALVLLGVGLSLVGEMFLAFRERVNASREVEPVEPENCHLIEELESGSEDIDILPSGLAFISSGLKYPGMPNFAPDEPGKIFLMDLNEQNPRAQALEISGGFDKELFNPHGISIFIDKDNTVYLYVVNHPHMKSTVEIFKFEEQQRSLVYLKTIKHELLKSVNDIVVLGPEQFYATRDHYFTNSLLSFFEMILDLRWTYVLFYSPREVKVVAKGFCSANGITVSADQKYVYVADVAAKNIHIMEKHDNWDLTQLKVIQLGTLVDNLTVDPATGDILAGCHPNPMKLLNYNPEDPPGSEVLRIQNVLSEKPRVSTVYANNGSVLQGTSVASVYHGKILIGTVFHKTLYCEL

SEQ ID NO: 7406 - protein, 836 aa, unidentified
MIPFLPMFSLLLLLIVNPINANNHYDKILAHSRIRGRDQGPNVCALQQILGTKKKYFSTCKNWYKKSICGQKTTVLYECCPGYMRMEGMKGCPAVLPIDHVYGTLGIVGATTTQRYSDASKLREEIEGKGSFTYFAPSNEAWDNLDSDIRRGLESNVNVELLNALHSHMINKRMLTKDLKNGMIIPSMYNNLGLFINHYPNGVVTVNCARIIHGNQIATNGVVHVIDRVLTQIGTSIQDFIEAEDDLSSFRAAAITSDILEALGRDGHFTLFAPTNEAFEKLPRGVLERIMGDKVASEALMKYHILNTLQCSESIMGGAVFETLEGNTIEIGCDGDSITVNGIKMVNKKDIVTNNGVIHLIDQVLIPDSAKQVIELAGKQQTTFTDLVAQLGLASALRPDGEYTLLAPVNNAFSDDTLSMDQRLLKLILQNHILKVKVGLNELYNGQILETIGGKQLRVFVYRTAVCIENSCMEKGSKQGRNGAIHIFREIIKPAEKSLHEKLKQDKRFSTFLSLLEAADLKELLTQPGDWTLFVPTNDAFKGMTSEEKEILIRDKNALQNIILYHLTPGVFIGKGFEPGVTNILKTTQGSKIFLKEVNDTLLVNELKSKESDIMTTNGVIHVVDKLLYPADTPVGNDQLLEILNKLIKYIQIKFVRGSTFKEIPVTVYTTKIITKVVEPKIKVIEGSLQPIIKTEGPTLTKVKIEGEPEFRLIKEGETITEVIHGEPIIKKYTKIIDGVPVEITEKETREERIITGPEIKYTRISTGGGETEETLKKLLQEEVTKVTKFIEGGDGHLFEDEEIKRLLQGDTPVRKLQANKKVQGSRRRLREGRSQ

SEQ ID NO: 7407 - protein, 128 aa, unidentified
MSLRLDTTPSCNSARPLHALQVLLLLSLLLTALASSTKGQTKRNLAKGKEESLDSDLYAELRCMCIKTTSGIHPKNIQSLEVIGKGTHCNQVEVIATLKDGRKICLDPDAPRIKKIVQKKLAGDESAD

SEQ ID NO: 7408 - protein, 216 aa, unidentified
MLRLSERNMKVLLAAALIAGSVFFLLLPGPSAADEKKKGPKVTVKVYFDLRIGDEDVGRVIFGLFGKTVPKTVDNFVALATGEKGFGYKNSKFHRVIKDFMIQGGDFTRGDGTGGKSIYGERFPDENFKLKHYGPGWVSMANAGKDTNGSQFFITTVKTAWLDGKHVVFGKVLEGMEVVRKVESTKTDSRDKPLKDVIIADCGKIEVEKPFAIAKE

SEQ ID NO: 7409 - protein, 212 aa, unidentified
MGPGPRLLLPLVLCVGLGALVFSSGAEGFRKRGPSVTAKVFFDVRIGDKDVGRIVIGLFGKVVPKTVENFVALATGEKGYGYKGSKFHRVIKDFMIQGGDITTGDGTGGVSIYGETFPDENFKLKHYGIGWVSMANAGPDTNGSQFFITLTKPTWLDGKHVVFGKVIDGMTVVHSIELQATDGHDRPLTNCSIINSGKIDVKTPFVVEIADW

SEQ ID NO: 7410 - protein, 477 aa, unidentified
MGRTVVVLGGGISGLAASYHLSRAPCPPKVVLVESSERLGGWIRSVRGPNGAIFELGPRGIRPAGALGARTLLLVSELGLDSEVLPVRGDHPAAQNRFLYVGGALHALPTGLRGLLRPSPPFSKPLFWAGLRELTKPRGKEPDETVHSFAQRRLGPEVASLAMDSLCRGVFAGNSRELSIRSCFPSLFQAEQTHRSILLGLLLGAGRTPQPDSALIRQALAERWSQWSLRGGLEMLPQALETHLTSRGVSVLRGQPVCGLSLQAEGRWKVSLRDSSLEADHVISAIPASVLSELLPAEAAPLARALSAITAVSVAVVNLQYQGAHLPVQGFGHLVPSSEDPGVLGIVYDSVAFPEQDGSPPGLRVTVMLGGSWLQTLEASGCVLSQELFQQRAQEAAATQLGLKEMPSHCLVHLHKNCIPQYTLGHWQKLESARQFLTAHRLPLTLAGASYEGVAVNDCIESGRQAAVSVLGTEPNS

SEQ ID NO: 7411 - protein, 330 aa, unidentified
MSDSEKLNLDSIIGRLLEVQGSRPGKNVQLTENEIRGLCLKSREIFLSQPILLELEAPLKICGDIHGQYYDLLRLFEYGGFPPESNYLFLGDYVDRGKQSLETICLLLAYKIKYPENFFLLRGNHECASINRIYGFYDECKRRYNIKLWKTFTDCFNCLPIAAIVDEKIFCCHGGLSPDLQSMEQIRRIMRPTDVPDQGLLCDLLWSDPDKDVQGWGENDRGVSFTFGAEVVAKFLHKHDLDLICRAHQVVEDGYEFFAKRQLVTLFSAPNYCGEFDNAGAMMSVDETLMCSFQILKPADKNKGKYGQFSGLNPGGRPITPPRNSAKAKK

SEQ ID NO: 7412 - protein, 306 aa, unidentified
MASPGCLWLLAVALLPWTCASRALQHLDPPAPLPLVIWHGMGDSCCNPLSMGAIKKMVEKKIPGIYVLSLEIGKTLMEDVENSFFLNVNSQVTTVCQALAKDPKLQQGYNAMGFSQGGQFLRAVAQRCPSPPMINLISVGGQHQGVFGLPRCPGESSHICDFIRKTLNAGAYSKVVQERLVQAEYWHDPIKEDVYRNHSIFLADINQERGINESYKKNLMALKKFVMVKFLNDSIVDPVDSEWFGFYRSGQAKETIPLQETSLYTQDRLGLKEMDNAGQLVFLATEGDHLQLSEEWFYAHIIPFLG

SEQ ID NO: 7413 - protein, 302 aa, unidentified
MLGLCGQRLPAAWVLLLLPFLPLLLLAAPAPHRASYKPVIVVHGLFDSSYSFRHLLEYINETHPGTVVTVLDLFDGRESLRPLWEQVQGFREAVVPIMAKAPQGVHLICYSQGGLVCRALLSVMDDHNVDSFISLSSPQMGQYGDTDYLKWLFPTSMRSNLYRICYSPWGQEFSICNYWHDPHHDDLYLNASSFLALINGERDHPNATVWRKNFLRVGHLVLIGGPDDGVITPWQSSFFGFYDANETVLEMEEQLVYLRDSFGLKTLLARGAIVRCPMAGISHTAWHSNRTLYETCIEPWLS

SEQ ID NO: 7414 - protein, 95 aa, unidentified
MAAARLCLSLLLLSTCVALLLQPLLGAQGAPLEPVYPGDNATPEQMAQYAADLRRYINMLTRPRYGKRHKEDTLAFSEWGSPHAAVPRELSPLDL

SEQ ID NO: 7415 - protein, 188 aa, unidentified
MVPGAAGWCCLVLWLPACVAAHGFRIHDYLYFQVLSPGDIRYIFTATPAKDFGGIFHTRYEQIHLVPAEPPEACGELSNGFFIQDQIALVERGGCSFLSKTRVVQEHGGRAVIISDNAVDNDSFYVEMIQDSTQRTADIPALFLLGRDGYMIRRSLEQHGLPWAIISIPVNVTSIPTFELLQPPWTFW

SEQ ID NO: 7416 - protein, 151 aa, unidentified
MRRLLLVTSLVVVLLWEAGAVPAPKVPIKMQVKHWPSEQDPEKAWGARVVEPPEKDDQLVVLFPVQKPKLLTTEEKPRGQGRGPILPGTKAWMETEDTLGHVLSPEPDHDSLYHPPPEEDQGEERPRLWVMPNHQVLLGPEEDQDHIYHPQ

SEQ ID NO: 7417 - protein, 330 aa, unidentified
MLLILLSVALLALSSAQNLNEDVSQEESPSLIAGNPQGPSPQGGNKPQGPPPPPGKPQGPPPQGGNKPQGPPPPGKPQGPPPQGDKSRSPRSPPGKPQGPPPQGGNQPQGPPPPPGKPQGPPPQGGNRPQGPPPPGKPQGPPPQGDKSRSPSPPGKPQGPPPQGGNQPQGPPPPPGKPQGPPPQGGKKPQGPPPPGKPQGPPPQGDKSRSSQSPPGKPQGPPPQGGNQPQGPPPPPGKPQGPPPQGGNKPQGPPPPGKPQGPPAQGGSKSQSARSPPGKPQGPPQQEGNNPQGPPPPAGGNPQQPQAPPAGQPQGPPRPPQGGRPSRPPQ

SEQ ID NO: 7418 - protein, 309 aa, unidentified
MLLILLSVALLALSSAQSLNEDVSQEESPSVISGKPEGRRPQGGNQPQRTPPPPGKPEGRPPQGGNQSQGPPPRPGKPEGPPPQGGNQSQGPPPRPGKPEGQPPQGGNQSQGPPPRPGKPEGPPPQGGNQSQGPPPRPGKPEGPPPQGGNQSQGPPPHPGKPEGPPPQGGNQSQGPPPRPGKPEGPPPQGGNQSQGPPPRPGKPEGPPPQGGNQSQGPPPRPGKPEGSPSQGGNKPQGPPPHPGKPQGPPPQEGNKPQRPPPPGRPQGPPPPGGNPQQPLPPPAGKPQGPPPPPQGGRPHRPPQGQPPQ

SEQ ID NO: 7419 - protein, 247 aa, unidentified
MLLILLSVALLALSSAESSSEDVSQEESLFLISGKPEGRRPQGGNQPQRPPPPPGKPQGPPPQGGNQSQGPPPPPGKPEGRPPQGGNQSQGPPPHPGKPERPPPQGGNQSQGTPPPPGKPERPPPQGGNQSHRPPPPPGKPERPPPQGGNQSQGPPPHPGKPEGPPPQEGNKSRSARSPPGKPQGPPQQEGNKPQGPPPPGKPQGPPPAGGNPQQPQAPPAGKPQGPPPPPQGGRPPRPAQGQQPPQ

SEQ ID NO: 7420 - protein, 54 aa, unidentified
MCTTLFLLSTLAMLWRRRFANRVQPEPSDVDGAARGSSLDADPQSSGREKEPLK

SEQ ID NO: 7421 - protein, 496 aa, unidentified
MGRRALLLLLLSFLAPWATIALRPALRALGSLHLPTNPTSLPAVAKNYSVLYFQQKVDHFGFNTVKTFNQRYLVADKYWKKNGGSILFYTGNEGDIIWFCNNTGFMWDVAEELKAMLVFAEHRYYGESLPFGDNSFKDSRHLNFLTSEQALADFAELIKHLKRTIPGAENQPVIAIGGSYGGMLAAWFRMKYPHMVVGALAASAPIWQFEDLVPCGVFMKIVTTDFRKSGPHCSESIHRSWDAINRLSNTGSGLQWLTGALHLCSPLTSQDIQHLKDWISETWVNLAMVDYPYASNFLQPLPAWPIKVVCQYLKNPNVSDSLLLQNIFQALNVYYNYSGQVKCLNISETATSSLGTLGWSYQACTEVVMPFCTNGVDDMFEPHSWNLKELSDDCFQQWGVRPRPSWITTMYGGKNISSHTNIVFSNGELDPWSGGGVTKDITDTLVAVTISEGAHHLDLRTKNALDPMSVLLARSLEVRHMKNWIRDFYDSAGKQH

SEQ ID NO: 7422 - protein, 367 aa, unidentified
MMGSVLPAEALVLKTGLKAPGLALAEVITSDILHSFLYGRWRNVLGEQLFEDKSHHASPKTAFTAEVLAQSFSGEVQKLSSLVLPAEVIIAQSSIPGEGLGIFSKTWIKAGTEMGPFTGRVIAPEHVDICKNNNLMWEVFNEDGTVRYFIDASQEDHRSWMTYIKCARNEQEQNLEVVQIGTSIFYKAIEMIPPDQELLVWYGNSHNTFLGIPGVPGLEEDQKKNKHEDFHPADSAAGPAGRMRCVICHRGFNSRSNLRSHMRIHTLDKPFVCRFCNRRFSQSSTLRNHVRLHTGERPYKCQVCQSAYSQLAGLRAHQKSARHRPPSTALQAHSPALPAPHAHAPALAAAAAAAAAAAAHHLPAMVL

SEQ ID NO: 7423 - protein, 271 aa, unidentified
MEALPLLAATTPDHGRHRRLLLLPLLLFLLPAGAVQGWETEERPRTREEECHFYAGGQVYPGEASRVSVADHSLHLSKAKISKPAPYWEGTAVIDGEFKELKLTDYRGKYLVFFFYPLDFTFVCPTEIIAFGDRLEEFRSINTEVVACSVDSQFTHLAWINTPRRQGGLGPIRIPLLSDLTHQISKDYGVYLEDSGHTLRGLFIIDDKGILRQITLNDLPVGRSVDETLRLVQAFQYTDKHGEVCPAGWKPGSETIIPDPAGKLKYFDKLN

SEQ ID NO: 7424 - protein, 382 aa, unidentified
MRSPLCWLLPLLILASVAQGQPTRRPRPGTGPGRRPRPRPRPTPSFPQPDEPAEPTDLPPPLPPGPPSIFPDCPRECYCPPDFPSALYCDSRNLRKVPVIPPRIHYLYLQNNFITELPVESFQNATGLRWINLDNNRIRKIDQRVLEKLPGLVFLYMEKNQLEEVPSALPRNLEQLRLSQNHISRIPPGVFSKLENLLLLDLQHNRLSDGVFKPDTFHGLKNLMQLNLAHNILRKMPPRVPTAIHQLYLDSNKIETIPNGYFKSFPNLAFIRLNYNKLTDRGLPKNSFNISNLLVLHLSHNRISSVPAINNRLEHLYLNNNSIEKINGTQICPNDLVAFHDFSSDLENVPHLRYLRLDGNYLKPPIPLDLMMCFRLLQSVVI

SEQ ID NO: 7425 - protein, 555 aa, unidentified
MAARLLLLGILLLLLPLPVPAPCHTAARSECKRSHKFVPGAWLAGEGVDVTSLRRSGSFPVDTQRFLRPDGTCTLCENALQEGTLQRLPLALTNWRAQGSGCQRHVTRAKVSSTEAVARDAARSIRNDWKVGLDVTPKPTSNVHVSVAGSHSQAANFAAQKTHQDQYSFSTDTVECRFYSFHVVHTPPLHPDFKRALGDLPHHFNASTQPAYLRLISNYGTHFIRAVELGGRISALTALRTCELALEGLTDNEVEDCLTVEAQVNIGIHGSISAEAKACEEKKKKHKMTASFHQTYRERHSEVVGGHHTSINDLLFGIQAGPEQYSAWVNSLPGSPGLVDYTLEPLHVLLDSQDPRREALRRALSQYLTDRARWRDCSRPCPPGRQKSPRDPCQCVCHGSAVTTQDCCPRQRGLAQLEVTFIQAWGLWGDWFTATDAYVKLFFGGQELRTSTVWDNNNPIWSVRLDFGDVLLATGGPLRLQVWDQDSGRDDDLLGTCDQAPKSGSHEVRCNLNHGHLKFRYHARCLPHLGGGTCLDYVPQMLLGEPPGNRSGAVW

SEQ ID NO: 7426 - protein, 222 aa, unidentified
MKLPLLLALLFGAVSALHLRSETSTFETPLGAKTLPEDEETPEQEMEETPCRELEEEEEWGSGSEDASKKDGAVESISVPDMVDKNLTCPEEEDTVKVVGIPGCQTCRYLLVRSLQTFSQAWFTCRRCYRGNLVSIHNFNINYRIQCSVSALNQGQVWIGGRITGSGRCRRFQWVDGSRWNFAYWAAHQPWSRGGHCVALCTRGGHWRRAHCLRRLPFICSY

SEQ ID NO: 7427 - protein, 225 aa, unidentified
MQCLLLLPFLLLGTVSALHLENDAPHLESLETQADLGQDLDSSKEQERDLALTEEVIQAEGEEVKASACQDNFEDEEAMESDPAALDKDFQCPREEDIVEVQGSPRCKICRYLLVRTPKTFAEAQNVCSRCYGGNLVSIHDFNFNYRIQCCTSTVNQAQVWIGGNLRGWFLWKRFCWTDGSHWNFAYWSPGQPGNGQGSCVALCTKGGYWRRAQCDKQLPFVCSF

SEQ ID NO: 7428 - protein, 1404 aa, unidentified
MAWKTLPIYLLLLLSVFVIQQVSSQDLSSCAGRCGEGYSRDATCNCDYNCQHYMECCPDFKRVCTAELSCKGRCFESFERGRECDCDAQCKKYDKCCPDYESFCAEVHNPTSPPSSKKAPPPSGASQTIKSTTKRSPKPPNKKKTKKVIESEEITEEHSVSENQESSSSSSSSSSSSTIRKIKSSKNSAANRELQKKLKVKDNKKNRTKKKPTPKPPVVDEAGSGLDNGDFKVTTPDTSTTQHNKVSTSPKITTAKPINPRPSLPPNSDTSKETSLTVNKETTVETKETTTTNKQTSTDGKEKTTSAKETQSIEKTSAKDLAPTSKVLAKPTPKAETTTKGPALTTPKEPTPTTPKEPASTTPKEPTPTTIKSAPTTPKEPAPTTTKSAPTTPKEPAPTTTKEPAPTTPKEPAPTTTKEPAPTTTKSAPTTPKEPAPTTPKKPAPTTPKEPAPTTPKEPTPTTPKEPAPTTKEPAPTTPKEPAPTAPKKPAPTTPKEPAPTTPKEPAPTTTKEPSPTTPKEPAPTTTKSAPTTTKEPAPTTTKSAPTTPKEPSPTTTKEPAPTTPKEPAPTTPKKPAPTTPKEPAPTTPKEPAPTTTKKPAPTTPKEPAPTTPKETAPTTPKKLTPTTPEKLAPTTPEKPAPTTPEELAPTTPEEPTPTTPEEPAPTTPKAAAPNTPKEPAPTTPKEPAPTTPKEPAPTTPKETAPTTPKGTAPTTLKEPAPTTPKKPAPKELAPTTTKEPTSTTSDKPAPTTPKGTAPTTPKEPAPTTPKEPAPTTPKGTAPTTLKEPAPTTPKKPAPKELAPTTTKGPTSTTSDKPAPTTPKETAPTTPKEPAPTTPKKPAPTTPETPPPTTSEVSTPTTTKEPTTIHKSPDESTPELSAEPTPKALENSPKEPGVPTTKTPAATKPEMTTTAKDKTTERDLRTTPETTTAAPKMTKETATTTEKTTESKITATTTQVTSTTTQDTTPFKITTLKTTTLAPKVTTTKKTITTTEIMNKPEETAKPKDRATNSKATTPKPQKPTKAPKKPTSTKKPKTMPRVRKPKTTPTPRKMTSTMPELNPTSRIAEAMLQTTTRPNQTPNSKLVEVNPKSEDAGGAEGETPHMLLRPHVFMPEVTPDMDYLPRVPNQGIIINPMLSDETNICNGKPVDGLTTLRNGTLVAFRGHYFWMLSPFSPPSPARRITEVWGIPSPIDTVFTRCNCEGKTFFFKDSQYWRFTNDIKDAGYPKPIFKGFGGLTGQIVAALSTAKYKNWPESVYFFKRGGSIQQYIYKQEPVQKCPGRRPALNYPVYGETTQVRRRRFERAIGPSQTHTIRIQYSPARLAYQDKGVLHNEVKVSILWRGLPNVVTSAISLPNIRKPDGYDYYAFSKDQYYNIDVPSRTARAITTRSGQTLSKVWYNCP

SEQ ID NO: 7429 - protein, 166 aa, unidentified
MLLILLSVALLAFSSAQDLDEDVSQEDVPLVISDGGDSEQFIDEERQGPPLGGQQSQPSAGDGNQDDGPQQGPPQQGGQQQQGPPPPQGKPQGPPQQGGHPPPPQGRPQGPPQQGGHPRPPRGRPQGPPQQGGHQQGPPPPPPGKPQGPPPQGGRPQGPPQGQSPQ

SEQ ID NO: 7430 - protein, 331 aa, unidentified
METVISSDSSPAVENEHPQETPESNNSVYTSFMKSHRCYDLIPTSSKLVVFDTSLQVKKAFFALVTNGVRAAPLWDSKKQSFVGMLTITDFINILHRYYKSALVQIYELEEHKIETWREVYLQDSFKPLVCISPNASLFDAVSSLIRNKIHRLPVIDPESGNTLYILTHKRILKFLKLFITEFPKPEFMSKSLEELQIGTYANIAMVRTTTPVYVALGIFVQHRVSALPVVDEKGRVVDIYSKFDVINLAAEKTYNNLDVSVTKALQHRSHYFEGVLKCYLHETLETIINRLVEAEVHRLVVVDENDVVKGIVSLSDILQALVLTGGEKKP

SEQ ID NO: 7431 - protein, 528 aa, unidentified
MLLPLLLLLPMCWAVEVKRPRGVSLTNHHFYDESKPFTCLDGSATIPFDQVNDDYCDCKDGSDEPGTAACPNGSFHCTNTGYKPLYIPSNRVNDGVCDCCDGTDEYNSGVICENTCKEKGRKERESLQQMAEVTREGFRLKKILIEDWKKAREEKQKKLIELQAGKKSLEDQVEMLRTVKEEAEKPEREAKEQHQKLWEEQLAAAKAQQEQELAADAFKELDDDMDGTVSVTELQTHPELDTDGDGALSEAEAQALLSGDTQTDATSFYDRVWAAIRDKYRSEALPTDLPAPSAPDLTEPKEEQPPVPSSPTEEEEEEEEEEEEEAEEEEEEEDSEEAPPPLSPPQPASPAEEDKMPPYDEQTQAFIDAAQEARNKFEEAERSLKDMEESIRNLEQEISFDFGPNGEFAYLYSQCYELTTNEYVYRLCPFKLVSQKPKLGGSPTSLGTWGSWIGPDHDKFSAMKYEQGTGCWQGPNRSTTVRLLCGKETMVTSTTEPSRCEYLMELMTPAACPEPPPEAPTEDDHDEL

SEQ ID NO: 7432 - protein, 912 aa, unidentified
MSAPPVLRPPSPLLPVAAAAAAAAAALVPGSGPGPAPFLAPVAAPVGGISFHLQIGLSREPVLLLQDSSGDYSLAHVREMACSIVDQKFPECGFYGMYDKILLFRHDPTSENILQLVKAASDIQEGDLIEVVLSASATFEDFQIRPHALFVHSYRAPAFCDHCGEMLWGLVRQGLKCEGCGLNYHKRCAFKIPNNCSGVRRRRLSNVSLTGVSTIRTSSAELSTSAPDEPLLQKSPSESFIGREKRSNSQSYIGRPIHLDKILMSKVKVPHTFVIHSYTRPTVCQYCKKLLKGLFRQGLQCKDCRFNCHKRCAPKVPNNCLGEVTINGDLLSPGAESDVVMEEGSDDNDSERNSGLMDDMEEAMVQDAEMAMAECQNDSGEMQDPDPDHEDANRTISPSTSNNIPLMRVVQSVKHTKRKSSTVMKEGWMVHYTSKDTLRKRHYWRLDSKCITLFQNDTGSRYYKEIPLSEILSLEPVKTSALIPNGANPHCFEITTANVVYYVGENVVNPSSPSPNNSVLTSGVGADVARMWEIAIQHALMPVIPKGSSVGTGTNLHRDISVSISVSNCQIQENVDISTVYQIFPDEVLGSGQFGIVYGGKHRKTGRDVAIKIIDKLRFPTKQESQLRNEVAILQNLHHPGVVNLECMFETPERVFVVMEKLHGDMLEMILSSEKGRLPEHITKFLITQILVALRHLHFKNIVHCDLKPENVLLASADPFPQVKLCDFGFARIIGEKSFRRSVVGTPAYLAPEVLRNKGYNRSLDMWSVGVIIYVSLSGTFPFNEDEDIHDQIQNAAFMYPPNPWKEISHEAIDLINNLLQVKMRKRYSVDKTLSHPWLQDYQTWLDLRELECKIGERYITHESDDLRWEKYAGEQGLQYPTHLINPSASHSDTPETEETEMKALGERVSIL

SEQ ID NO: 7433 - protein, 227 aa, unidentified
MNIKGSPWKGSLLLLLVSNLLLCQSVAPLPICPGGAARCQVTLRDLFDRAVVLSHYIHNLSSEMFSEFDKRYTHGRGFITKAINSCHTSSLATPEDKEQAQQMNQKDFLSLIVSILRSWNEPLYHLVTEVRGMQEAPEAILSKAVEIEEQTKRLLEGMELIVSQVHPETKENEIYPVWSGLPSLQMADEESRLSAYYNLLHCLRRDSHKIDNYLKLLKCRIIHNNNC

SEQ ID NO: 7434 - protein, 87 aa, unidentified
MKVLRAWLLCLLMLGLALRGAASRTHRHSMEIRTPDINPAWYASRGIRPVGRFGRRRATLGDVPKPGLRPRLTCFPLEGGAMSSQDG

SEQ ID NO: 7435 - protein, 622 aa, unidentified; identical to SEQ ID NO: 3577

SEQ ID NO: 7436 - protein, 253 aa, unidentified; identical to SEQ ID NO: 3579

SEQ ID NO: 7437 - protein, 461 aa, unidentified
MWQLTSLLLFVATWGISGTPAPLDSVFSSSERAHQVLRIRKRANSFLEELRHSSLERECIEEICDFEEAKEIFQNVDDTLAFWSKHVDGDQCLVLPLEHPCASLCCGHGTCIDGIGSFSCDCRSGWEGRFCQREVSFLNCSLDNGGCTHYCLEEVGWRRCSCAPGYKLGDDLLQCHPAVKFPCGRPWKRMEKKRSHLKRDTEDQEDQVDPRLIDGKMTRRGDSPWQVVLLDSKKKLACGAVLIHPSWVLTAAHCMDESKKLLVRLGEYDLRRWEKWELDLDIKEVFVHPNYSKSTTDNDIALLHLAQPATLSQTIVPICLPDSGLAERELNQAGQETLVTGWGYHSSREKEAKRNRTFVLNFIKIPVVPHNECSEVMSNMVSENMLCAGILGDRQDACEGDSGGPMVASFHGTWFLVGLVSWGEGCGLLHNYGVYTKVSRYLDWIHGHIRDKEAPQKSWAP

SEQ ID NO: 7438 - protein, 105 aa, unidentified
MRGATRVSIMLLLVTVSDCAVITGACERDVQCGAGTCCAISLWLRGLRMCTPLGREGEECHPGSHKVPFFRKRKHHTCPCLPNLLCSRFPDGRYRCSMDLKNINF

SEQ ID NO: 7439 - protein, 129 aa, unidentified
MRSLCCAPLLLLLLLPPLLLTPRAGDAAVITGACDKDSQCGGGMCCAVSIWVKSIRICTPMGKLGDSCHPLTRKNNFGNGRQERRKRKRSKRKKEVPFFGRRMHHTCPCLPGLACLRTSFNRFICLAQK

SEQ ID NO: 7440 - protein, 865 aa, unidentified; identical to SEQ ID NO: 3583

SEQ ID NO: 7441 - protein, 676 aa, unidentified; identical to SEQ ID NO: 3585

SEQ ID NO: 7442 - protein, 400 aa, unidentified
MAGCVPLLQGLVLVLALHRVEPSVFLPASKANDVLVRWKRAGSYLLEELFEGNLEKECYEEICVYEEAREVFENEVVTDEFWRRYKGGSPCISQPCLHNGSCQDSIWGYTCTCSPGYEGSNCELAKNECHPERTDGCQHFCLPGQESYTCSCAQGYRLGEDHKQCVPHDQCACGVLTSEKRAPDLQDLPWQVKLTNSEGKDFCGGVIIRENFVLTTAKCSLLHRNITVKTYFNRTSQDPLMIKITHVHVHMRYDADAGENDLSLLELEWPIQCPGAGLPVCTPEKDFAEHLLIPRTRGLLSGWARNGTDLGNSLTTRPVTLVEGEECGQVLNVTVTTRTYCERSSVAAMHWMDGSVVTREHRGSWFLTGVLGSQPVGGQAHMVLVTKVSRYSLWFKQIMN

SEQ ID NO: 7443 - protein, 219 aa, unidentified
MKLLLWACIVCVAFARKRRFPFIGEDDNDDGHPLHPSLNIPYGIRNLPPPLYYRPVNTVPSYPGNTYTDTGLPSYPWILTSPGFPYVYHIRGFPLATQLNVPPLPPRGFPFVPPSRFFSAAAAPAAPPIAAEPAAAAPLTATPVAAEPAAGAPVAAEPAAEAPVGAEPAAEAPVAAEPAAEAPVGVEPAAEEPSPAEPATAKPAAPEPHPSPSLEQANQ

SEQ ID NO: 7444 - protein, 134 aa, unidentified
MLLVLLSVVLLALSSAQSTDNDVNYEDFTFTIPDVEDSSQRPDQGPQRPPPEGLLPRPPGDSGNQDDGPQQRPPKPGGHHRHPPPPPFQNQQRPPRRGHRQLSLPRFPSVSLQEASSFFQRDRPARHPQEQPLW

SEQ ID NO: 7445 - protein, 202 aa, unidentified; identical to SEQ ID NO: 3589

SEQ ID NO: 7446 - protein, 981 aa, unidentified; identical to SEQ ID NO: 3594

SEQ ID NO: 7447 - protein, 899 aa, unidentified; identical to SEQ ID NO: 3595

SEQ ID NO: 7448 - protein, 247 aa, unidentified
MNPLLILTFVAAALAAPFDDDDKIVGGYNCEENSVPYQVSLNSGYHFCGGSLINEQWVVSAGHCYKSRIQVRLGEHNIEVLEGNEQFINAAKIIRHPQYDRKTLNNDIMLIKLSSRAVINARVSTISLPTAPPATGTKCLISGWGNTASSGADYPDELQCLDAPVLSQAKCEASYPGKITSNMFCVGFLEGGKDSCQGDSGGPVVCNGQLQGVVSWGDGCAQKNKPGVYTKVYNYVKWIKNTIAANS

SEQ ID NO: 7449 - protein, 875 aa, unidentified
MTLARFVLALMLGALPEVVGFDSVLNDSLHHSHRHSPPAGPHYPYYLPTQQRPPRTRPPPPLPRFPRPPRALPAQRPHALQAGHTPRPHPWGCPAGEPWVSVTDFGAPCLRWAEVPPFLERSPPASWAQLRGQRHNFCRSPDGAGRPWCFYGDARGKVDWGYCDCRHGSVRLRGGKNEFEGTVEVYASGVWGTVCSSHWDDSDASVICHQLQLGGKGIAKQTPFSGLGLIPIYWSNVRCRGDEENILLCEKDIWQGGVCPQKMAAAVTCSFSHGPTFPIIRLAGGSSVHEGRVELYHAGQWGTVCDDQWDDADAEVICRQLGLSGIAKAWHQAYFGEGSGPVMLDEVRCTGNELSIEQCPKSSWGEHNCGHKEDAGVSCTPLTDGVIRLAGGKGSHEGRLEVYYRGQWGTVCDDGWTELNTYVVCRQLGFKYGKQASANHFEESTGPIWLDDVSCSGKETRFLQCSRRQWGRHDCSHREDVSIACYPGGEGHRLSLGFPVRLMDGENKKEGRVEVFINGQWGTICDDGWTDKDAAVICRQLGYKGPARARTMAYFGEGKGPIHVDNVKCTGNERSLADCIKQDIGRHNCRHSEDAGVICDYFGKKASGNSNKESLSSVCGLRLLHRRQKRIIGGKNSLRGGWPWQVSLRLKSSHGDGRLLCGATLLSSCWVLTAAHCFKRYGNSTRSYAVRVGDYHTLVPEEFEEEIGVQQIVIHREYRPDRSDYDIALVRLQGPEEQCARFSSHVLPACLPLWRERPQKTASNCYITGWGDTGRAYSRTLQQAAIPLLPKRFCEERYKGRFTGRMLCAGNLHEHKRVDSCQGDSGGPLMCERPGESWVVYGVTSWGYGCGVKDSPGVYTKVSAFVPWIKSVTKL

SEQ ID NO: 7450 - protein, 514 aa, unidentified
MAVWLAQWLGPLLLVSLWGLLAPASLLRRLGEHIQQFQESSAQGLGLSLGPGAAALPKVGWLEQLLDPFNVSDRRSFLQRYWVNDQHWVGQDGPIFLHLGGEGSLGPGSVMRGHPAALAPAWGALVISLEHRFYGLSIPAGGLEMAQLRFLSSRLALADVVSARLALSRLFNISSSSPWICFGGSYAGSLAAWARLKFPHLIFASVASSAPVRAVLDFSEYNDVVSRSLMSTAIGGSLECRAAVSVAFAEVERRLRSGGAAQAALRTELSACGPLGRAENQAELLGALQALVGGVVQYDGQTGAPLSVRQLCGLLLGGGGNRSHSTPYCGLRRAVQIVLHSLGQKCLSFSRAETVAQLRSTEPQLSGVGDRQWLYQTCTEFGFYVTCENPRCPFSQLPALPSQLDLCEQVFGLSALSVAQAVAQTNSYYGGQTPGANKVLFVNGDTDPWHVLSVTQALGSSESTLLIRTGSHCLDMAPERPSDSPSLRLGRQNIFQQLQTWLKLAKESQIKGEV

SEQ ID NO: 7451 - protein, 314 aa, unidentified
MGARGALLLALLLARAGLRKPESQEAAPLSGPCGRRVITSRIVGGEDAELGRWPWQGSLRLWDSHVCGVSLLSHRWALTAAHCFETYSDLSDPSGWMVQFGQLTSMPSFWSLQAYYTRYFVSNIYLSPRYLGNSPYDIALVKLSAPVTYTKHIQPICLQASTFEFENRTDCWVTGWGYIKEDEALPSPHTLQEVQVAIINNSMCNHLFLKYSFRKDIFGDMVCAGNAQGGKDACFGDSGGPLACNKNGLWYQIGVVSWGVGCGRPNRPGVYTNISHHFEWIQKLMAQSGMSQPDPSWPLLFFPLLWALPLLGPV

SEQ ID NO: 7452 - protein, 317 aa, unidentified
MVVSGAPPALGGGCLGTFTSLLLLASTAILNAARIPVPPACGKPQQLNRVVGGEDSTDSEWPWIVSIQKNGTHHCAGSLLTSRWVITAAHCFKDNLNKPYLFSVLLGAWQLGNPGSRSQKVGVAWVEPHPVYSWKEGACADIALVRLERSIQFSERVLPICLPDASIHLPPNTHCWISGWGSIQDGVPLPHPQTLQKLKVPIIDSEVCSHLYWRGAGQGPITEDMLCAGYLEGERDACLGDSGGPLMCQVDGAWLLAGIISWGEGCAERNRPGVYISLSAHRSWVEKIVQGVQLRGRAQGGGALRAPSQGSGAAARS

SEQ ID NO: 7453 - protein, 383 aa, unidentified
MAGIPGLLFLLFFLLCAVGQVSPYSAPWKPTWPAYRLPVVLPQSTLNLAKPDFGAEAKLEVSSSCGPQCHKGTPLPTYEEAKQYLSYETLYANGSRTETQVGIYILSSSGDGAQHRDSGSSGKSRRKRQIYGYDSRFSIFGKDFLLNYPFSTSVKLSTGCTGTLVAEKHVLTAAHCIHDGKTYVKGTQKLRVGFLKPKFKDGGRGANDSTSAMPEQMKFQWIRVKRTHVPKGWIKGNANDIGMDYDYALLELKKPHKRKFMKIGVSPPAKQLPGGRIHFSGYDNDRPGNLVYRFCDVKDETYDLLYQQCDAQPGASGSGVYVRMWKRQQQKWERKIIGIFSGHQWVDMNGSPQDFNVAVRITPLKYAQICYWIKGNYLDCREG

SEQ ID NO: 7454 - protein, 290 aa, unidentified
MRRPAAVPLLLLLCFGSQRAKAATACGRPRMLNRMVGGQDTQEGEWPWQVSIQRNGSHFCGGSLIAEQWVLTAAHCFRNTSETSLYQVLLGARQLVQPGPHAMYARVRQVESNPLYQGTASSADVALVELEAPVPFTNYILPVCLPDPSVIFETGMNCWVTGWGSPSEEDLLPEPRILQKLAVPIIDTPKCNLLYSKDTEFGYQPKTIKNDMLCAGFEEGKKDACKGDSGGPLVCLVGQSWLQAGVISWGEGCARQNRPGVYIRVTAHHNWIHRIIPKLQFQPARLGGQK

SEQ ID NO: 7455 - protein, 304 aa, unidentified
MCGPDDRCPARWPGPGRAVKCGKGLAAARPGRVERGGAQRGGAGLELHPLLGGRTWRAARDADGCEALGTVAVPFDDDDKIVGGYTCEENSLPYQVSLNSGSHFCGGSLISEQWVVSAAHCYKTRIQVRLGEHNIKVLEGNEQFINAAKIIRHPKYNRDTLDNDIMLIKLSSPAVINARVSTISLPTTPPAAGTECLISGWGNTLSFGADYPDELKCLDAPVLTQAECKASYPGKITNSMFCVGFLEGGKDSCQRDSGGPVVCNGQLQGVVSWGHGCAWKNRPGVYTKVYNYVDWIKDTIAANS

SEQ ID NO: 7456 - protein, 280 aa, unidentified
MRGVSCLQVLLLLVLGAAGTQGRKSAACGQPRMSSRIVGGRDGRDGEWPWQASIQHRGAHVCGGSLIAPQWVLTAAHCFPRRALPAEYRVRLGALRLGSTSPRTLSVPVRRVLLPPDYSEDGARGDLALLQLRRPVPLSARVQPVCLPVPGARPPPGTPCRVTGWGSLRPGVPLPEWRPLQGVRVPLLDSRTCDGLYHVGADVPQAERIVLPGSLCAGYPQGHKDACQGDSGGPLTCLQSGSWVLVGVVSWGKGCALPNRPGVYTSVATYSPWIQARVSF

SEQ ID NO: 7457 - protein, 413 aa, unidentified
MENMLLWLIFFTPGWTLIDGSEMEWDFMWHLRKVPRIVSERTFHLTSPAFEADAKMMVNTVCGIECQKELPTPSLSELEDYLSYETVFENGTRTLTRVKVQDLVLEPTQNITTKGVSVRRKRQVYGTDSRFSILDKRFLTNFPFSTAVKLSTGCSGILISPQHVLTAAHCVHDGKDYVKGSKKLRVGLLKMRNKSGGKKRRGSKRSRREASGGDQREGTREHLRERAKGGRRRKKSGRGQRIAEGRPSFQWTRVKNTHIPKGWARGGMGDATLDYDYALLELKRAHKKKYMELGISPTIKKMPGGMIHFSGFDNDRADQLVYRFCSVSDESNDLLYQYCDAESGSTGSGVYLRLKDPDKKNWKRKIIAVYSGHQWVDVHGVQKDYNVAVRITPLKYAQICLWIHGNDANCAYG

SEQ ID NO: 7458 - protein, 855 aa, unidentified
MARHLLLPLVMLVISPIPGAFQDSALSPTQEEPEDLDCGRPEPSARIVGGSNAQPGTWPWQVSLHHGGGHICGGSLIAPSWVLSAAHCFMTNGTLEPAAEWSVLLGVHSQDGPLDGAHTRAVAAIVVPANYSQVELGADLALLRLASPASLGPAVWPVCLPRASHRFVHGTACWATGWGDVQEADPLPLPWVLQEVELRLLGEATCQCLYSQPGPFNLTLQILPGMLCAGYPEGRRDTCQGDSGGPLVCEEGGRWFQAGITSFGFGCGRRNRPGVFTAVATYEAWIREQVMGSEPGPAFPTQPQKTQSDPQEPREENCTIALPECGKAPRPGAWPWEAQVMVPGSRPCHGALVSESWVLAPASCFLDPNSSDSPPRDLDAWRVLLPSRPRAERVARLVQHENASWDNASDLALLQLRTPVNLSAASRPVCLPHPEHYFLPGSRCRLARWGRGEPALGPGALLEAELLGGWWCHCLYGRQGAAVPLPGDPPHALCPAYQEKEEVGSCWNDSRWSLLCQEEGTWFLAGIRDFPSGCLRPRAFFPLQTHGPWISHVTRGAYLEDQLAWDWGPDGEETETQTCPPHTEHGACGLRLEAAPVGVLWPWLAEVHVAGDRVCTGILLAPGWVLAATHCVLRPGSTTVPYIEVYLGRAGASSLPQGHQVSRLVISIRLPQHLGLRPPLALLELSSRVEPSPSALPICLHPAGIPPGASCWVLGWKEPQDRVPVAAAVSILTQRICDCLYQGILPPGTLCVLYAEGQENRCEMTSAPPLLCQMTEGSWILVGMAVQGSRELFAAIGPEEAWISQTVGEANFLPPSGSPHWPTGGSNLCPPELAKASGSPHAVYFLLLLTLLIQS

SEQ ID NO: 7459 - protein, 235 aa, unidentified
MKYVFYLGVLAGTFFFADSSVQKEDPAPYLVYLKSHFNPCVGVLIKPSWVLAPAHCYLPNLKVMLGNFKSRVRDGTEQTINPIQIVRYWNYSHSAPQDDLMLIKLAKPAMLNPKVQPLTLATTNVRPGTVCLLSGLDWSQENSGRHPDLRQNLEAPVMSDRECQKTEQGKSHRNSLCVKFVKVFSRIFGEVAVATVICKDKLQGIEVGHFMGGDVGIYTNVYKYVSWIENTAKDK

SEQ ID NO: 7460 - protein, 326 aa, unidentified
MAAPASVMGPLGPSALGLLLLLLVVAPPRVAALVHRQPENQGISLTGSVACGRPSMEGKILGGVPAPERKWPWQVSVHYAGLHVCGGSILNEYWVLSAAHCFHRDKNIKIYDMYVGLVNLRVAGNHTQWYEVNRVILHPTYEMYHPIGGDVALVQLKTRIVFSESVLPVCLATPEVNLTSANCWATGWGLVSKQGETSDELQEMQLPLILEPWCHLLYGHMSYIMPDMLCAGDILNAKTVCEGDSGGPLVCEFNRSWLQIGIVSWGRGCSNPLYPGVYASVSYFSKWICDNIEITPTPAQPAPALSPALGPTLSVLMAMLAGWSVL

SEQ ID NO: 7461 - protein, 293 aa, unidentified
MSSGGGSRGLLAWLLLLQPWPGQNWAGMAAPRLPSPLLSEEGGENPEASPAPGPEAGPPLNLFTSFPGDSLLCGRTPLRIVGGVDAEEGRWPWQVSVRTKGRHICGGTLVTATWVLTAGHCISSRFHYSVKMGDRSVYNENTSVVVSVQRAFVHPKFSTVTTIRNDLALLQLQHPVNFTSNIQPICIPQENFQVEGRTRCWVTGWGKTPEREKLASEILQDVDQYIMCYEECNKIIQKALSSTKDVIIKGMVCGYKEQGKDSCQGDSGGRLACEYNDTWVQVGIVSWGIGCGR

SEQ ID NO: 7462 - protein, 328 aa, unidentified; identical to SEQ ID NO: 3596

SEQ ID NO: 7463 - protein, 385 aa, unidentified
MGRWCQTVARGQRPRTSAPSRAGALLLLLLLLRSAGCWGAGEAPGALSTADPADQSVQCVPKATCPSSRPRLLWQTPTTQTLPSTTMETQFPVSEGKVDPYRSCGFSYEQDPTLRDPEAVARRWPWMVSVRANGTHICAGTIIASQWVLTVAHCLIWRDVIYSVRVGSPWIDQMTQTASDVPVLQVIMHSRYRAQRFWSWVGQANDIGLLKLKQELKYSNYVRPICLPGTDYVLKDHSRCTVTGWGLSKADGMWPQFRTIQEKEVIILNNKECDNFYHNFTKIPTLVQIIKSQMMCAEDTHREKFCYELTGEPLVCSMEGTWYLVGLVSWGAGCQKSEAPPIYLQVSSYQHWIWDCLNGQALALPAPSRTLLLALPLPLSLLAAL

SEQ ID NO: 7464 - protein, 553 aa, unidentified
MKWCWGPVLLIAGATVLMEGLQAAQRACGQRGPGPPKPQEGNTVPGEWPWQASVRRQGAHICSGSLVADTWVLTAAHCFEKAAATELNSWSVVLGSLQREGLSPGAEEVGVAALQLPRAYNHYSQGSDLALLQLAHPTTHTPLCLPQPAHRFPFGASCWATGWDQDTSDAPGTLRNLRLRLISRPTCNCIYNQLHQRHLSNPARPGMLCGGPQPGVQGPCQGDSGGPVLCLEPDGHWVQAGIISFASSCAQEDAPVLLTNTAAHSSWLQARVQGAAFLAQSPETPEMSDEDSCVACGSLRTAGPQAGAPSPWPWEARLMHQGQLACGGALVSEEAVLTAAHCFIGRQAPEEWSVGLGTRPEEWGLKQLILHGAYTHPEGGYDMALLLLAQPVTLGASLRPLCLPYPDHHLPDGERGWVLGRARPGAGISSLQTVPVTLLGPRACSRLHAAPGGDGSPILPGMVCTSAVGELPSCEGLSGAPLVHEVRGTWFLAGLHSFGDACQGPARPAVFTALPAYEDWVSSLDWQVYFAEEPEPEAEPGSCLANISQPTSC

SEQ ID NO: 7465 - protein, 395 aa, unidentified
MVSAAGLSGDGKMRGVLLVLLGLLYSSTSCGVQKASVFYGPDPKEGLVSSMEFPWVVSLQDSQYTHLAFGCILSEFWVLSIASAIQNRKDIVVIVGISNMDPSKIAHTEYPVNTIIIHEDFDNNSMSNNIALLKTDTAMHFGNLVQSICFLGRMLHTPPVLQNCWVSGWNPTSATGNHMTMSVLRKIFVKDLDMCPLYKLQKTECGSHTKEETKTACLGDPGSPMMCQLQQFDLWVLRGVLNFGGETCPGLFLYTKVEDYSKWITSKAERAGPPLSSLHHWEKLISFSHHGPNATMTQKTYSDSELGHVGSYLQGQRRTITHSRLGNSSRDSLDVREKDVKESGRSPEASVQPLYYDYYGGEVGEGRIFAGQNRLYQPEEIILVSFVLVFFCSSI

SEQ ID NO: 7466 - protein, 352 aa, unidentified
MLLFSVLLLLSLVTGTQLGPRTPLPEAGVAILGRARGAHRPQPPHPPSPVSECGDRSIFEGRTRYSRITGGMEAEVGEFPWQVSIQARSEPFCGGSILNKWWILTAAHCLYSEELFPEELSVVLGTNDLTSPSMEIKEVASIILHKDFKRANMDNDIALLLLASPIKLDDLKVPICLPTQPGPATWRECWVAGWGQTNAADKNSVKTDLMKAPMVIMDWEECSKMFPKLTKNMLCAGYKNESYDACKGDSGGPLVCTPEPGEKWYQVGIISWGKSCGEKNTPGIYTSLVNYNLWIEKVTQLEGRPFNAEKRRTSVKQKPMGSPVSGVPEPGSPRSWLLLCPLSHVLFRAILY

SEQ ID NO: 7467 - protein, 283 aa, unidentified
MGLGLRGWGRPLLTVATALMLPVKPPAGSWGAQIIGGHEVTPHSRPYMASVRFGGQHHCGGFLLRARWVVSAAHCFSHRDLRTGLVVLGAHVLSTAEPTQQVFGIDALTTHPDYHPMTHANDICLLRLNGSAVLGPAVGLLRPPGRRARPPTAGTRCRVAGWGFVSDFEELPPGLMEAKVRVLDPDVCNSSWKGHLTLTMLCTRSGDSHRRGFCSADSGGPLVCRNRAHGLVSFSGLWCGDPKTPDVYTQVSAFVAWIWDVVRRSSPQPGPLPGTTRPPGEAA

SEQ ID NO: 7468 - protein, 241 aa, unidentified
MKFILLWALLNLTVALAFNPDYTVSSTPPYLVYLKSDYLPCAGVLIHPLWVITAAHCNLPKLRVILGVTIPADSNEKHLQVIGYEKMIHHPHFSVTSIDHDIMLIKLKTEAELNDYVKLANLPYQTISENTMCSVSTWSYNVCDIYKEPDSLQTVNISVISKPQCRDAYKTYNITENMLCVGIVPGRRQPCKEVSAAPAICNGMLQGILSFADGCVLRADVGIYAKIFYYIPWIENVIQNN

SEQ ID NO: 7469 - protein, 343 aa, unidentified; identical to SEQ ID NO: 3597

SEQ ID NO: 7470 - protein, 1150 aa, unidentified; identical to SEQ ID NO: 3598

SEQ ID NO: 7471 - protein, 256 aa, unidentified
MAHRPPSPALASVLLALLLSGAARAAEIVGGHEAQPHSRPYMASLQMRGNPGSHFCGGTLIHPSFVLTAAHCLRDIPQRLVNVVLGAHNVRTQEPTQQHFSVAQVFLNNYDAENKLNDVLLIQLSSPANLSASVATVQLPQQDQPVPHGTQCLAMGWGRVGAHDPPAQVLQELNVTVVTFFCRPHNICTFVPRRKAGICFGDSGGPLICDGIIQGIDSFVIWGCATRLFPDFFTRVALYVDWIRSTLRRVEAKGRP

SEQ ID NO: 7472 - protein, 524 aa, unidentified
MYALFLLASLLGAALAGPVLGLKECTRGSAVWCQNVKTASDCGAVKHCLQTVWNKPTVKSLPCDICKDVVTAAGDMLKDNATEEEILVYLEKTCDWLPKPNMSASCKEIVDSYLPVILDIIKGEMSRPGEVCSALNLCESLQKHLAELNHQKQLESNKIPELDMTEVVAPFMANIPLLLYPQDGPRSKPQPKDNGDVCQDCIQMVTDIQTAVRTNSTFVQALVEHVKEECDRLGPGMADICKNYISQYSEIAIQMMMHMQPKEICALVGFCDEVKEMPMQTLVPAKVASKNVIPALELVEPIKKHEVPAKSDVYCEVCEFLVKEVTKLIDNNKTEKEILDAFDKMCSKLPKSLSEECQEVVDTYGSSILSILLEEVSPELVCSMLHLCSGTRLPALTVHVTQPKDGGFCEVCKKLVGYLDRNLEKNSTKQEILAALEKGCSFLPDPYQKQCDQFVAEYEPVLIEILVEVMDPSFVCLKIGACPSAHKPLLGTEKCIWGPSYWCQNTETAAQCNAVEHCKRHVWN

SEQ ID NO: 7473 - protein, 521 aa, unidentified
MLCALLLLPSLLGATRASPTSGPQECAKGSTVWCQDLQTAARCGAVGYCQGAVWNKPTAKSLPCDVCQDIAAAAGNGLNPDATESDILALVMKTCEWLPSQESSAGCKWMVDAHSSAILSMLRGAPDSAPAQVCTALSLCEPLQRHLATLRPLSKEDTFEAVAPFMANGPLTFHPRQAPEGALCQDCVRQVSRLQEAVRSNLTLADLNIQEQCESLGPGLAVLCKNYLFQFFVPADQALRLLPPQELCRKGGFCEELGAPARLTQVVAMDGVPSLELGLPRKQSEMQMKAGVTCEVCMNVVQKLDHWLMSNSSELMITHALERVCSVMPASITKECIILVDTYSPSLVQLVAKITPEKVCKFIRLCGNRRRARAVHDAYAIVPSPEWDAENQGSFCNGCKRLLTVSSHNLESKSTKRDILVAFKGGCSILPLPYMIQCKHFVTQYEPVLIESLKDMMDPVAVCKKVGACHGPRTPLLGTDQCALGPSFWCRSQEAAKLCNAVQHCQKHVWKEMHLHAGEHA

SEQ ID NO: 7474 - protein, 419 aa, unidentified
MGTLSAPPCTQRIKWKGLLLTASLLNFWNLPTTAQVTIEAEPTKVSEGKDVLLLVHNLPQNLTGYIWYKGQMRDLYHYITSYVVDGEIIIYGPAYSGRETAYSNASLLIQNVTREDAGSYTLHIIKGDDGTRGVTGRFTFTLHLETPKPSISSSNLNPRETMEAVSLTCDPETPDASYLWWMNGQSLPMTHSLKLSETNRTLFLLGVTKYTAGPYECEIRNPVSASRSDPVTLNLLPKLPKPYITINNLNPRENKDVLNFTCEPKSENYTYIWWLNGQSLPVSPRVKRPIENRILILPSVTRNETGPYQCEIRDRYGGIRSDPVTLNVLYGPDLPRIYPSFTYYRSGEVLYLSCSADSNPPAQYSWTINEKFQLPGQKLFIRHITTKHSGLYVCSVRNSATGKESSKSMTVEVSDWTVP

SEQ ID NO: 7475 - protein, 335 aa, unidentified
MGPLSAPPCTEHIKWKGLLLTALLLNFWNLPTTAQVMIEAQPPKVSEGKDVLLLVHNLPQNLTGYIWYKGQIRDLYHYITSYVVDGQIIIYGPAYSGRETVYSNASLLIQNVTREDAGSYTLHIIKRGDGTRGVTGYFTFTLYLETPKPSISSSNLNPREAMETVILTCNPETPDASYLWWMNGQSLPMTHRMQLSETNRTLFLFGVTKYTAGPYECEIWNSGSASRSDPVTLNLLHGPDLPRIFPSVTSYYSGENLDLSCFANSNPPAQYSWTINGKFQLSGQKLFIPQITPKHNGLYACSARNSATGEESSTSLTIRVIAPPGLGTFAFNNPT

SEQ ID NO: 7476 - protein, 335 aa, unidentified
MGPLSAPPCTEHIKWKGLLVTASLLNFWNLPTTAQVTIEAQPPKVSEGKDVLLLVHNLPQNLTGYIWYKGQIRDLYHYITSYVVDGQIIIYGPAYSGRETAYSNASLLIQNVTREDAGSYTLHIIKRGDGTRGVTGYFTFTLYLETPKPSISSSNLNPREAMETVILTCDPETPDTSYQWWMNGQSLPMTHRFQLSETNRTLFLFGVTKYTAGPYECEIRNSGSASRSDPVTLNLLHGPDLPRIHPSYTNYRSGDNLYLSCFANSNPPAQYSWTINGKFQQSGQNLFIPQITTKHSGLYVCSVRNSATGEESSTSLTVKVSASTRIGLLPLLNPT

SEQ ID NO: 7477 - protein, 428 aa, unidentified
MGPLSAPPCTQRITWKGLLLTALLLNFWNLPTTAQVTIEAEPTKVSKGKDVLLLVHNLPQNLAGYIWYKGQMKDLYHYITSYVVDGQIIIYGPAYSGRETVYSNASLLIQNVTREDAGSYTLHIVKRGDGTRGETGHFTFTLYLETPKPSISSSNLYPREDMEAVSLTCDPETPDASYLWWMNGQSLPMTHSLQLSKNKRTLFLFGVTKYTAGPYECEIRNPVSASRSDPVTLNLLPKLPKPYITINNLNPRENKDVLAFTCEPKSENYTYIWWLNGQSLPVSPRVKRPIENRILILPSVTRNETGPYQCEIQDRYGGIRSYPVTLNVLYGPDLPRIYPSFTYYHSGENLYLSCFADSNPPAEYSWTINGKFQLSGQKLFIPQITTKHSGLYACSVRNSATGMESSKSMTVKVSAPSGTGHLPGLNPL

SEQ ID NO: 7478 - protein, 419 aa, unidentified
MGPLSAPPCTQRITWKGVLLTASLLNFWNPPTTAQVTIEAQPPKVSEGKDVLLLVHNLPQNLAGYIWYKGQMTYLYHYITSYVVDGQRIIYGPAYSGRERVYSNASLLIQNVTQEDAGSYTLHIIKRRDGTGGVTGHFTFTLHLETPKPSISSSNLNPREAMEAVILTCDPATPAASYQWWMNGQSLPMTHRLQLSKTNRTLFIFGVTKYIAGPYECEIRNPVSASRSDPVTLNLLPKLSKPYITINNLNPRENKDVLTFTCEPKSKNYTYIWWLNGQSLPVSPRVKRPIENRILILPNVTRNETGPYQCEIRDRYGGIRSDPVTLNVLYGPDLPSIYPSFTYYRSGENLYLSCFAESNPRAQYSWTINGKFQLSGQKLSIPQITTKHSGLYACSVRNSATGKESSKSITVKVSDWILP

SEQ ID NO: 7479 - protein, 335 aa, unidentified
MGPLSAPPCTQHITWKGLLLTASLLNFWNLPITAQVTIEALPPKVSEGKDVLLLVHNLPQNLAGYIWYKGQLMDLYHYITSYVVDGQINIYGPAYTGRETVYSNASLLIQNVTREDAGSYTLHIIKRGDRTRGVTGYFTFNLYLKLPKPYITINNSKPRENKDVLAFTCEPKSENYTYIWWLNGQSLPVSPRVKRPIENRILILPSVTRNETGPYECEIRDRDGGMRSDPVTLNVLYGPDLPSIYPSFTYYRSGENLYLSCFAESNPPAEYFWTINGKFQQSGQKLSIPQITTKHRGLYTCSVRNSATGKESSKSMTVEVSAPSGIGRLPLLNPI

SEQ ID NO: 7480 - protein, 435 aa, unidentified
MGPLSAPPCTQHITWKGLLLTASLLNFWNLPTTAQVIIEAKPPKVSEGKDVLLLVHNLPQNLTGYIWYKGQMTDLYHYITSYVVHGQIIYGPAYSGRETVYSNASLLIQNVTQEDAGSYTLHIIKRGDGTGGVTGYFTVTLYSETPKPSISSSNLNPREVMEAVRLICDPETPDASYLWLLNGQNLPMTHRLQLSKTNRTLYLFGVTKYIAGPYECEIRNPVSASRSDPVTLNLLPKLPMPYITINNLNPREKKDVLAFTCEPKSRNYTYIWWLNGQSLPVSPRVKRPIENRILILPSVTRNETGPYQCEIRDRYGGIRSNPVTLNVLYGPDLPRIYPSFTYYRSGENLDLSCFADSNPPAEYSWTINGKFQLSGQKLFIPQITTNHSGLYACSVRNSATGKEISKSMIVKVSETASPQVTYAGPNTWFQEILLL

SEQ ID NO: 7481 - protein, 426 aa, unidentified
MGLLSAPPCTQRITWKGLLLTASLLNFWNPPTTAQVTIEAQPTKVSEGKDVLLLVHNLPQNLTGYIWYKGQIRDLYHYITSYVVDGQIIIYGPAYSGRETIYSNASLLIQNVTQEDAGSYTLHIIMGGDENRGVTGHFTFTLYLETPKPSISSSKLNPREAMEAVSLTCDPETPDASYLWWMNGQSLPMSHRLQLSETNRTLFLLGVTKYTAGPYECEIRNPVSASRSDPFTLNLLPKLPKPYITINNLKPRENKDVLNFTCEPKSENYTYIWWLNGQSLPVSPRVKRPIENRILILPSVTRNETGPYQCEIRDQYGGIRSYPVTLNVLYGPDLPRIYPSFTYYRSGEVLYLSCSADSNPPAQYSWTINGKFQLSGQKLFIPQITTKHSGLYACSVRNSATGKESSKSMTVKVSGKRIPVSLAIGI

SEQ ID NO: 7482 - protein, 426 aa, unidentified; identical to SEQ ID NO: 3603

SEQ ID NO: 7483 - protein, 953 aa, unidentified; identical to SEQ ID NO: 3606

SEQ ID NO: 7484 - protein, 136 aa, unidentified
MILNWKLLGILVLCLHTRGISGSEGHPSHPPAEDREEAGSPTLPQGPPVPGDPWPGAPPLFEDPPPTRPSRPWRDLPETGVWLPEPPRTDPPQPPRPDDPWPAGPQPPENPWPPAPEVDNRPQEEPDLDPPREEYR

SEQ ID NO: 7485 - protein, 156 aa, unidentified
MAVGKFLLGSLLLLSLQLGQGWGPDARGVPVADGEFSSEQVAKAGGTWLGTHRPLARLRRALSGPCQLWSLTLSVAELGLGYASEEKVIFRYCAGSCPRGARTQHGLALARLQGQGRAHGGPCCRPTRYTDVAFLDDRHRWQRLPQLSAAACGCGG

SEQ ID NO: 7486 - protein, 190 aa, unidentified
MATHHTLWMGLALLGVLGDLQAAPEAQVSVQPNFQQDKFLGRWFSAGLASNSSWLREKKAALSMCKSVVAPATDGGLNLTSTFLRKNQCETRTMLLQPAGSLGSYSYRSPHWGSTYSVSVVETDYDQYALLYSQGSKGPGEDFRMATLYSRTQTPRAELKEKFTAFCKAQGFTEDTIVFLPQTDKCMTEQ

SEQ ID NO: 7487 - protein, 386 aa, unidentified [sequence omitted]

SEQ ID NO: 7488 - protein, 599 aa, unidentified
MSRSLLLWFLLFLLLLPPLPVLLADPGAPTPVNPCCYYPCQHQGICVRFGLDRYQCDCTRTGYSGPNCTIPGLWTWLRNSLRPSPSFTHFLLTHGRWFWEFVNATFIREMLMRLVLTVRSNLIPSPPTYNSAHDYISWESFSNVSYYTRILPSVPKDCPTPMGTKGKKQLPDAQLLARRFLLRRKFIPDPQGTNLMFAFFAQHFTHQFFKTSGKMGPGFTKALGHGVDLGHIYGDNLERQYQLRLFKDGKLKYQVLDGEMYPPSVEEAPVLMHYPRGIPPQSQMAVGQEVFGLLPGLMLYATLWLREHNRVCDLLKAEHPTWGDEQLFQTTRLILIGETIKIVIEEYVQQLSGYFLQLKFDPELLFGVQFQYRNRIAMEFNHLYHWHPLMPDSFKVGSQEYSYEQFLFNTSMLVDYGVEALVDAFSRQIAGRIGGGRNMDHHILHVAVDVIRESREMRLQPFNEYRKRFGMKPYTSFQELVGEKEMAAELEELYGDIDALEFYPGLLLEKCHPNSIFGESMIEIGAPFSLKGLLGNPICSPEYWKPSTFGGEVGFNIVKTATLKKLVCLNTKTCPYVSFRVPDASQDDGPAVERPSTEL

SEQ ID NO: 7489 - protein, 604 aa, unidentified
MLARALLLCAVLALSHTANPCCSHPCQNRGVCMSVGFDQYKCDCTRTGFYGENCSTPEFLTRIKLFLKPTPNTVHYILTHFKGFWNVVNNIPFLRNAIMSYVLTSRSHLIDSPPTYNADYGYKSWEAFSNLSYYTRALPPVPDDCPTPLGVKGKKQLPDSNEIVEKLLLRRKFIPDPQGSNMMFAFFAQHFTHQFFKTDHKRGPAFTNGLGHGVDLNHIYGETLARQRKLRLFKDGKMKYQIIDGEMYPPTVKDTQAEMIYPPQVPEHLRFAVGQEVFGLVPGLMMYATIWLREHNRVCDVLKQEHPEWGDEQLFQTSRLILIGETIKIVIEDYVQHLSGYHFKLKFDPELLFNKQFQYQNRIAAEFNTLYHWHPLLPDTFQIHDQKYNYQQFIYNNSILLEHGITQFVESFTRQIAGRVAGGRNVPPAVQKVSQASIDQSRQMKYQSFNEYRKRFMLKPYESFEELTGEKEMSAELEALYGDIDAVELYPALLVEKPRPDAIFGETMVEVGAPFSLKGLMGNVICSPAYWKPSTFGGEVGFQIINTASIQSLICNNVKGCPFTSFSVPDPELIKTVTINASSSRSGLDDINPTVLLKERSTEL

SEQ ID NO: 7490 - protein, 115 aa, unidentified
MIPAKDMAKVMIVMLAICFLTKSDGKSVKKRSVSEIQLMHNLGKHLNSMERVEWLRKKLQDVHNFVALGAPLAPRDAGSQRPRKKEDNVLVESHEKSLGEADKADVNVLTKAKSQ

SEQ ID NO: 7491 - protein, 100 aa, unidentified
METRQVSRSPRVRLLLLLLLLLVVPWGVRTASGVALPPVGVLSLRPPGRAWADPATPRPRRSLALADDAAFRERARLLAALERRHWLNSYMHKLLVLDAP

SEQ ID NO: 7492 - protein, 177 aa, unidentified
MQRRLVQQWSVAVFLLSYAVPSCGRSVEGLSRRLKRAVSEHQLLHDKGKSIQDLRRRFFLHHLIAEIHTAEIRATSEVSPNSKPSPNTKNHPVRFGSDDEGRYLTQETNKVETYKEQPLKTPGKKKKGKPGKRKEQEKKKRRTRSAWLDSGVTGSGLEGDHLSDTSTTSLELDSRRH

SEQ ID NO: 7493 - protein, 1070 aa, unidentified; identical to SEQ ID NO: 3630

SEQ ID NO: 7494 - protein, 168 aa, unidentified
MQAQQYQQQRRKFAAAFLAFIFILAAVDTAEAGKKEKPEKKVKKSDCGEWQWSVCVPTSGDCGLGTREGTRTGAECKQTMKTQRCKIPCNWKKQFGAECKYQFQAWGECDLNTALKTRTGSLKRALHNAECQKTVTISKPCGKLTKPKPQAESKKKKKEGKKQEKMLD

SEQ ID NO: 7495 - protein, 802 aa, unidentified; identical to SEQ ID NO: 3634

SEQ ID NO: 7496 - protein, 1997 aa, unidentified; identical to SEQ ID NO: 3635

SEQ ID NO: 7497 - protein, 1306 aa, unidentified; identical to SEQ ID NO: 3636

SEQ ID NO: 7498 - protein, 206 aa, unidentified
MALPCTLGLGMLLALPGALGSGGSAEDSVGSSSVTVVLLLLLLLLLATGLALAWRRLSRDSGGYYHPARLGAALWGRTRRLLWASPPGRWLQARAELGSTDNDLERQEDEQDTDYDHVADGGLQADPGEGEQQCGEASSPEQVPVRAEEARDSDTEGDLVLGSPGPASAGGSAEALLSDLHAFAGSAAWDDSARAAGGQGLHVTAL

SEQ ID NO: 7499 - protein, 1912 aa, unidentified; identical to SEQ ID NO: 3637

SEQ ID NO: 7500 - protein, 700 aa, unidentified; identical to SEQ ID NO: 3638

SEQ ID NO: 7501 - protein, 1907 aa, unidentified; identical to SEQ ID NO: 3639

SEQ ID NO: 7502 - protein, 1337 aa, unidentified; identical to SEQ ID NO: 3642

SEQ ID NO: 7503 - protein, 1216 aa, unidentified; identical to SEQ ID NO: 3647

SEQ ID NO: 7504 - protein, 1948 aa, unidentified; identical to SEQ ID NO: 3649

SEQ ID NO: 7505 - protein, 180 aa, unidentified; identical to SEQ ID NO: 3654

SEQ ID NO: 7506 - protein, 381 aa, unidentified
MHLLAILFCALWSAVLAENSDDYDLMYVNLDNEIDNGLHPTEDPTPCACGQEHSEWDKLFIMLENSQMRERMLLQATDDVLRGELQRLREELGRLAESLARPCAPGAPAEARLTSALDELLQATRDAGRRLARMEGAEAQRPEEAGRALAAVLEELRQTRADLHAVQGWAARSWLPAGCETAILFPMRSKKIFGSVHPVRPMRLESFSACIWVKATDVLNKTILFSYGTKRNPYEIQLYLSYQSIVFVVGGEENKLVAEAMVSLGRWTHLCGTWNSEEGLTSLWVNGELAATTVEMATGHIVPEGGILQIGQEKNGCCVGGGFDETLAFSGRLTGFNIWDSVLSNEEIRETGGAESCHIRGNIVGWGVTEIQPHGGAQYVS

SEQ ID NO: 7507 - protein, 478 aa, unidentified
MGCSWRKTLSFFLVFVPIYLHGASSQEAAPVGPRKPFFERLRRLEEQFRRFQEVTWTHLQNIASNYNVSYNVDVRFRSLAEESQAVAQAVNRSQASVQGELAQLKAWVRKLQRRGRKVDTRLRALDLTLGERSQQRARERKAHKAQRDALQDSLARLEGLVHSQGARLAALEGRLPVAHPGTAALGPALVPTPTQPEELGPTSLKLQRDRQELRAASEHRGPPQDSSAPLQGRREPPASGSHRVLSGTAPKDPRQQAWSPQVPGEICGVGPTLVFPNASTRNVVFLSPGFVTALRALSFCSWVRTASGRLGTLLSYATEDNDNKLVLHGRDSLLPGSIHFVIGDPAFRELPLQLLLDGQWHHICVIWTSTQGRYWLHVDRRLVATGSRFREGYEIPPGGSLVLGQEQDSVGGGFDSSEAFVGSMSGLAIWDRALVPGEVANLAIGKEFPTGAILTLANAALAGGFVQGANCTCLERCP

SEQ ID NO: 7508 - protein, 417 aa, unidentified; identical to SEQ ID NO: 3655

SEQ ID NO: 7509 - protein, 1479 aa, unidentified
MAKRSRGPGRRCLLALVLFCAWGTLAVVAQKPGAGCPSRCLCFRTTVRCMHLLLEAVPAVAPQTSILDLRFNRIREIQPGAFRRLRNLNTLLLNNNQIKRIPSGAFEDLENLKYLYLYKNEIQSIDRQAFKGLASLEQLYLHFNQIETLDPDSFQHLPKLERLFLHNNRITHLVPGTFNHLESMKRLRLDSNTLHCDCEILWLADLLKTYAESGNAQAAAICEYPRRIQGRSVATITPEELNCERPRITSEPQDADVTSGNTVYFTCRAEGNPKPEIIWLRNNNELSMKTDSRLNLLDDGTLMIQNTQETDQGIYQCMAKNVAGEVKTQEVTLRYFGSPARPTFVIQPQNTEVLVGESVTLECSATGHPPPRISWTRGDRTPLPVDPRVNITPSGGLYIQNVVQGDSGEYACSATNNIDSVHATAFIIVQALPQFTVTPQDRVVIEGQTVDFQCEAKGNPPPVIAWTKGGSQLSVDRRHLVLSSGTLRISGVALHDQGQYECQAVNIIGSQKVVAHLTVQPRVTPVFASIPSDTTVEVGANVQLPCSSQGEPEPAITWNKDGVQVTESGKFHISPEGFLTINDVGPADAGRYECVARNTIGSASVSMVLSVNVPDVSRNGDPFVATSIVEAIATVDRAINSTRTHLFDSRPRSPNDLLALFRYPRDPYTVEQARAGEIFERTLQLIQEHVQHGLMVDLNGTSYHYNDLVSPQYLNLIANLSGCTAHRRVNNCSDMCFHQKYRTHDGTCNNLQHPMWGASLTAFERLLKSVYENGFNTPRGINPHRLYNGHALPMPRLVSTTLIGTETVTPDEQFTHMLMQWGQFLDHDLDSTVVALSQARFSDGQHCSNVCSNDPPCFSVMIPPNDSRARSGARCMFFVRSSPVCGSGMTSLLMNSVYPREQINQLTSYIDASNVYGSTEHEARSIRDLASHRGLLRQGIVQRSGKPLLPFATGPPTECMRDENESPIPCFLAGDHRANEQLGLTSMHTLWFREHNRIATELLKLNPHWDGDTIYYETRKIVGAEIQHITYQHWLPKILGEVGMRTLGEYHGYDPGINAGIFNAFATAAFRFGHTLVNPLLYRLDENFQPIAQDHLPLHKAFFSPFRIVNEGGIDPLLRGLFGVAGKMRVPSQLLNTELTERLFSMAHTVALDLAAINIQRGRDHGIPPYHDYRVYCNLSAAHTFEDLKNEIKNPEIREKLKRLYGSTLNIDLFPALVVEDLVPGSRLGPTLMCLLSTQFKRLRDGDRLWYENPGVFSPAQLTQIKQTSLARILCDNADNITRVQSDVFRVAEFPHGYGSCDEIPRVDLRVWQDCCEDCRTRGQFNAFSYHFRGRRSLEFSYQEDKPTKKTRPRKIPSVGRQGEHLSNSTSAFSTRSDASGTNDFREFVLEMQKTITDLRTQIKKLESRLSTTECVDAGGESHANNTKWKKDACTICECKDGQVTCFVEACPPATCAVPVNIPGACCPVCLQKRAEEKP

SEQ ID NO: 7510 - protein, 1463 aa, unidentified
MEPRLFCWTTLFLLAGWCLPGLPCPSRCLCFKSTVRCMHLMLDHIPQVPQQTTVLDLRFNRIREIPGSAFKKLKNLNTLLLNNNHIRKISRNAFEGLENLLYLYLYKNEIHALDKQTFKGLISLEHLYIHFNQLEMLQPETFGDLLRLERLFLHNNKLSKIPAGSFSNLDSLKRLRLDSNALVCDCDLMWLGELLQGFAQHGHTQAAATCEYPRRLHGRAVASVTVEEFNCQSPRITFEPQDVEVPSGNTVYFTCRAEGNPKPEIIWIHNNHSLDLEDDTRLNVFDDGTLMIRNTRESDQGVYQCMARNSAGEAKTQSAMLRYSSLPAKPSFVIQPQDTEVLIGTSTTLECMATGHPHPLITWTRDNGLELDGSRHVATSSGLYLQNITQRDHGRFTCHANNSHGTVQAAANIIVQAPPQFTVTPKDQVVLEEHAVEWLCEADGNPPPVIVWTKTGGQLPVEGQHTVLSSGTLRIDRAAQHDQGQYECQAVSSLGVKKVSVQLTVKPKALAVFTQLPQDTSVEVGKNINISCHAQGEPQPIITWNKEGVQITESGKFHVDDEGTLTIYDAGFPDQGRYECVARNSFGLAVTNMFLTVTAIQGRQAGDDFVESSILDAVQRVDSAINSTRRHLFSQKPHTSSDLLAQFHYPRDPLIVEMARAGEIFEHTLQLIRERVKQGLTVDLEGKEFRYNDLVSPRSLSLIANLSGCTARRPLPNCSNRCFHAKYRAHDGTCNNLQQPTWGAALTAFARLLQPAYRDGIRAPRGLGLPVGSRQPLPPPRLVATVWARAAAVTPDHSYTRMLMHWGWFLEHDLDHTVPALSTARFSDGRPCSSVCTNDPPCFPMNTRHADPRGTHAPCMLFARSSPACASGRPSATVDSVYAREQINQQTAYIDGSNVYGSSERESQALRDPSVPRGLLKTGFPWPPSGKPLLPFSTGPPTECARQEQESPCFLAGDHRANEHLALAAMHTLWFREHNRMATELSALNPHWEGNTVYQEARKIVGAELQHITYSHWLPKVLGDPGTRMLRGYRGYNPNVNAGIINSFATAAFRFGHTLINPILYRLNATLGEISEGHLPFHKALFSPSRIIKEGGIDPVLRGLFGVAAKWRAPSYLLSPELTQRLFSAAYSAAVDSAATIIQRGRDHGIPPYVDFRVFCNLTSVKNFEDLQNEIKDSEIRQKLRKLYGSPGDIDLWPALMVEDLIPGTRVGPTLMCLFVTQFQRLRDGDRFWYENPGVFTPAQLTQLKQASLSRVLCDNGDSIQQVQADVFVKAEYPQDYLNCSEIPKVDLRVWQDCCADCRSRGQFRAVTQESQKKRSAQYSYPVDKDMELSHLRSRQQDKIYVGEDARNVTVLAKTKFSQDFSTFAAEIQETITALREQINKLEARLRQAGCTDVRGVPRKAEERWMKEDCTHCICESGQVTCVVEICPPAPCPSPELVKGTCCPVCRDRGMPSDSPEKR

SEQ ID NO: 7511 - protein, 480 aa, unidentified
MLFRNRFLLLLALAALLAFVSLSLQFFHLIPVSTPKNGMSSKSRKRIMPDPVTEPPVTDPVYEALLYCNIPSVAERSMEGHAPHHFKLVSVHVFIRHGDRYPLYVIPKTKRPEIDCTLVANRKPYHPKLEAFISHMSKGSGASFESPLNSLPLYPNHPLCEMGELTQTGVVQHLQNGQLLRDIYLKKHKLLPNDWSADQLYLETTGKSRTLQSGLALLYGFLPDFDWKKIYFRHQPSALFCSGSCYCPVRNQYLEKEQRRQYLLRLKNSQLEKTYGEMAKIVDVPTKQLRAANPIDSMLCHFCHNVSFPCTRNGCVDMEHFKVIKTHQIEDERERREKKLYFGYSLLGAHPILNQTIGRMQRATEGRKEELFALYSAHDVTLSPVLSALGLSEARFPRFAARLIFELWQDREKPSEHSVRILYNGVDVTFHTSFCQDHHKRSPKPMCPLENLVRFVKRDMFVALGGSGTNYYDACHREGF

SEQ ID NO: 7512 - protein, 97 aa, unidentified
MVFVRRPWPALTTVLLALLVCLGALVDAYPIKPEAPREDASPEELNRYYASLRHYLNLVTRQRYGKRDGPDTLLSKTFFPDGEDRPVRSRSEGPDLW

SEQ ID NO: 7513 - protein, 361 aa, unidentified
MAGGRHRRVVGTLHLLLLVAALPWASRGVSPSASAWPEEKNYHQPAILNSSALRQIAEGTSISEMWQNDLQPLLIERYPGSPGSYAARQHIMQRIQRLQADWVLEIDTFLSQTPYGYRSFSNIISTLNPTAKRHLVLACHYDSKYFSHWNNRVFVGATDSAVPCAMMLELARALDKKLLSLKTVSDSKPDLSLQLIFFDGEEAFLHWSPQDSLYGSRHLAAKMASTPHPPGARGTSQLHGMDLLVLLDLIGAPNPTFPNFFPNSARWFERLQAIEHELHELGLLKDHSLEGRYFQNYSYGGVIQDDHIPFLRRGVPVLHLIPSPFPEVWHTMDDNEENLDESTIDNLNKILQVFVLEYLHL

SEQ ID NO: 7514 - protein, 297 aa, unidentified
MDAEGLALLLPPVTLAALVDSWLREDCPGLNYAALVSGAGPSQAALWAKSPGVLAGQPFFDAIFTQLNCQVSWFLPEGSKLVPVARVAEVRGPAHCLLLGERVALNTLARCSGIASAAAAAVEAARGAGWTGHVAGTRKTTPGFRLVEKYGLLVGGAASHRYDLGGLVMVKDNHVVAAGGVEKAVRAARQAADFTLKVEVECSSLQEAVQAAEAGADLVLLDNFKPEELHPTATVLKAQFPSVAVEASGGITLDNLPQFCGPHIDVISMGMLTQAAPALDFSLKLFAKEVAPVPKIH

SEQ ID NO: 7515 - protein, 136 aa, unidentified
MVRPYPLIYFLFLPLGACFPLLDRREPTDAMGGLGAGERWADLAMGPRPHSVWGSSRWLRASQPQALLVIARGLQTSGREHAGCRFRFGRQDEGSEATGFLPAAGEKTSGPLGNLAEELNGYSRKKGGFSFRFGRR

SEQ ID NO: 7516 - protein, 747 aa, unidentified; identical to SEQ ID NO: 3661

SEQ ID NO: 7517 - protein, 253 aa, unidentified
MPLLPSTVGLAGLLFWAGQAVNALIMPNATPAPAQPESTAMRLLSGLEVPRYRRKRHISVRDMNALLDYHNHIRASVYPPAANMEYMVWDKRLARAAEAWATQCIWAHGPSQLMRYVGQNLSIHSGQYRSVVDLMKSWSEEKWHYLFPAPRDCNPHCPWRCDGPTCSHYTQMVWASSNRLGCAIHTCSSISVWGNTWHRAAYLVCNYAIKGNWIGESPYKMGKPCSSCPPSYQGSCNSNMCFKGLKSNKFTWF

SEQ ID NO: 7518 - protein, 256 aa, unidentified
MSRKKTPKSKGASTPAASTLPTANGARPARSGTALSGPDAPPNGPLQPGRPSLGGGVDFYDVAFKVMLVGDSGVGKTCLLVRFKDGAFLAGTFISTVGIDFRNKVLDVDGVKVKLQMWDTAGQERFRSVTHAYYRDAHALLLLYDVTNKASFDNIQAWLTEIHEYAQHDVALMLLGNKVDSAHERVVKREDGEKLAKEYGLPFMETSAKTGLNVDLAFTAIAKELKQRSMKAPSEPRFRLHDYVKREGRGASCCRP

SEQ ID NO: 7519 - protein, 333 aa, unidentified
MVIAGASWMLGRAAASPTQTPPTTSTIRVARRSRVALVAMVIAAAGSGGPGRAEPQLSQPSLDCGRMRSSLTPLGPPVSRDRVIASFPKWYTPEACLQLREHFHGQVSAACQRRNTGTVGLKLSKVVVVGDLYVGKTSLIHRFCKNVFDRDYKATIGVDFEIERFEIAGIPYSLQIWDTAGQEKFKCIASAYYRGAQVIITAFDLTDVQTLEHTRQWLEDALRENEAGSCFIFLVGTKKDLLSGAACEQAEADAVHLAREMQAEYWSVSAKTGENVKAFFSRVAALAFEQSVLQDLERQSSARLQVGNGDLIQMEGSPPETQESKRPSSLGCC

SEQ ID NO: 7520 - protein, 201 aa, unidentified
MSGKSLLLKVILLGDGGVGKSSLMNRYVTNKFDSQAFHTIGVEFLNRDLEVDGRFVTLQIWDTAGQERFKSLRTPFYRGADCCLLTFSVDDRQSFENLGNWQKEFIYYADVKDPEHFPFVVLGNKVDKEDRQVTTEEAQTWCMENGDYPYLETSAKDDTNVTVAFEEAVRQVLAVEEQLEHCMLGHTIDLNSGSKAGSSCC

SEQ ID NO: 7521 - protein, 263 aa, unidentified; identical to SEQ ID NO: 3668

SEQ ID NO: 7522 - protein, 334 aa, unidentified; identical to SEQ ID NO: 3669

SEQ ID NO: 7523 - protein, 175 aa, unidentified; identical to SEQ ID NO: 3674

SEQ ID NO: 7524 - protein, 580 aa, unidentified
MGSSRLRVFDPHLERKDSAAALSDRELPLPTFDVPYFKYIDEEDEDDEWSSRSQSSTEDDSVDSLLSDRYVVVSGTPEKILEHLLNDLHLEEVQDKETETLLDDFLLTYTVFMTTDDLCQALLRHYSAKKYQGKEENSDVPRRKRKVLHLVSQWIALYKDWLPEDEHSKMFLKTIYRNVLDDVYEYPILEKELKEFQKILGMHRRHTVDEYSPQKKNKALFHQFSLKENWLQHRGTVTETEEIFCHVYITEHSYVSVKAKVSSIAQEILKVVAEKIQYAEEDLALVAITFSGEKHELQPNDLVISKSLEASGRIYVYRKDLADTLNPFAENEESQQRSMRILGMNTWDLALELMNFDWSLFNSIHEQELIYFTFSRQGSGEHTANLSLLLQRCNEVQLWVATEILLCSQLGKRVQLVKKFIKIAAHCKAQRNLNSFFAIVMGLNTASVSRLSQTWEKIPGKFKKLFSELESLTDPSLNHKAYRDAFKKMKPPKIPFMPLLLKDVTFIHEGNKTFLDNLVNFEKLHMIADTVRTLRHCRTNQFGDLSPKEHQELKSYVNHLYVIDSQQALFELSHRIEPRV

SEQ ID NO: 7525 - protein, 294 aa, unidentified
MQPRRQRLPAPWSGPRGPRPTAPLLALLLLLAPVAAPAGSGDPDDPGQPQDAGVPRRLLQQAARAALHFFNFRSGSPSALRVLAEVQEGRAWINPKEGCKVHVVFSTERYNPESLLQEGEGRLGKCSARVFFKNQKPRPTINVTCTRLIEKKKRQQEDYLLYKQMKQLKNPLEIVSIPDNHGHIDPSLRLIWDLAFLGSSYVMWEMTTQVSHYYLAQLTSVRQWKTNDDTIDFDYTVLLHELSTQEIIPCRIHLVWYPGKPLKVKYHCQELQTPEEASGTEEGSAVVPTELSNF

SEQ ID NO: 7526 - protein, 163 aa, unidentified
MRRLLIPLALWLGAVGVGVAELTEAQRRGLQVALEEFHKHPPVQWAFQETSVESAVDTPFPAGIFVRLEFKLQQTSCRKRDWKKPECKVRPNGRKRKCLACIKLGSEDKVLGRLVHCPIETQVLREAEEHQETQCLRVQRAGEDPHSFYFPGQFAFSKALPRS

SEQ ID NO: 7527 - protein, 850 aa, unidentified
MAAAAPAAAAASSEAPAASATAEPEAGDQDSREVRVLQSLRGKICEAKNLLPYLGPHKMRDCFCTINLDQEEVYRTQVVEKSLSPFFSEEFYFEIPRTFQYLSFYVYDKNVLQRDLRIGKVAIKKEDLCNHSGKETWFSLQPVDSNSEVQGKVHLELKLNELITENGTVCQQLVVHIKACHGLPLINGQSCDPYATVSLVGPSRNDQKKTKVKKKTSNPQFNEIFYFEVTRSSSYTRKSQFQVEEEDIEKLEIRIDLWNNGNLVQDVFLGEIKVPVNVLRTDSSHQAWYLLQPRDNGNKSSKTDDLGSLRLNICYTEDYVLPSEYYGPLKTLLLKSPDVQPISASAAYILSEICRDKNDAVLPLVRLLLHHDKLVPFATAVAELDLKDTQDANTIFRGNSLATRCLDEMMKIVGGHYLKVTLKPILDEICDSSKSCEIDPIKLKEGDNVENNKENLRYYVDKLFNTIVKSSMSCPTVMCDIFYSLRQMATQRFPNDPHVQYSAVSSFVFLRFFAVAVVSPHTFHLRPHHPDAQTIRTLTLISKTIQTLGSWGSLSKSKSSFKETFMCEFFKMFQEEGYIIAVKKFLDEISSTETKESSGTSEPVHLKEGEMYKRAQGRTRIGKKNFKKRWFCLTSRELTYHKQPGSKDAIYTIPVKNILAVEKLEESSFNKKNMFQVIHTEKPLYVQANNCVEANEWIDVLCRVSRCNQNRLSFYHPSVYLNGNWLCCQETGENTLGCKPCTAGVPADIQIDIDEDRETERIYSLFTLSLLKLQKMEEACGTIAVYQGPQKEPDDYSNFVIEDSVTTFKTIQQIKSIIEKLDEPHEKYRKKRSSSAKYGSKENPIVGKAS

SEQ ID NO: 7528 - protein, 473 aa, unidentified; identical to SEQ ID NO: 3678

SEQ ID NO: 7529 - protein, 238 aa, unidentified
MSSGYSSLEEDAEDFFFTARTSFFRRAPQGKPRSGQQDVEKEKETHSYLSKEEIKEKVHKYNLAVTDKLKMTLNSNGIYTGFIKVQMELCKPPQTSPNSGKLSPSSNGCMNTLHISSTNTVGEVIEALLKKFLVTESPAKFALYKRCHREDQVYACKLSDREHPLYLRLVAGPRTDTLSFVLREHEIGEWEAFSLPELQNFLRILDKEEDEQLQNLKRRYTAYRQKLEEALREVWKPD

SEQ ID NO: 7530 - protein, 157 aa, unidentified
MSSEEGKLFVGGLNFNTDEQALEDHFSSFGPISEVVVVKDRETQRSRGFGFITFTNPEHASVAMRAMNGESLDGRQIRVDHAGKSARGTRGGGFGAHGRGRSYSRGGGDQGYGSGRYYDSRPGGYGYGYGRSRDYNGRNQGGYDRYSGGNYRDNYDN

SEQ ID NO: 7531 - protein, 1247 aa, unidentified
MMREWVLLMSVLLCGLAGPTHLFQPSLVLDMAKVLLDNYCFPENLLGMQEAIQQAIKSHEILSISDPQTLASVLTAGVQSSLNDPRLVISYEPSTPEPPPQVPALTSLSEEELLAWLQRGLRHEVLEGNVGYLRVDSVPGQEVLSMMGEFLVAHVWGNLMGTSALVLDLRHCTGGQVSGIPYIISYLHPGNTILHVDTIYNRPSNTTTEIWTLPQVLGERYGADKDVVVLTSSQTRGVAEDIAHILKQMRRAIVVGERTGGGALDLRKLRIGESDFFFTVPVSRSLGPLGGGSQTWEGSGVLPCVGTPAEQALEKALAILTLRSALPGVVHCLQEVLKDYYTLVDRVPTLLQHLASMDFSTVVSEEDLVTKLNAGLQAASEDPRLLVRAIGPTETPSWPAPDAAAEDSPGVAPELPEDEAIRQALVDSVFQVSVLPGNVGYLRFDSFADASVLGVLAPYVLRQVWEPLQDTEHLIMDLRHNPGGPSSAVPLLLSYFQGPEAGPVHLFTTYDRRTNITQEHFSHMELPGPRYSTQRGVYLLTSHRTATAAEEFAFLMQSLGWATLVGEITAGNLLHTRTVPLLDTPEGSLALTVPVLTFIDNHGEAWLGGGVVPDAIVLAEEALDKAQEVLEFHQSLGALVEGTGHLLEAHYARPEVVGQTSALLRAKLAQGAYRTAVDLESLASQLTADLQEVSGDHRLLVFHSPGELVVEEAPPPPPAVPSPEELTYLIEALFKTEVLPGQLGYLRFDAMAELETVKAVGPQLVRLVWQQLVDTAALVIDLRYNPGSYSTAIPLLCSYFFEAEPRQHLYSVFDRATSKVTEVWTLPQVAGQRYGSHKDLYILMSHTSGSAAEAFAHTMQDLQRATVIGEPTAGGALSVGIYQVGSSPLYASMPTQMAMSATTGKAWDLAGVEPDITVPMSEALSIAQDIVALRAKVPTVLQTAGKLVADNYASAELGAKMATKLSGLQSRYSRVTSEVALAEILGADLQMLSGDPHLKAAHIPENAKDRIPGIVPMQIPSPEVFEELIKFSFHTNVLEDNIGYLRFDMFGDGELLTQVSRLLVEHIWKKIMHTDAMIIDMRFNIGGPTSSIPILCSYFFDEGPPVLLDKIYSRPDDSVSELWTHAQVVGERYGSKKSMVILTSSVTAGTAEEFTYIMKRLGRALVIGEVTSGGCQPPQTYHVDDTNLYLTIPTARSVGASDGSSWEGVGVTPHVVVPAEEALARAKEMLQHNQLRVKRSPGLQDHL

SEQ ID NO: 7532 - protein, 201 aa, unidentified
MKWVWALLLLAALGSGRAERDCRVSSFRVKENFDKARFSGTWYAMAKKDPEGLFLQDNIVAEFSVDETGQMSATAKGRVRLLNNWDVCADMVGTFTDTEDPAKFKMKYWGVASFLQKGNDDHWIVDTDYDTYAVQYSCRLLNLDGTCADSYSFVFSRDPNGLPPEAQKIVRQRQEELCLARQYRLIVHNGYCDGRSERNLL

SEQ ID NO: 7533 - protein, 331 aa, unidentified
MARGGRGRRLGLALGLLLALVLAPRVLRAKPTVRKERVVRPDSELGERPPEDNQSFQYDHEAFLGKEDSKTFDQLTPDESKERLGKIVDRIDNDGDGFVTTEELKTWIKRVQKRYIFDNVAKVWKDYDRDKDDKISWEEYKQATYGYYLGNPAEFHDSSDHHTFKKMLPRDERRFKAADLNGDLTATREEFTAFLHPEEFEHMKEIVVLETLEDIDKNGDGFVDQDEYIADMFSHEENGPEPDWVLSEREQFNEFRDLNKDGKLDKDEIRHWILPQDYDHAQAEARHLVYESDKNKDEKLTKEEILENWNMFVGSQATNYGEDLTKNHDEL

SEQ ID NO: 7534 - protein, 317 aa, unidentified
MRLGPRTAALGLLLLCAAAAGAGKAEELHYPLGERRSDYDREALLGVQEDVDEYVKLGHEEQQKRLQAIIKKIDLDSDGFLTESELSSWIQMSFKHYAMQEAKQQFVEYDKNSDDTVTWDEYNIQMYDRVIDFDENTALDDAEEESFRKLHLKDKKRFEKANQDSGPGLSLEEFIAFEHPEEVDYMTEFVIQEALEEHDKNGDGFVSLEEFLGDYRWDPTANEDPEWILVEKDRFVNDYDKDNDGRLDPQELLPWVVPNNQGIAQEEALHLIDEMDLNGDKKLSEEEILENPDLFLTSEATDYGRQLHDDYFYHDEL

SEQ ID NO: 7535 - protein, 328 aa, unidentified; identical to SEQ ID NO: 3683

SEQ ID NO: 7536 - protein, 485 aa, unidentified
MPAMVEKGPEVSGKRRGRNNAAASASAAAASAAASAACASPAATAASGAAASSASAAAASAAAAPNNGQNKSLAAAAPNGNSSSNSWEEGSSGSSSDEEHGGGGMRVGPQYQAVVPDFDPAKLARRSQERDNLGMLVWSPNQNLSEAKLDEYIAIAKEKHGYNMEQALGMLFWHKHNIEKSLADLPNFTPFPDEWTVEDKVLFEQAFSFHGKTFHRIQQMLPDKSIASLVKFYYSWKKTRTKTSVMDRHARKQKREREESEDELEEANGNNPIDIEVDQNKESKKEVPPTETVPQVKKEKHSTQAKNRAKRKPPKGMFLSQEDVEAVSANATAATTVLRQLDMELVSVKRQIQNIKQTNSALKEKLDGGIEPYRLPEVIQKCNARWTTEEQLLAVQAIRKYGRDFQAISDVIGNKSVVQVKNFFVNYRRRFNIDEVLQEWEAEHGKEETNGPSNQKPVKSPDNSIKMPEEEDEAPVLDVRYASAS

SEQ ID NO: 7537 - protein, 318 aa, unidentified
MVELMFPLLLLLLPFLLYMAAPQIRKMLSSGVCTSTVQLPGKVVVVTGANTGIGKETAKELAQRGARVYLACRDVEKGELVAKEIQTTTGNQQVLVRKLDLSDTKSIRAFAKGFLAEEKHLHVLINNAGVMMCPYSKTADGFEMHIGVNHLGHFLLTHLLLEKLKESAPSRIVNVSSLAHHLGRIHFHNLQGEKFYNAGLAYCHSKLANILFTQELARRLKGSGVTTYSVHPGTVQSELVRHSSFMRWMWWLFSFFIKTPQQGAQTSLHCALTEGLEILSGNHFSDCHVAWVSAQARNETIARRLWDVSCDLLGLPID

SEQ ID NO: 7538 - protein, 316 aa, unidentified
MLVTLGLLTSFFSFLYMVAPSIRKFFAGGVCRTNVQLPGKVVVITGANTGIGKETARELASRGARVYIACRDVLKGESAASEIRVDTKNSQVLVRKLDLSDTKSIRAFAEGFLAEEKQLHILINNAGVMMCPYSKTADGFETHLGVNHLGHFLLTYLLLERLKVSAPARVVNVSSVAHHIGKIPFHDLQSEKRYSRGFAYCHSKLANVLFTRELAKRLQGTGVTTYAVHPGVVRSELVRHSSLLCLLWRLFSPFVKTAREGAQTSLHCALAEGLEPLSGKYFSDCKRTWVSPRARNNKTAERLWNVSCELLGIRWE

SEQ ID NO: 7539 - protein, 331 aa, unidentified
MSRYLLPLSALGTVAGAAVLLKDYVTGGACPSKATIPGKTVIVTGANTGIGKQTALELARRGGNIILACRDMEKCEAAAKDIRGETLNHHVNARHLDLASLKSIREFAAKIIEEEERVDILINNAGVMRCPHWTTEDGFEMQFGVNHLGHFLLTNLLLDKLKASAPSRIINLSSLAHVAGHIDFDDLNWQTRKYNTKAAYCQSKLAIVLFTKELSRRLQGSGVTVNALHPGVARTELGRHTGIHGSTFSSTTLGPIFWLLVKSPELAAQPSTYLAVAEELADVSGKYFDGLKQKAPAPEAEDEEVARRLWAESARLVGLEAPSVREQPLPR

SEQ ID NO: 7540 - protein, 318 aa, unidentified
MWLPLLLGALLWAVLWLLRDRQSLPASNAFVFITGCDSGFGRLLALQLDQRGFRVLASCLTPSGAEDLQRVASSRLHTTLLDITDPQSVQQAAKWVEMHVKEAGLFGLVNNAGVAGIIGPTPWLTRDDFQRVLNVNTMGPIGVTLALLPLLQQARGRVINITSVLGRLAANGGGYCVSKFGLEAFSDSLRRDVAHFGIRVSIVEPGFFRTPVTNLESLEKTLQACWARLPPATQAHYGGAFLTKYLKMQQRIMNLICDPDLTKVSRCLEHALTARHPRTRYSPGWDAKLLWLPASYLPASLVDAVLTWVLPKPAQAVY

SEQ ID NO: 7541 - protein, 311 aa, unidentified
MAAAPRTVLISGCSSGIGLELAVQLAHDPKKRYQVVATMRDLGKKETLEAAAGEALGQTLTVAQLDVCSDESVAQCLSCIQGEVDVLVNNAGMGLVGPLEGLSLAAMQNVFDTNFFGAVRLVKAVLPGMKRRRQGHIVVISSVMGLQGVIFNDVYAASKFALEGFFESLAIQLLQFNIFISLVEPGPVVTEFEGKLLAQVSMAEFPGTDPETLHYFRDLYLPASRKLFCSVGQNPQDVVQAIVNVISSTRPPLRRQTNIRYSPLTTLKTVDSSGSLYVRTTHRLLFRCPRLLNLGLQCLSCGCLPTRVRPR

SEQ ID NO: 7542 - protein, 166 aa, unidentified
MAQTSSYFMLISCLMFLSQSQGQEAQTELPQARISCPEGTNAYRSYCYYFNEDRETWVDADLYCQNMNSGNLVSVLTQAEGAFVASLIKESGTDDFNVWIGLHDPKKNRRWHWSSGSLVSYKSWGIGAPSSVNPGYCVSLTSSTGFQKWKDVPCEDKFSFVCKFKN

SEQ ID NO: 7543 - protein, 166 aa, unidentified
MAQTNSFFMLISSLMFLSLSQGQESQTELPNPRISCPEGTNAYRSYCYYFNEDPETWVDADLYCQNMNSGNLVSVLTQAEGAFVASLIKESSTDDSNVWIGLHDPKKNRRWHWSSGSLVSYKSWDTGSPSSANAGYCASLTSCSGFKKWKDESCEKKFSFVCKFKN

SEQ ID NO: 7544 - protein, 175 aa, unidentified
MLPPMALPSVSWMLLSCLMLLSQVQGEEPQRELPSARIRCPKGSKAYGSHCYALFLSPKSWTDADLACQKRPSGNLVSVLSGAEGSFVSSLVKSIGNSYSYVWIGLHDPTQGTEPNGEGWEWSSSDVMNYFAWERNPSTISSPGHCASLSRSTAFLRWKDYNCNVRLPYVCKFTD

SEQ ID NO: 7545 - protein, 175 aa, unidentified
MLPPMALPSVSWMLLSCLILLCQVQGEETQKELPSPRISCPKGSKAYGSPCYALFLSPKSWMDADLACQKRPSGKLVSVLSGAEGSFVSSLVRSISNSYSYIWIGLHDPTQGSEPDGDGWEWSSTDVMNYFAWEKNPSTILNPGHCGSLSRSTGFLKWKDYNCDAKLPYVCKFKD

SEQ ID NO: 7546 - protein, 158 aa, unidentified
MASRSMRLLLLLSCLAKTGVLGDIIMRPSCAPGWFYHKSNCYGYFRKLRNWSDAELECQSYGNGAHLASILSLKEASTIAEYISGYQRSQPIWIGLHDPQKRQQWQWIDGAMYLYRSWSGKSMGGNKHCAEMSSNNNFLTWSSNECNKRQHFLCKYRP

SEQ ID NO: 7547 - protein, 3460 aa, unidentified
MERSGWARQTFLLALLLGATLRARAAAGYYPRFSPFFFLCTHHGELEGDGEQGEVLISLHIAGNPTYYVPGQEYHVTISTSTFFDGLLVTGLYTSTSVQASQSIGGSSAFGFGIMSDHQFGNQFMCSVVASHVSHLPTTNLSFIWIAPPAGTGCVNFMATATHRGQVIFKDALAQQLCEQGAPTDVTVHPHLAEIHSDSIILRDDFDSYHQLQLNPNIWVECNNCETGEQCGAIMHGNAVTFCEPYGPRELITTGLNTTTASVLQFSIGSGSCRFSYSDPSIIVLYAKNNSADWIQLEKIRAPSNVSTIIHILYLPEDAKGENVQFQWKQENLRVGEVYEACWALDNILIINSAHRQVVLEDSLDPVDTGNWLFFPGATVKHSCQSDGNSIYFHGNEGSEFNFATTRDVDLSTEDIQEQWSEEFESQPTGWDVLGAVIGTECGTIESGLSMVFLKDGERKLCTPSMDTTGYGNLRFYFVMGGICDPGNSHENDIILYAKIEGRKEHITLDTLSYSSYKVPSLVSVVINPELQTPATKFCLRQKNHQGHNRNVWAVDFFHVLPVLPSTMSHMIQFSINLGCGTHQPGNSVSLEFSTNHGRSWSLLHTECLPEICAGPHLPHSTVYSSENYSGWNRITIPLPNAALTRNTRIRWRQTGPILGNMWAIDNVYIGPSCLKFCSGRGQCTRHGCKCDPGFSGPACEMASQTFPMFISESFGSSRLSSYHNFYSIRGAEVSFGCGVLASGKALVFNKDGRRQLITSFLDSSQSRFLQFTLRLGSKSVLSTCRAPDQPGEGVLLHYSYDNGITWKLLEHYSYLSYHEPRIISVELPGDAKQFGIQFRWWQPYHSSQREDVWAIDEIIMTSVLFNSISLDFTNLVEVTQSLGFYLGNVQPYCGHDWTLCFTGDSKLASSMRYVETQSMQIGASYMIQFSLVMGCGQKYTPHMDNQVKLEYSTNHGLTWHLVQEECLPSMPSCQEFTSASIYHASEFTQWRRVIVLLPQKTWSSATRFRWSQSYYTAQDEWALDSIYIGQQCPNMCSGHGSCDHGICRCDQGYQGTECHPEAALPSTIMSDFENQNGWESDWQEVIGGEIVKPEQGCGVISSGSSLYFSKAGKRQLVSWDLDTSWVDFVQFYIQIGGESASCNKPDSREEGVLLQYSNNGGIQWHLLAEMYFSDFSKPRFVYLELPAAAKTPCTRFRWWQPVFSGEDYDQWAVDDIIILSEKQKQIIPVINPTLPQNFYEKPAFDYPMNQMSVWLMLANEGMVKNETFCAATPSAMIFGKSDGDRFAVTRDLTLKPGYVLQFKLNIGCANQFSSTAPVLLQYSHDAGMSWFLVKEGCYPASAGKGCEGNSRELSEPTMYHTGDFEEWTRITIVIPRSLASSKTRFRWIQESSSQKNVPPFGLDGVYISEPCPSYCSGHGDCISGVCFCDLGYTAAQGTCVSNVPNHNEMFDRFEGKLSPLWYKITGAQVGTGCGTLNDGKSLYFNGPGKREARTVPLDTRNIRLVQFYIQIGSKTSGITCIKPRTRNEGLIVQYSNDNGILWHLLRELDFMSFLEPQIISIDLPQDAKTPATAFRWWQPQHGKHSAQWALDDVLIGMNDSSQTGFQDKFDGSIDLQANWYRIQGGQVDIDCLSMDTALIFTENIGKPRYAETWDFHVSASTFLQFEMSMGCSKPFSNSHSVQLQYSLNNGKDWHLVTEECVPPTIGCLHYTESSIYTSERFQNWKRITVYLPLSTISPRTRFRWIQANYTVGADSWAIDNVVLASGCPWMCSGRGICDAGRCVCDRGFGGPYCVPVVPLPSILKDDFNGNLHPDLWPEVYGAERGNLNGETIKSGTSLIFKGEGLRMLISRDLDCTNTMYVQFSLRFIAKSTPERSHSILLQFSISGGITWHLMDEFYFPQTTNILFINVPLPYTAQTNATRFRLWQPYNNGKKEEIWIVDDFIIDGNNVNNPVMLLDTFDFGPREDNWFFYPGGNIGLYCPYSSKGAPEEDSAMVFVSNEVGEHSITTRDLNVNENTIIQFEINVGCSTDSSSADPVRLEFSRDFGATWHLLLPLCYHSSSHVSSLCSTEHHPSSTYYAGTMQGWRREVVHFGKLHLCGSVRFRWYQGFYPAGSQPVTWAIDNVYIGPQCEEMCNGQGSCINGTKCICDPGYSGPTCKISTKNPDFLKDDFEGQLESDRFLLMSGGKPSRKCGILSSGNNLFFNEDGLRMLMTRDLDLSHARFVQFFMRLGCGKGVPDPRSQPVLLQYSLNGGLSWSLLQEFLFSNSSNVGRYIALEIPLKARSGSTRLRWWQPSENGHFYSPWVIDQILIGGNISGNTVLEDDFTTLDSRKWLLHPGGTKMPVCGSTGDALVFIEKASTRYVVSTDVAVNEDSFLQIDFAASCSVTDSCYAIELEYSVDLGLSWHPLVRDCLPTNVECSRYHLQRILVSDTFNKWTRITLPLPPYTRSQATRFRWHQPAPFDKQQTWAIDNVYIGDGCIDMCSGHGRCIQGNCVCDEQWGGLYCDDPETSLPTQLKDNFNRAPSSQNWLTVNGGKLSTVCGAVASGMALHFSGGCSRLLVTVDLNLTNAEFIQFYFMYGCLITPNNRNQGVLLEYSVNGGITWNLLMEIFYDQYSKPGFVNILLPPDAKEIATRFRWWQPRHDGLDQNDWAIDNVLISGSADQRTVMLDTFSSAPVPQHERSPADAGPVGRIAFDMFMEDKTSVNEHWLFHDDCTVERFCDSPDGVMLCGSHDGREVYAVTHDLTPTEGWIMQFKISVGCKVSEKIAQNQIHVQYSTDFGVSWNYLVPQCLPADPKCSGSVSQPSVFFPTKGWKRITYPLPESLVGNPVRFRFYQKYSDMQWAIDNFYLGPGCLDNCRGHGDCLREQCICDPGYSGPNCYLTHTLKTFLKERFDSEEIKPDLWMSLEGGSTCTECGILAEDTALYFGGSTVRQAVTQDLDLRGAKFLQYWGRIGSENNMTSCHRPICRKEGVLLDYSTDGGITWTLLHEMDYQKYISVRHDYILLPEDALTNTTRLRWWQPFVISNGIVVSGVERAQWALDNILIGGAEINPSQLVDTFDDEGTSHEENWSFYPNAVRTAGFCGNPSFHLYWPNKKKDKTHNALSSRELIIQPGYMMQFKIVVGCEATSCGDLHSVMLEYTKDARSDSWQLVQTQCLPSSSNSIGCSPFQFHEATIYNSVNSSSWKRITIQLPDHVSSSATQFRWIQKGEETEKQSWAIDHVYIGEACPKLCSGHGYCTTGAICICDESFQGDDCSVFSHDLPSYIKDNFESARVTEANWETIQGGVIGSGCGQLAPYAHGDSLYFNGCQIRQAATKPLDLTRASKIMFVLQIGSMSQTDSCNSDLSGPHAVDKAVLLQYSVNNGITWHVIAQHQPKDFTQAQRVSYNVPLEARMKGVLLRWWQPRHNGTGHDQWALDHVEVVLVSTRKQNYMMNFSRQHGLRHFYNRRRRSLRRYP

SEQ ID NO: 7548 - protein, 430 aa, unidentified; identical to SEQ ID NO: 3695

SEQ ID NO: 7549 - protein, 406 aa, unidentified
MDGWRRMPRWGLLLLLWGSCTFGLPTDTTTFKRIFLKRMPSIRESLKERGVDMARLGPEWSQPMKRLTLGNTTSSVILTNYMDTQYYGEIGIGTPPQTFKVVFDTGSSNVWVPSSKCSRLYTACVYHKLFDASDSSSYKHNGTELTLRYSTGTVSGFLSQDIITVGGITVTQMFGEVTEMPALPFMLAEFDGVVGMGFIEQAIGRVTPIFDNIISQGVLKEDVFSFYYNRDSENSQSLGGQIVLGGSDPQHYEGNFHYINLIKTGVWQIQMKGVSVGSSTLLCEDGCLALVDTGASYISGSTSSIEKLMEALGAKKRLFDYVVKCNEGPTLPDISFHLGGKEYTLTSADYVFQESYSSKKLCTLAIHAMDIPPPTGPTWALGATFIRKFYTEFDRRNNRIGFALAR

SEQ ID NO: 7550 - protein, 567 aa, unidentified
MLERRCRGPLAMGLAQPRLLSGPSQESPQTLGKESRGLRQQGTSVAQSGAQAPGRAHRCAHCRRHFPGWVALWLHTRRCQARLPLPCPECGRRFRHAPFLALHRQVHAAATPDLGFACHLCGQSFRGWVALVLHLRAHSAAKRPIACPKCERRFWRRKQLRAHLRRCHPPAPEARPFICGNCGRSFAQWDQLVAHKRVHVAEALEEAAAKALGPRPRGRPAVTAPRPGGDAVDRPFQCACCGKRFRHKPNLIAHRRVHTGERPHQCPECGKRFTNKPYLTSHRRIHTGEKPYPCKECGRRFRHKPNLLSHSKIHKRSEGSAQAAPGPGSPQLPAGPQESAAEPTPAVPLKPAQEPPPGAPPEHPQDPIEAPPSLYSCDDCGRSFRLERFLRAHQRQHTGERPFTCAECGKNFGKKTHLVAHSRVHSGERPFACEECGRRFSQGSHLAAHRRDHAPDRPFVCPDCGKAFRHKPYLAAHRRIHTGEKPYVCPDCGKAFSQKSNLVSHRRIHTGERPYACPDCDRSFSQKSNLITHRKSHIRDGAFCCAICGQTFDDEERLLAHQKKHDV

SEQ ID NO: 7551 - protein, 660 aa, unidentified
MEAAAAAAAAAAAAAAAGGGCGSGPPPLLLSEGEQQCYSELFARCAGAAGGGPGSGPPEAARVAPGTATAAAGPVADLFRASQLPAETLHQITELCGAKRVGYFGPTQFYIALKLIAAAQSGLPVRIESIKCELPLPRFMMSKNDGEIRFGNPAELHGTKVQIPYLTTEKNSFKRMDDEDKQQETQSPTMSPLASPPSSPPHYQRVPLSHGYSKLRSSAEQMHPAPYEARQPLVQPEGSSSGGPGTKPLRHQASLIRSFSVERELQDNSSYPDEPWRITEEQREYYVNQFRSLQPDPSSFISGSVAKNFFTKSKLSIPELSYIWELSDADCDGALTLPEFCAAFHLIVARKNGYPLPEGLPPTLQPEYLQAAFPKPKWDCQLFDSYSESLPANQQPRDLNRMEKTSVKDMADLPVPNQDVTSDDKQALKSTINEALPKDVSEDPATPKDSNSLKARPRSRSYSSTSIEEAMKRGEDPPTPPPRPQKTHSRASSLDLNKVFQPSVPATKSGLLPPPPALPPRPCPSQSEQVSEAELLPQLSRAPSQAAESSPAKKDVLYSQPPSKPIRRKFRPENQATENQEPSTAASGPASAATMKPHPTVQKQSSKQKKAIQTAIRKNKEANAVLARLNSELQQQLKEVHQERIALENQLEQLRPVTVL

SEQ ID NO: 7552 - protein, 1114 aa, unidentified; identical to SEQ ID NO: 3697

SEQ ID NO: 7553 - protein, 108 aa, unidentified
MKALCLLLLPVLGLLVSSKTLCSMEEAINERIQEVAGSLIFRAISSIGLECQSVTSRGDLATCPRGFAVTGCTCGSACGSWDVRAETTCHCQCAGMDWTGARCCRVQP

SEQ ID NO: 7554 - protein, 111 aa, unidentified
MGPSSCLLLILIPLLQLINPGSTQCSLDSVMDKKIKDVLNSLEYSPSPISKKLSCASVKSQGRPSSCPAGMAVTGCACGYGCGSWDVQLETTCHCQCSVVDWTTARCCHLT

SEQ ID NO: 7555 - protein, 610 aa, unidentified; identical to SEQ ID NO: 3698

SEQ ID NO: 7556 - protein, 331 aa, unidentified
MSRARGALCRACLALAAALAALLLLPLPLPRAPAPARTPAPAPRAPPSRPAAPSLRPDDVFIAVKTTRKNHGPRLRLLLRTWISRARQQTFIFTDGDDPELELQGGDRVINTNCSAVRTRQALCCKMSVEYDKFIESGRKWFCHVDDDNYVNARSLLHLLSSFSPSQDVYLGRPSLDHPIEATERVQGGRTVTTVKFWFATGGAGFCLSRGLALKMSPWASLGSFMSTAEQVRLPDDCTVGYIVEGLLGARLLHSPLFHSHLENLQRLPPDTLLQQVTLSHGGPENPHNVVNVAGGFSLHQDPTRFKSIHCLLYPDTDWCPRQKQGAPTSR

SEQ ID NO: 7557 - protein, 137 aa, unidentified
MKPPAAQGSPAAAAAAAPALDSAAAEDLSDALCEFDAVLADFASPFHERHFHYEEHLERMKRRSSASVSDSSGFSDSESADSLYRNSFSFSDEKLNSPTDSTPALLSATVTPQKAKLGDTKELEAFIADLDKTLASM

SEQ ID NO: 7558 - protein, 473 aa, unidentified
MRKLLTNLPAAAVLSAQVYSAVLQGLWEENVCGTPGRTRVCTALLYGQVCPFQDSTDGLRTITSILFNWPPENTSVYYQPPQRSSFRIKLAFRNLSWPGLGLEDHQEIVLGQLVLPEPNEAKPDDPAPRPGQHALTMPALEPAPPLLADLGPALEPESPAALGPPGYLHSAPGPAPAPGEGPPPGTVLEPQSAPESSCPCRGSVKNQPSEELPDMTTFPPRLLAEQLTLMDAELFKKVVLHECLGCIWGQGHLKGNEHMAPTVRATIAHFNRLTNCITTSCLGDHSMRARDRARVVEHWIKVARECLSLNNFSSVHVIVSALCSNPIGQLHKTWAGVSSKSMKELKELCKKDTAVKRDLLIKAGSFKVATQERNPQRVQMRLRRQKKGVVPFLGDFLTELQRLDSAIPDDLDGNTNKRSKEVRVLQEMQLLQVAAMNYRLRPLEKFVTYFTRMEQLSDKESYKLSCQLEPENP

SEQ ID NO: 7559 - protein, 450 aa, unidentified
MQPPRERLVVTGRAGWMGMGRGAGRSALGFWPTLAFLLCSFPAATSPCKILKCNSEFWSATSGSHAPASDDTPEFCAALRSYALCTRRTARTCRGDLAYHSAVHGIEDLMSQHNCSKDGPTSQPRLRTLPPAGDSQERSDSPEICHYEKSFHKHSATPNYTHCGLFGDPHLRTFTDRFQTCKVQGAWPLIDNNYLNVQVTNTPVLPGSAATATSKLTIIFKNFQECVDQKVYQAEMDELPAAFVDGSKNGGDKHGANSLKITEKVSGQHVEIQAKYIGTTIVVRQVGRYLTFAVRMPEEVVNAVEDWDSQGLYLCLRGCPLNQQIDFQAFHTNAEGTGARRLAAASPAPTAPETFPYETAVAKCKEKLPVEDLYYQACVFDLLTTGDVNFTLAAYYALEDVKMLHSNKDKLHLYDRTRDLPGRAAAGLPLAPRPLLGALVPLLALLPVFC

SEQ ID NO: 7560 - protein, 437 aa, unidentified; identical to SEQ ID NO: 3700

SEQ ID NO: 7561 - protein, 205 aa, unidentified
MAHGPGALMLKCVVVGDGAVGKTCLLMSYANDAFPEEYVPTVFDHYAVSVTVGGKQYLLGLYDTAGQEDYDRLRPLSYPMTDVFLICFSVVNPASFQNVKEEWVPELKEYAPNVPFLLIGTQIDLRDDPKTLARLNDMKEKPICVEQGQKLAKEIGACCYVECSALTQKGLKTVFDEAIIAILTPKKHTVKKRIGSRCINCCLIT

SEQ ID NO: 7562 - protein, 369 aa, unidentified; identical to SEQ ID NO: 3721

SEQ ID NO: 7563 - protein, 137 aa, unidentified
MSSLIRRVISTAKAPGAIGPYSQAVLVDRTIYISGQIGMDPSSGQLVSGGVAEEAKQALKNMGEILKAAGCDFTNVVKTTVLLADINDFNTVNEIYKQYFKSNFPARAAYQVAALPKGSRIEIEAVAIQGPLTTASL

SEQ ID NO: 7564 - protein, 1692 aa, unidentified
MSSAVGPRGPRPPTVPPPMQELPDLSHLTEEERNIIMAVMDRQKEEEEKEEAMLKCVVRDMAKPAACKTPRNAENQPHQPSPRLHQQFESYKEQVRKIGEEARRYQGEHKDDAPTCGICHKTKFADGCGHLCSYCRTKFCARCGGRVSLRSNNEDKVVMWVCNLCRKQQEILTKSGAWFFGSGPQQTSQDGTLSDTATGAGSEVPREKKARLQERSRSQTPLSTAAASSQDAAPPSAPPDRSKGAEPSQQALGPEQKQASSRSRSEPPRERKKTPGLSEQNGKGALKSERKRVPKTSAQPVEGAVEERERKERRESRRLEKGRSQDYPDTPEKRDEGKAADEEKQRKEEDYQTRYRSDPNLARYPVKPPPEEQQMRMHARVSRARHERRHSDVALPRTEAGAALPEGKAGKRAPAAARASPPDSPRAYSAERTAETRAPGAKQLTNHSPPAPRHGPVPAEAPELKAQEPLRKQSRLDPSSAVLMRKAKREKVETMLRNDSLSSDQSESVRPSPPKPHRSKRGGKKRQMSVSSSEEEGVSTPEYTSCEDVELESESVSEKGDLDYYWLDPATWHSRETSPISSHPVTWQPSKEGDRLIGRVILNKRTTMPKDSGALLGLKVVGGKMTDLGRLGAFITKVKKGSLADVVGHLRAGDEVLEWNGKPLPGATNEEVYNIILESKSEPQVEIIVSRPIGDIPRIPESSHPPLESSSSSFESQKMERPSISVISPTSPGALKDAPQVLPGQLSVKLWYDKVGHQLIVNVLQATDLPARVDGRPRNPYVKMYFLPDRSDKSKRRTKTVKKILEPKWNQTFVYSHVHRRDFRERMLEITVWDQPRVQEEESEFLGEILIELETALLDDEPHWYKLQTHDESSLPLPQPSPFMPRRHIHGESSSKKLQRSQRISDSDISDYEVDDGIGVVPPVGYRSSARESKSTTLTVPEQQRTTHHRSRSVSPHRGNDQGKPRSRLPNVPLQRSLDEIHPTRRSRSPTRHHDASRSPVDHRTRDVDSQYLSEQDSELLMLPRAKRGRSAECLHTTRHLVRHYKTLPPKMPLLQSSSHWNIYSSILPAHTKTKSVTRQDISLHHECFNSTVLRFTDEILVSELQPFLDRARSASTNCLRPDTSLHSPERERGRWSPSLDRRRPPSPRIQIQHASPENDRHSRKSERSSIQKQTRKGTASDAERVLPTCLSRRGHAAPRATDQPVIRGKHPARSRSSEHSSIRTLCSMHHLVPGGSAPPSPLLTRMHRQRSPTQSPPADTSFSSRRGRQLPQVPVRSGSIEQASLVVEERTRQMKMKVHRFKQTTGSGSSQELDREQYSKYNIHKDQYRSCDNVSAKSSDSDVSDVSAISRTSSASRLSSTSFMSEQSERPRGRISSFTPKMQGRRMGTSGRSIMKSTSVSGEMYTLEHNDGSQSDTAVGTVGAGGKKRRSSLSAKVVAIVSRRSRSTSQLSQTESGHKKLKSTIQRSTETGMAAEMRKMVRQPSRESTDGSINSYSSEGNLIFPGVRLGADSQFSDFLDGLGPAQLVGRQTLATPAMGDIQIGMEDKKGQLEVEVIRARSLTQKPGSKSTPAPYVKVYLLENGACIAKKKTRIARKTLDPLYQQSLVFDESPQGKVLQVIVWGDYGRMDHKCFMGVAQILLEELDLSSMVIGWYKLFPPSSLVDPTLTPLTRRASQSSLESSTGPPCIRS

SEQ ID NO: 7565 - protein, 151 aa, unidentified
MDSAACAAAATPVPALALALAPDLAQAPLALPGLLSPSCLLSSGQEVNGSERGTCLWRPWLSSTNDSPRQMRKLVDLAAGGATAAEVTKAESKFHHPVRLFWPKSRSFDYLYSAGEILLQNFPVQATINLYEDSDSEEEEEDEEQEDEEEK

SEQ ID NO: 7566 - protein, 185 aa, unidentified
MPRLFLFHLLEFCLLLNQFSRAVAAKWKDDVIKLCGRELVRAQIAICGMSTWSKRSLSQEDAPQTPRPVAEIVPSFINKDTETIIIMLEFIANLPPELKAALSERQPSLPELQQYVPALKDSNLSFEEFKKLIRNRQSEAADSNPSELKYLGLDTHSQKKRRPYVALFEKCCLIGCTKRSLAKYC

SEQ ID NO: 7567 - protein, 185 aa, unidentified
MPRLFFFHLLGVCLLLNQFSRAVADSWMEEVIKLCGRELVRAQIAICGMSTWSKRSLSQEDAPQTPRPVAEIVPSFINKDTETINMMSEFVANLPQELKLTLSEMQPALPQLQQHVPVLKDSSLLFEEFKKLIRNRQSEAADSSPSELKYLGLDTHSRKKRQLYSALANKCCHVGCTKRSLARFC

SEQ ID NO: 7568 - protein, 142 aa, unidentified
MARYMLLLLLAVWVLTGELWPGAEARAAPYGVRLCGREFIRAVIFTCGGSRWRRSDILAHEAMGDTFPDADADEDSLAGELDEAMGSSEWLALTKSPQAFYRGRPSWQGTPGVLRGSRDVLAGLSSSCCKWGCSKSEISSLC

SEQ ID NO: 7569 - protein, 314 aa, unidentified
MALAARLWRLLPFRRGAAPGSRLPAGTSGSRGHCGPCRFRGFEVMGNPGTFKRGLLLSALSYLGFETYQVISQAAVVHATAKVEEILEQADYLYESGETEKLYQLLTQYKESEDAELLWRLARASRDVAQLSRTSEEEKKLLVYEALEYAKRALEKNESSFASHKWYAICLSDVGDYEGIKAKIANAYIIKEHFEKAIELNPKDATSIHLMGIWCYTFAEMPWYQRRIAKMLFATPPSSTYEKALGYFHRAEQVDPNFYSKNLLLLGKTYLKLHNKKLAAFWLMKAKDYPAHTEEDKQIQTEAAQLLTSFSEKN

SEQ ID NO: 7570 - protein, 156 aa, unidentified
MALEKSLVRLLLLVLILLVLGWVQPSLGKESRAKKFQRQHMDSDSSPSSSSTYCNQMMRRRNMTQGRCKPVNTFVHEPLVDVQNVCFQEKVTCKNGQGNCYKSNSSMHITDCRLTNGSRYPNCAYRTSPKERHIIVACEGSPYVPVHFDASVEDST

SEQ ID NO: 7571 - protein, 216 aa, unidentified
MKLNLVQIFFMLLMLLLGLGMGLGLGLHMATAVLEESDQPLNEFWSSDSQDKAEATEEGDGTQTTETLVLSNKEVVQPGWPEDPILGEDEVGGNKMLRASALFQSNKDYLRLDQTDRECNDMMAHKMKEPSQSCIAQYAFIHEDLNTVKAVCNSPVIACELKGGKCHKSSRPFDLTLCELSQPDQVTPNCNYLTSVIKKHIIITCNDMKRQLPTGQ

SEQ ID NO: 7572 - protein, 199 aa, unidentified
METFPLLLLSLGLVLAEASESTMKIIKEEFTDEEMQYDMAKSGQEKQTIEILMNPILLVKNTSLSMSKDDMSSTLLTFRSLHYNDPKGNSSGNDKECCNDMTVWRKVSEANGSCKWSNNFIRSSTEVMRRVHRAPSCKFVQNPGISCCESLELENTVCQFTTGKQFPRCQYHSVTSLEKILTVLTGHSLMSWLVCGSKL

SEQ ID NO: 7573 - protein, 147 aa, unidentified
MIIMVIIFLVLLFWENEVNDEAVMSTLEHLHVDYPQNDVPVPARYCNHMIIQRVIREPDHTCKKEHVFIHERPRKINGICISPKKVACQNLSAIFCFQSETKFKMTVCQLIEGTRYPACRYHYSPTEGFVLVTCDDLRPDSFLGYVK

SEQ ID NO: 7574 - protein, 156 aa, unidentified
MAPAVTRLLFLQLVLGPTLVMDIKMQIGSRNFYTLSIDYPRVNYPKGFRGYCNGLMSYMRGKMQNSDCPKIHYVIHAPWKAIQKFCKYSDSFCENYNEYCTLTQDSLPITVCSLSHQQPPTSCYYNSTLTNQKLYLLCSRKYEADPIGIAGLYSGI

SEQ ID NO: 7575 - protein, 161 aa, unidentified
MVPKLFTSQICLLLLLGLLAVEGSLHVKPPQFTWAQWFETQHINMTSQQCTNAMQVINNYQRRCKNQNTFLLTTFANVVNVCGNPNMTCPSNKTRKNCHHSGSQVPLIHCNLTTPSPQNISNCRYAQTPANMFYIVACDNRDQRRDPPQYPVVPVHLDRII

SEQ ID NO: 7576 - protein, 160 aa, unidentified
MVPKLFTSQICLLLLLGLMGVEGSLHARPPQFTRAQWFAIQHISLNPPRCTIAMRAINNYRWRCKNQNTFLRTTFANVVNVCGNQSIRCPHNRTLNNCHRSRFRVPLLHCDLINPGAQNISNCTYADRPGRRFYVVACDNRDPRDSPRYPVVPVHLDTTI

SEQ ID NO: 7577 - protein, 147 aa, unidentified
MALQRTHSLLLLLLLTLLGLGLVQPSYGQDGMYQRFLRQHVHPEETGGSDRYCNLMMQRRKMTLYHCKRFNTFIHEDIWNIRSICSTTNIQCKNGKMNCHEGVVKVTDCRDTGSSRAPNCRYRAIASTRRVVIACEGNPQVPVHFDG

SEQ ID NO: 7578 - protein, 150 aa, unidentified
MVLCFPLLLLLLVLWGPVCPLHAWPKRLTKAHWFEIQHIQPSPLQCNRAMSGINNYTQHCKHQNTFLHDSFQNVAAVCDLLSIVCKNRRHNCHQSSKPVNMTDCRLTSGKYPQCRYSAAAQYKFFIVACDPPQKSDPPYKLVPVHLDSIL

SEQ ID NO: 7579 - protein, 156 aa, unidentified
MAPARAGFCPLLLLLLLGLWVAEIPVSAKPKGMTSSQWFKIQHMQPSPQACNSAMKNINKHTKRCKDLNTFLHEPFSSVAATCQTPKIACKNGDKNCHQSHGAVSLTMCKLTSGKHPNCRYKEKRQNKSYVVACKPPQKKDSQQFHLVPVHLDRVL

SEQ ID NO: 7580 - protein, 154 aa, unidentified
MAPARAGCCPLLLLLLGLWVAEVLVRAKPKDMTSSQWFKTQHVQPSPQACNSAMSIINKYTERCKDLNTFLHEPFSSVAITCQTPNIACKNSCKNCHQSHGPMSLTMGELTSGKYPNCRYKEKHLNTPYIVACDPPQQGDPGYPLVPVHLDKVV

SEQ ID NO: 7581 - protein, 205 aa, unidentified
MMRTLITTHPLPLLLLPQQLLQLVQFQEVDTDFDFPEEDKKEEFEECLEKFFSTGPARPPTKEKVKRRVLIEPGMPLNHIEYCNHEIMGKNVYYKHRWVAEHYFLLMQYDELQKICYNRFVPCKNGIRKCNRSKGLVEGVYCNLTEAFEIPACKYESLYRKGYVLITCSWQNEMQKRIPHTINDLVEPPEHRSFLSEDGVFVISP

SEQ ID NO: 7582 - protein, 286 aa, unidentified
MSWLLFLAHRVALAALPCRRGSRGFGMFYAVRRGRKTGVFLTWNECRAQVDRFPAARFKKFATEDEAWAFVRKSASPEVSEGHENQHGQESEAKASKRLREPLDGDGHESAEPYAKHMKPSVEPAPPVSRDTFSYMGDFVVVYTDGCCSSNGRRRPRAGIGVYWGPGHPLNVGIRLPGRQTNQRAEIHAACKAIEQAKTQNINKLVLYTDSMFTINGITNWVQGWKKNGWKTSAGKEVINKEDFVALERLTQGMDIQWMHVPGHSGFIGNEEADRLAREGAKQSED

SEQ ID NO: 7583 - protein, 256 aa, unidentified
MRPAALRGALLGCLCLALLCLGGADKRLRDNHEWKKLIMVQHWPETVCEKIQNDCRDPPDYWTIHGLWPDKSEGCNRSWPFNLEEIKDLLPEMRAYWPDVIHSFPNRSRFWKHEWEKHGTCAAQVDALNSQKKYFGRSLELYRELDLNSVLLKLGIKPSINYYQVADFKDALARVYGVIPKIQCLPPSQDEEVQTIGQIELCLTKQDQQLQNCTEPGEQPSPKQEVWLANGAAESRGLRVCEDGPVFYPPPKKTKH

SEQ ID NO: 7584 - protein, 359 aa, unidentified
MMAGCGEIDHSINMLPTNRKANESCSNTAPSLTVPECAICLQTCVHPVSLPCKHVFCYLCVKGASWLGKRCALCRQEIPEDFLDKPTLLSPEELKAASRGNGEYAWYYEGRNGWWQYDERTSRELEDAFSKGKKNTEMLIAGFLYVADLENMVQYRRNEHGRRRKIKRDIIDIPKKGVAGLRLDCDANTVNLARESSADGADSVSAQSGASVQPLVSSVRPLTSVDGQLTSPATPSPDASTSLEDSFAHLQLSGDNTAERSHRGEGEEDHESPSSGRVPAPDTSIEETESDASSDSEDVSAVVAQHSLTQQRLLVSNANQTVPDRSDRSGTDRSVAGGGTVSVSVRSRRPDGQCTVTEV

SEQ ID NO: 7585 - protein, 305 aa, unidentified; identical to SEQ ID NO: 3737

SEQ ID NO: 7586 - protein, 438 aa, unidentified; identical to SEQ ID NO: 3739

SEQ ID NO: 7587 - protein, 350 aa, unidentified [sequence omitted]

SEQ ID NO: 7588 - protein, 566 aa, unidentified
MDLHRAAFKMENSSYLPNPLASPALMVLASTAEASRDASIPCQQPRPFGVPVSVDKDVHIPFTNGSYTFASMYHRQGGVPGTFANRDFPPSLLHLHPQFAPPNLDCTPISMLNHSGVGAFRPFASTEDRESYQSAFTPAKRLKNCHDTESPHLRFSDADGKEYDFGTQLPSSSPGSLKVDDTGKKIFAVSGLISDREASSSPEDRNDRCKKKAAALFDSQAPICPICQVLLRPSELQEHMEQELEQLAQLPSSKNSLLKDAMAPGTPKSLLLSASIKREGESPTASPHSSATDDLHHSDRYQTFLRVRANRQTRLNARIGKMKRRKQDEGQREGSCMAEDDAVDIEHENNNRFEEYEWCGQKRIRATTLLEGGFRGSGFIMCSGKENPDSDADLDVDGDDTLEYGKPQYTEADVIPCTGEEPGEAKEREALRGAVLNGGPPSTRITPEFSKWASDEMPSTSNGESSKQEAMQKTCKNSDIEKITEDSAVTTFEALKARVRELERQLSRGDRYKCLICMDSYSMPLTSIQCWHVHCEECWLRTLGAKKLCPQCNTITAPGDLRRIYL

SEQ ID NO: 7589 - protein, 372 aa, unidentified
MKAGATSMWASCCGLLNEVMGTGAVRGQQSAFAGATGPFRFTPNPEFSTYPPAATEGPNIVCKACGLSFSVFRKKHVCCDCKKDFCSVCSVLQENLRRCSTCHLLQETAFQRPQLMRLKVKDLRQYLILRNIPIDTCREKEDLVDLVLCHHGLGSEDDMDTSSLNSSRSQTSSFFTRSFFSNYTAPSATMSSFQGELMDGDQTSRSGVPAQVQSEITSANTEDDDDDDDEDDDDEEENAEDRNPGLSKERVRASLSDLSSLDDVEGMSVRQLKEILARNFVNYSGCCEKWELVEKVNRLYKENEENQKSYGERLQLQDEEDDSLCRICMDAVIDCVLLECGHMVTCTKCGKRMSECPICRQYVVRAVHVFKS

SEQ ID NO: 7590 - protein, 342 aa, unidentified
MAQVLIVGAGMTGSLCAALLRRQTSGPLYLAVWDKAEDSGGRMTTACSPHNPQCTADLGAQYITCTPHYAKKHQRFYDELLAYGVLRPLSSPIEGMVMKEGDCNFVAPQGISSIIKHYLKESGAEVYFRHRVTQINLRDDKWEVSKQTGSPEQFDLIVLTMPVPEILQLQGDITTLISECQRQQLEAVSYSSRYALGLFYEAGTKIDVPWAGQYITSNPCIRFVSIDNKKRNIESSEIGPSLVIHTTVPFGVTYLEHSIEDVQELVFQQLENILPGLPQPIATKCQKWRHSQVTNAAANCPGQMTLHHKPFLACGGDGFTQSNFDGCITSALCVLEALKNYI

SEQ ID NO: 7591 - protein, 650 aa, unidentified
MASGEHSPGSGAARRPLHSAQAVDVASASNFRAFELLHLHLDLRAEFGPPGPGAGSRGLSGTAVLDLRCLEPEGAAELRLDSHPCLEVTAAALRRERPGSEEPPAEPVSFYTQPFSHYGQALCVSFPQPCRAAERLQVLLTYRVGEGPGVCWLAPEQTAGKKKPFVYTQGQAVLNRAFFPCFDTPAVKYKYSALIEVPDGFTAVMSASTWEKRGPNKFFFQMCQPIPSYLIALAIGDLVSAEVGPRSRVWAEPCLIDAAKEEYNGVIEEFLATGEKLFGPYVWGRYDLLFMPPSFPFGGMENPCLTFVTPCLLAGDRSLADVIIHEISHSWFGNLVTNANWGEFWLNEGFTMYAQRRISTILFGAAYTCLEAATGRALLRQHMDITGEENPLNKLRVKIEPGVDPDDTYNETPYEKGFCFVSYLAHLVGDQDQFDSFLKAYVHEFKFRSILADDFLDFYLEYFPELKKKRVDIIPGFEFDRWLNTPGWPPYLPDLSPGDSLMKPAEELAQLWAAEELDMKAIEAVAISPWKTYQLVYFLDKILQKSPLPPGNVKKLGDTYPSISNARNAELRLRWGQIVLKNDHQEDFWKVKEFLHNQGKQKYTLPLYHAMMGGSEVAQTLAKETFASTASQLHSNVVNYVQQIVAPKGS

SEQ ID NO: 7592 - protein, 937 aa, unidentified; identical to SEQ ID NO: 3767

SEQ ID NO: 7593 - protein, 403 aa, unidentified
MSHRKFSAPRHGSLGFLPRKRSSRHRGKVKSFPKDDPSKPVHLTAFLGYKAGMTHIVREVDRPGSKVNKKEVVEAVTIVETPPMVVVGIVGYVETPRGLRTFKTVFAEHISDECKRRFYKNWHKSKKKAFTKYCKKWQDEDGKKQLEKDFSSMKKYCQVIRVIAHTQMRLLPLRQKKAHLMEIQVNGGTVAEKLDWARERLEQQVPVNQVFGQDEMIDVIGVTKGKGYKGVTSRWHTKKLPRKTHRGLRKVACIGAWHPARVAFSVARAGQKGYHHRTEINKKIYKIGQGYLIKDGKLIKNNASTDYDLSDKSINPLGGFVHYGEVTNDFVMLKGCVVGTKKRVLTLRKSLLVQTKRRALEKIDLKFIDTTSKFGHGRFQTMEEKKAFMGPLKKDRIAKEEGA

SEQ ID NO: 7594 - protein, 115 aa, unidentified
MRYVASYLLAALGGNSSPSAKDIKKILDSVGIEADDDRLNKVISELNGKNIEDVIAQGIGKLASVPAGGAVAVSAAPGSAAPAAGSAPAAAEEKKDEKKEESEESDDDMGFGLFD

SEQ ID NO: 7595 - protein, 631 aa, unidentified; identical to SEQ ID NO: 3778

SEQ ID NO: 7596 - protein, 84 aa, unidentified
MPLARDLLHPSLEEEKKKHKKKRLVQSPNSYFMDVKCPGCYKITTVFSHAQTVVLCVGCSTVLCQPTGGKARLTEGCSFRRKQH

SEQ ID NO: 7597 - protein, 224 aa, unidentified
MSRKIEGFLLLLLFGYEATLGLSSTEDEGEDPWYQKACKCDCQGGPNALWSAGATSLDCIPECPYHKPLGFESGEVTPDQITCSNPEQYVGWYSSWTANKARLNSQGFGCAWLSKFQDSSQWLQIDLKEIKVISGILTQGRCDIDEWMTKYSVQYRTDERLNWIYYKDQTGNNRVFYGNSDRTSTVQNLLRPPIISRFIRLIPLGWHVRIAIRMELLECVSKCA

SEQ ID NO: 7598 - protein, 1441 aa, unidentified
MATAAAAAAVMAPPGCPGSCPNFAVVCSFLERYGPLLDLPELPFPELERVLQAPPPDVGNGEVPKELVELHLKLMRKIGKSVTADRWEKYLIKICQEFNSTWAWEMEKKGYLEMSVECKLALLKYLCECQFDDNLKFKNIINEEDADTMRLQPIGRDKDGLMYWYQLDQDHNVRMYIEEQDDQDGSSWKCIVRNRNELAETLALLKAQIDPVLLKNSSQQDNSSRESPSLEDEETKKEEETPKQEEQKESEKMKSEEQPMDLENRSTANVLEETTVKKEKEDEKELVKLPVIVKLEKPLPENEEKKIIKEESDSFKENVKPIKVEVKECRADPKDTKSSMEKPVAQEPERIEFGGNIKSSHEITEKSTEETEKLKNDQQAKIPLKKREIKLSDDFDSPVKGPLCKSVTPTKEFLKDEIKQEEETCKRISTITALGHEGKQLVNGEVSDERVAPNFKTEPIETKFYETKEESYSPSKDRNIITEGNGTESLNSVITSMKTGELEKETAPLRKDADSSISVLEIHSQKAQIEEPDPPEMETSLDSSEMAKDLSSKTALSSTESCTMKGEEKSPKTKKDKRPPILECLEKLEKSKKTFLDKDAQRLSPIPEEVPKSTLESEKPGSPEAAETSPPSNIIDHCEKLASEKEVVECQSTSTVGGQSVKKVDLETLKEDSEFTKVEMDNLDNAQTSGIEEPSETKGSMQKSKFKYKLVPEEETTASENTEITSERQKEGIKLTIRISSRKKKPDSPPKVLEPENKQEKTEKEEEKTNVGRTLRRSPRISRPTAKVAEIRDQKADKKRGEGEDEVEEESTALQKTDKKEILKKSEKDTNSKVSKVKPKGKVRWTGSRTRGRWKYSSNDESEGSGSEKSSAASEEEEEKESEEAILADDDEPCKKCGLPNHPELILLCDSCDSGYHTACLRPPLMIIPDGEWFCPPCQHKLLCEKLEEQLQDLDVALKKKERAERRKERLVYVGISIENIIPPQEPDFSEDQEEKKKDSKKSKANLLERRSTRTRKCISYRFDEFDEAIDEAIEDDIKEADGGGVGRGKDISTITGHRGKDISTILDEERKENKRPQRAAAARRKKRRRLNDLDSDSNLDEEESEDEFKISDGSQDEFVVSDENPDESEEDPPSNDDSDTDFCSRRLRRHPSRPMRQSRRLRRKTPKKKYSDDDEEEESEENSRDSESDFSDDFSDDFVETRRRRSRRNQKRQINYKEDSESDGSQKSLRRGKEIRRVHKRRLSSSESEESYLSKNSEDDELAKESKRSVRKRGRSTDEYSEADEEEEEEEGKPSRKRLHRIETDEEESCDNAHGDANQPARDSQPRVLPSEQESTKKPYRIESDEEEDFENVGKVGSPLDYSLVDLPSTNGQSPGKAIENLIGKPTEKSQTPKDNSTASASLASNGTSGGQEAGAPEEEEDELLRVTDLVDYVCNSEQL

SEQ ID NO: 7599 - protein, 263 aa, unidentified
MRLGLCVVALVLSWTHLTISSRGIKGKRQRRISAEGSQACAKGCELCSEVNGCLKCSPKLFILLERNDIRQVGVCLPSCPPGYFDARNPDMNKCIKCKIEHCEACFSHNFCTKCKEGLYLHKGRCYPACPEGSSAANGTMECSSPAQCEMSEWSPWGPCSKKQQLCGFRRGSEERTRRVLHAPVGDHAACSDTKETRRCTVRRVPCPEGQKRRKGGQGRRENANRNLARKESKEAGAGSRRRKGQQQQQQQGTVGPLTSAGPA

SEQ ID NO: 7600 - protein, 243 aa, unidentified
MQFRLFSFALIILNCMDYSHCQGNRWRRSKRASYVSNPICKGCLSCSKDNGCSRCQQKLFFFLRREGMRQYGECLHSCPSGYYGHRAPDMNRCARCRIENCDSCFSKDFCTKCKVGFYLHRGRCFDECPDGFAPLEETMECVEGCEVGHWSEWGTCSRNNRTCGFKWGLETRTRQIVKKPVKDTILCPTIAESRRCKMTMRHCPGGKRTPKAKEKRNKKKKRKLIERAQEQHSVFLATDRANQ

SEQ ID NO: 7601 - protein, 272 aa, unidentified
MHLRLISWLFIILNFMEYIGSQNASRGRRQRRMHPNVSQGCQGGCATCSDYNGCLSCKPRLFFALERIGMKQIGVCLSSCPSGYYGTRYPDINKCTKCKADCDTCFNKNFCTKCKSGFYLHLGKCLDNCPEGLEANNHTMECVSIVHCEVSEWNPWSPCTKKGKTCGFKRGTETRVREIIQHPSAKGNLCPPTNETRKCTVQRKKCQKGERGKKGRERKRKKPNKGESKEAIPDSKSLESSKEIPEQRENKQQQKKRKVQDKQKSVSVSTVH

SEQ ID NO: 7602 - protein, 234 aa, unidentified
MRAPLCLLLLVAHAVDMLALNRRKKQVGTGLGGNCTGCIICSEENGCSTCQQRLFLFIRREGIRQYGKCLHDCPPGYFGIRGQEVNRCKKCGATCESCFSQDFCIRCKRQFYLYKGKCLPTCPPGTLAHQNTRECQGECELGPWGGWSPCTHNGKTCGSAWGLESRVREAGRAGHEEAATCQVLSESRKCPIQRPCPGERSPGQKKGRKDRRPRKDRKLDRRLDVRPRQPGLQP

SEQ ID NO: 7603 - protein, 576 aa, unidentified
MIVFGWAVFLASRSLGQGLLLTLEEHIAHFLGTGGAATTMGNSCICRDDSGTDDSVDTQQQQAENSAVPTADTRSQPRDPVRPPRRGRGPHEPRRKKQNVDGLVLDTLAVIRTLVDNDQEPPYSMITLHEMAETDEGWLDVVQSLIRVIPLEDPLGPAVITLLLDECPLPTKDALQKLTEILNLNGEVACQDSSHPAKHRNTSAVLGCLAEKLAGPASIGLLSPGILEYLLQCLKLQSHPTVMLFALIALEKFAQTSENKLTISESSISDRLVTLESWANDPDYLKRQVGFCAQWSLDNLFLKEGRQLTYEKVNLSSIRAMLNSNDVSEYLKISPHGLEARCDASSFESVRCTFCVDAGVWYYEVTVVTSGVMQIGWATRDSKFLNHEGYGIGDDEYSCAYDGCRQLIWYNARSKPHIHPCWKEGDTVGFLLDLNEKQMIFFLNGNQLPPEKQVFSSTVSGFFAAASFMSYQQCEFNFGAKPFKYPPSMKFSTFNDYAFLTAEEKIILPRHRRLALLKQVSIRENCCSLCCDEVADTQLKPCGHSDLCMDCALQLETCPLCRKEIVSRIRQISHIS

SEQ ID NO: 7604 - protein, 710 aa, unidentified
MRGRLCVGRAAAAAAAVAVPLAGGQEGSPGGGRRGSRGTTMVKKRKGRVVIDSDTEDSGSDENLDQELLSLAKRKRSDSEEKEPPVSQPAASSDSETSDSDDEWTFGSNKNKKKGKARKIEKKGTMKKQANKTASSGSSDKDSSAESSAPEEGEVSDSDSNSSSSSSDSDSSSEDEEFHDGYGEDLMGDEEDRARLEQMTEKEREQELFNRIEKREVLKRRFEIKKKLKTAKKKEKKEKKKKQEEEQEKKKLTQIQESQVTSHNKERRSKRDEKLDKKSQAMEELKAEREKRKNRTAELLAKKQPLKTSEVYSDDEEEEEDDKSSEKSDRSSRTSSSDEEEEKEEIPPKSQPVSLPEELNRVRLSRHKLERWCHMPFFAKTVTGCFVRIGIGNHNSKPVYRVAEITGVVETAKVYQLGGTRTNKGLQLRHGNDQRVFRLEFVSNQEFTESEFMKWKEAMFSAGMQLPTLDEINKKELSIKEALNYKFNDQDIEEIVKEKERFRKAPPNYAMKKTQLLKEKAMAEDLGDQDKAKQIQDQLNELEERAEALDRQRTKNISAISYINQRNREWNIVESEKALVAESHNMKNQQMDPFTRRQCKPTIVSNSRDPAVQAAILAQLNAKYGSGVLPDAPKEMSKGQGKDKDLNSKSASDLSEDLFKVHDFDVKIDLQVPSSESKALAITSKAPPAKDGAPRRSLNLEDYKKRRGLI

SEQ ID NO: 7605 - protein, 441 aa, unidentified
MLRKGCCVELLLLLVAAELPLGGGCPRDCVCYPAPMTVSCQAHNFAAIPEGIPVDSERVFLQNNRIGLLQPGHFSPAMVTLWIYSNNITYIHPSTFEGFVHLEELDLGDNRQLRTLAPETFQGLVKLHALYLYKCGLSALPAGVFGGLHSLQYLYLQDNHIEYLQDDIFVDLVNLSHLFLHGNKLWSLGPGTFRGLVNLDRLLLHENQLQWVHHKAFHDLRRLTTLFLFNNSLSELQGECLAPLGALEFLRLNGNPWDCGCRARSLWEWLQRFRGSSSAVPCVSPGLRHGQDLKLLRAEDFRNCTGPASPHQIKSHTLTTTDRAARKEHHSPHGPTRSKGHPHGPRPGHRKPGKNCTNPRNRNQISKAGAGKQAPELPDYAPDYQHKFSFDIMPTARPKRKGKCARRTPIRAPSGVQQASSASSLGASLLAWTLGLAVTLR

SEQ ID NO: 7606 - protein, 420 aa, unidentified
MLPGLRRLLQAPASACLLLMLLALPLAAPSCPMLCTCYSSPPTVSCQANNFSSVPLSLPPSTQRLFLQNNLIRTLRPGTFGSNLLTLWLFSNNLSTIYPGTFRHLQALEELDLGDNRHLRSLEPDTFQGLERLQSLHLYRCQLSSLPGNIFRGLVSLQYLYLQENSLLHLQDDLFADLANLSHLFLHGNRLRLLTEHVFRGLGSLDRLLLHGNRLQGVHRAAFRGLSRLTILYLFNNSLASLPGEALADLPSLEFLRLNANPWACDCRARPLWAWFQRARVSSSDVTCATPPERQGRDLRALREADFQACPPAAPTRPGSRARGNSSSNHLYGVAEAGAPPADPSTLYRDLPAEDSRGRQGGDAPTEDDYWGGYGGEDQRGEQMCPGAACQAPPDSRGPALSAGLPSPLLCLLLLVPHHL

SEQ ID NO: 7607 - protein, 122 aa, unidentified
MKLLTGLVFCSLVLGVSSRSFFSFLGEAFDGARDMWRAYSDMREANYIGSDKYFHARGNYDAAKRGPGGVWAAEAISDARENIQRFFGHGAEDSLADQAANEWGRSGKDPNHFRPAGLPEKY

SEQ ID NO: 7608 - protein, 122 aa, unidentified
MKLLTGLVFCSLVLSVSSRSFFSFLGEAFDGARDMWRAYSDMREANYIGSDKYFHARGNYDAAKRGPGGAWAAEVISNARENIQRLTGRGAEDSLADQAANKWGRSGRDPNHFRPAGLPEKY

SEQ ID NO: 7609 - protein, 130 aa, unidentified
MRLFTGIVFCSLVMGVTSESWRSFFKEALQGVGDMGRAYWDIMISNHQNSNRYLYARGNYDAAQRGPGGVWAAKLISRSRVYLQGLIDCYLFGNSSTVLEDSKSNEKAEEWGRSGKDPDRFRPDGLPKKY

SEQ ID NO: 7610 - protein, 681 aa, unidentified
MSKGILQVHPPICDCPGCRISSPVNRGRLADKRTVALPAARNLKKERTPSFSASDGDSDGSGPTCGRRPGLKQEDGPHIRIMKRRVHTHWDVNISFREASCSQDGNLPTLISSVHRSRHLVMPEHQSRCEFQRGSLEIGLRPAGDLLGKRLGRSPRISSDCFSEKRARSESPQEALLLPRELGPSMAPEDHYRRLVSALSEASTFEDPQRLYHLGLPSHGEDPPWHDPPHHLPSHDLLRVRQEVAAAALRGPSGLEAHLPSSTAGQRRKQGLAQHREGAAPAAAPSFSERELPQPPPLLSPQNAPHVALGPHLRPPFLGVPSALCQTPGYGFLPPAQAEMFAWQQELLRKQNLARLELPADLLRQKELESARPQLLAPETALRPNDGAEELQRRGALLVLNHGAAPLLALPPQGPPGSGPPTPSRDSARRAPRKGGPGPASARPSESKEMTGARLWAQDGSEDEPPKDSDGEDPETAAVGCRGPTPGQAPAGGAGAEGKGLFPGSTLPLGFPYAVSPYFHTGAVGGLSMDGEEAPAPEDVTKWTVDDVCSFVGGLSGCGEYTRVFREQGIDGETLPLLTEEHLLTNMGLKLGPALKIRAQVARRLGRVFYVASFPVALPLQPPTLRAPERELGTGEQPLSPTTATSPYGGGHALAGQTSPKQENGTLALLPGAPDPSQPLC

SEQ ID NO: 7611 - protein, 220 aa, unidentified
MNGFTPDEMSRGGDAAAAVAAVVAAAAAAASAGNGTGAGTGAEVPGAGAVSAAGPPGAAGPGPGQLCCLREDGERCGRAAGNASFSKRIQKSISQKKVKIELDKSARHLYICDYHKNLIQSVRNRRKRKGSDDDGGDSPVQDIDTPEVDLYQLQVNTLRRYKRHFKLPTRPGLNKAQLVEIVGCHFRSIPVNEKDTLTYFIYSVKNDKNKSDLKVDSGVH

SEQ ID NO: 7612 - protein, 198 aa, unidentified
MSFIFEWIYNGFSSVLQFLGLYKKSGKLVFLGLDNAGKTTLLHMLKDDRLGQHVPTLHPTSEELTIAGMTFTTFDLGGHEQARRVWKNYLPAINGIVFLVDCADHSRLVESKVELNALMTDETISNVPILILGNKIDRTDAISEEKLREIFGLYGQTTGKGNVTLKELNARPMEVFMCSVLKRQGYGEGFRWLSQYID

SEQ ID NO: 7613 - protein, 339 aa, unidentified; identical to SEQ ID NO: 3818

SEQ ID NO: 7614 - protein, 763 aa, unidentified
MDHLNEATQGKEHSEMSNNVSDPKGPPAKIARLEQNGSPLGRGRLGSTGAKMQGVPLKHSGHLMKTNLRKGTMLPVFCVVEHYENAIEYDCKEEHAEFVLVRKDMLFNQLIEMALLSLGYSHSSAAQAKGLIQVGKWNPVPLSYVTDAPDATVADMLQDVYHVVTLKIQLHSCPKLEDLPPEQWSHTTVRNALKDLLKDMNQSSLAKECPLSQSMISSIVNSTYYANVSAAKCQEFGRWYKHFKKTKDMMVEMDSLSELSQQGANHVNFGQQPVPGNTAEQPPSPAQLSHGSQPSVRTPLPNLHPGLVSTPISPQLVNQQLVMAQLLNQQYAVNRLLAQQSLNQQYLNHPPPVSRSMNKPLEQQVSTNTEVSSEIYQWVRDELKRAGISQAVFARVAFNRTQGLLSEILRKEEDPKTASQSLLVNLRAMQNFLQLPEAERDRIYQDERERSLNAASAMGPAPLISTPPSRPPQVKTATIATERNGKPENNTMNINASIYDEIQQEMKRAKVSQALFAKVAATKSQGWLCELLRWKEDPSPENRTLWENLSMIRRFLSLPQPERDAIYEQESNAVHHHGDRPPHIIHVPAEQIQQQQQQQQQQQQQQQAPPPPQPQQQPQTGPRLPPRQPTVASPAESDEENRQKTRPRTKISVEALGILQSFIQDVGLYPDEEAIQTLSAQLDLPKYTIIKFFQNQRYYLKHHGKLKDNSGLEVDVAEYKEEELLKDLEESVQDKNTNTLFSVKLEEELSVEGNTDINTDLKD

SEQ ID NO: 7615 - protein, 398 aa, unidentified
MGAKSMRSWCLCQICSCGSDYCPYEIVKQPRHVPEEYKPKQGKIDLGTTYKRDLNSYKVQPVAIVRPLERQVKKGKLDTVPTYKDDYRAWDLHKSELYKPEQTYHPPTVKFGNSTTFQDDFVPQEIKPRQSFKPSSVVKRSTAPFNGITSHRLDYIPHQLELKFERPKEVYKPTDQRFEDLTTHRCDFQGLIGETAKLCRPVHTRVTQNALFEGSTEFRESFQPWEIPPPEVKKVPEYVPPTGSMLLNSTSHLDYVPYQANHVVPIRPVSQKRSNNFPFQGKSIMKEDFPAWESCRQGLIKKQQQIPNPSGKFDGLSTFRSHYVPHELIPTESCKPLNIAFKSSVPFDDVTMYSVEYTPKRQEICPASYPSPPGYIFDNTNSQGHKFFRKIIPAVKAF

SEQ ID NO: 7616 - protein, 590 aa, unidentified
MHLARLVGSCSLLLLLGALSGWAASDDPIEKVIEGINRGLSNAEREVGKALDGINSGITHAGREVEKVFNGLSNMGSHTGKELDKGVQGLNHGMDKVAHEINHGIGQAGKEAEKLGHGVNNAAGQVGKEADKLIHHGVHHGANQAGSEAGKFGQGVDNAAGQAGNEAGRFGQGVHHAAGQAGNEAGRFGQGVHHAAGQAGNEAGRFGQGAHHGLSEGWKETEKFGQGIHHAAGQVGKEAEKFGQGAHHAAGQAGNEAGRFGQGVHHGLSEGWKETEKFGQGVHHTAGQVGKEAEKFGQGAHHAAGQAGNEAGRFGQGAHHAAGQAGNEAGRFGQGVHHGLSEGWKETEKFGQGVHHAASQFGKETEKLGHGVHHGVNEAWKEAEKFGQGVHHAASQVGKEEDRVVQGLHHGVSQAGREAGQFGHDIHHTAGQAGKEGDIAVHGVQPGVHEAGKEAGQFGQGVHHTLEQAGKEADKAVQGFHTGVHQAGKEAEKLGQGVNHAADQAGKEVEKLGQGAHHAAGQAGKELQNAHNGVNQASKEANQLLNGNHQSGSSSHQGGATTTPLASGASVNTPFINLPALWRSVANIMP

SEQ ID NO: 7617 - protein, 264 aa, unidentified
MRTLWMALCALSRLWPGAQAGCAEAGRCCPGRDPACFARGWRLDRVYGTCFCDQACRFTGDCCFDYDRACPARPCFVGEWSPWSGCADQCKPTTRVRRRSVQQEPQNGGAPCPPLEERAGCLEYSTPQGQDCGHTYVPAFITTSAFNKERTRQATSPHWSTHTEDAGYCMEFKTESLTPHCALENWPLTRWMQYLREGYTVCVDCQPPAMNSVSLRCSGDGLDSDGNQTLHWQAIGNPRCQGTWKKVRRVDQCSCPAVHSFIFI

SEQ ID NO: 7618 - protein, 830 aa, unidentified
MGLGLLLPLLLLWTRGTQGSELDPKGQHVCVASSPSAELQCCAGWRQKDQECTIPICEGPDACQKDEVCVKPGLCRCKPGFFGAHCSSRCPGQYWGPDCRESCPCHPHGQCEPATGACQCQADRWGARCEFPCACGPHGRCDPATGVCHCEPGWWSSTCRRPCQCNTAAARCEQATGACVCKPGWWGRRCSFRCNCHGSPCEQDSGRCACRPGWWGPECQQQCECVRGRCSAASGECTCPPGFRGARCELPCPAGSHGVQCAHSCGRCKHNEPCSPDTGSCESCEPGWNGTQCQQPCLPGTFGESCEQQCPHCRHGEACEPDTGHCQRCDPGWLGPRCEDPCPTGTFGEDCGSTCPTCVQGSCDTVTGDCVCSAGYWGPSCNASCPAGFHGNNCSVPCECPEGLCHPVSGSCQPGSGSRDTALIAGSLVPLLLLFLGLACCACCCWAPRSDLKDRPARDGATVSRMKLQVWGTLTSLGSTLPCRSLSSHKLPWVTVSHHDPEVPFNHSFIEPPSAGWATDDSFSSDPESGEADEVPAYCVPPQEGMVPVAQAGSSEASLAAGAFPPPEDASTPFAIPRTSSLARAKRPSVSFAEGTKFAPQSRRSSGELSSPLRKPKRLSRGAQSGPEGREAEESTGPEEAEAPESFPAAASPGDSATGHRRPPLGGRTVAEHVEAIEGSVQESSGPVTTIYMLAGKPRGSEGPVRSVFRHFGSFQKGQAEAKVKRAIPKPPRQALNRKKGSPGLASGSVGQSPNSAPKAGLPGATGPMAVRPEEAVRGLGAGTESSRRAQEPVSGCGSPEQDPQKQAEEERQEEPEYENVVPISRPPEP

SEQ ID NO: 7619 - protein, 617 aa, unidentified
MAEAKTHWLGAALSLIPLIFLISGAEAASFQRNQLLQKEPDLRLENVQKFPSPEMIRALEYIENLRQQAHKEESSPDYNPYQGVSVPLQQKENGDESHLPERDSLSEEDWMRIILEALRQAENEPQSAPKENKPYALNSEKNFPMDMSDDYETQQWPERKLKHMQFPPMYEENSRDNPFKRTNEIVEEQYTPQSLATLESVFQELGKLTGPNNQKRERMDEEQKLYTDDEDDIYKANNIAYEDVVGGEDWNPVEEKIESQTQEEVRDSKENIEKNEQINDEMKRSGQLGIQEEDLRKESKDQLSDDVSKVIAYLKRLVNAAGSGRLQNGQNGERATRLFEKPLDSQSIYQLIEISRNLQIPPEDLIEMLKTGEKPNGSVEPERELDLPVDLDDISEADLDHPDLFQNRMLSKSGYPKTPGRAGTEALPDGLSVEDILNLLGMESAANQKTSYFPNPYNQEKVLPRLPYGAGRSRSNQLPKAAWIPHVENRQMAYENLNDKDQELGEYLARMLVKYPEIINSNQVKRVPGQGSSEDDLQEEEQIEQAIKEHLNQGSSQETDKLAPVSKRFPVGPPKNDDTPNRQYWDEDLLMKVLEYLNQEKAEKGREHIAKRAMENM

SEQ ID NO: 7620 - protein, 468 aa, unidentified
MGFLGTGTWILVLVLPIQAFPKPGGSQDKSLHNRELSAERPLNEQIAEAEEDKIKKTYPPENKPGQSNYSFVDNLNLLKAITEKEKIEKERQSIRSSPLDNKLNVEDVDSTKNRKLIDDYDSTKSGLDHKFQDDPDGLHQLDGTPLTAEDIVHKIAARIYEENDRAVFDKIVSKLLNLGLITESQAHTLEDEVAEVLQKLISKEANNYEEDPNKPTSWTENQAGKIPEKVTPMAAIQDGLAKGENDETVSNTLTLTNGLERRTKTYSEDNFEELQYFPNFYALLKSIDSEKEAKEKETLITIMKTLIDFVKMMVKYGTISPEEGVSYLENLDEMIALQTKNKLEKNATDNISKLFPAPSEKSHEETDSTKEEAAKMEKEYGSLKDSTKDDNSNPGGKTDEPKGKTEAYLEAIRKNIEWLKKHDKKGNKEDYDLSKMRDFINKQADAYVEKGILDKEEAEAIKRIYSSL

SEQ ID NO: 7621 - protein, 212 aa, unidentified
MVSRMVSTMLSGLLFWLASGWTPAFAYSPRTPDRVSEADIQRLLHGVMEQLGIARPRVEYPAHQAMNLVGPQSIEGGAHEGLQHLGPFGNIPNIVAELTGDNIPKDFSEDQGYPDPPNPCPVGKTADDGCLENTPDTAEFSREFQLHQHLFDPEHDYPGLGKWNKKLLYEKMKGGERRKRRSVNPYLQGQRLDNVVAKKSVPHFSDEDKDPE

SEQ ID NO: 7622 - protein, 91 aa, unidentified
MKLAVTLTLVTLALCCSSASAEICPSFQRVIETLLMDTPSSYEAAMELFSPDQDMREAGAQLKKLVDTLPQKPRESIIKLMEKIAQSSLCN

SEQ ID NO: 7623 - protein, 95 aa, unidentified
MKGSRALLLVALTLFCICRMATGEDNDEFFMDFLQTLLVGTPEELYEGTLGKYNVNEDAKAAMTELKSCIDGLQPMHKAELVKLLVQVLGSQDGA

SEQ ID NO: 7624 - protein, 90 aa, unidentified
MRLSVCLLLLTLALCCYRANAVVCQALGSEITGFLLAGKPVFKFQLAKFKAPLEAVAAKMEVKKCVDTMAYEKRVLITKTLGKIAEKCDR

SEQ ID NO: 7625 - protein, 90 aa, unidentified
MKLSVCLLLVTLALCCYQANAEFCPALVSELLDFFFISEPLFKLSLAKFDAPPEAVAAKLGVKRCTDQMSLQKRSLIAEVLVKILKKCSV

SEQ ID NO: 7626 - protein, 83 aa, unidentified
MRLSVCLLMVSLALCCYQAHALVCPAVASEITVFLFLSDAAVNLQVAKLNPPPEALAAKLEVKHCTDQISFKKRLSLKKSWWK

SEQ ID NO: 7627 - protein, 95 aa, unidentified
MKLLMVLMLAALLLHCYADSGCKLLEDMVEKTINSDISIPEYKELLQEFIDSDAAAEAMGKFKQCFLNQSHRTLKNFGLMMHTVYDSIWCNMKSN

SEQ ID NO: 7628 - protein, 93 aa, unidentified
MKLLMVLMLAALSQHCYAGSGCPLLENVISKTINPQVSKTEYKELLQEFIDDNATTNAIDELKECFLNQTDETLSNVEVFMQLIYDSSLCDLF

SEQ ID NO: 7629 - protein, 96 aa, unidentified
MRVTSATCALLLALICSVQLGDACLDIDKLLANVVFDVSQDLLKEELARYNPSPLTEESFLNVQQCFANVSVTERFAHSVVIKKILQSNDCIEAAF

SEQ ID NO: 7630 - protein, 104 aa, unidentified
MKLAALLGLCVALSCSSAAAFLVGSAKPVAQPVAALESAAEAGAGTLANPLGTLNPLKLLLSSLGIPVNHLIEGSQKCVAELGPQAVGAVKALKALLGALTVFG

SEQ ID NO: 7631 - protein, 93 aa, unidentified
MKLVTIFLLVTISLCSYSATAFLINKVPLPVDKLAPLPLDNILPFMDPLKLLLKTLGISVEHLVEGLRKCVNELGPEASEAVKKLLEALSHLV

SEQ ID NO: 7632 - protein, 218 aa, unidentified; identical to SEQ ID NO: 3841

SEQ ID NO: 7633 - protein, 215 aa, unidentified; identical to SEQ ID NO: 3845

SEQ ID NO: 7634 - protein, 452 aa, unidentified
MELALRRSPVPRWLLLLPLLLGLNAGAVIDWPTEEGKEVWDYVTVRKDAYMFWWLYYATNSCKNFSELPLVMWLQGGPGGSSTGFGNFEEIGPLDSDLKPRKTTWLQAASLLFVDNPVGTGFSYVNGSGAYAKDLAMVASDMMVLLKTFFSCHKEFQTVPFYIFSESYGGKMAAGIGLELYKAIQRGTIKCNFAGVALGDSWISPVDSVLSWGPYLYSMSLLEDKGLAEVSKVAEQVLNAVNKGLYREATELWGKAEMIIEQNTDGVNFYNILTKSTPTSTMESSLEFTQSHLVCLCQRHVRHLQRDALSQLMNGPIRKKLKIIPEDQSWGGQATNVFVNMEEDFMKPVISIVDELLEAGINVTVYNGQLDLIVDTMGQEAWVRKLKWPELPKFSQLKWKALYSDPKSLETSAFVKSYKNLAFYWILKAGHMVPSDQGDMALKMMRLVTQQE

SEQ ID NO: 7635 - protein, 98 aa, unidentified
MKLMVLVFTIGLTLLLGVQAMPANRLSCYRKILKDHNCHNLPEGVADLTQIDVNVQDHFWDGKGCEMICYCNFSELLCCPKDVFFGPKISFVIPCNNQ

SEQ ID NO: 7636 - protein, 121 aa, unidentified
MAPRPLLLLLLLLGGSAARPAPPRARRHSDGTFTSELSRLREGARLQRLLQGLVGKRSEQDAENSMAWTRLSAGLLCPSGSNMPILQAWMPLDGTWSPWLPPGPMVSEPAGAAAEGTLRPR

SEQ ID NO: 7637 - protein, 988 aa, unidentified
MGAAAVRWHLCVLLALGTRGRLAGGSGLPGSVDVDECSEGTDDCHIDAICQNTPKSYKCLCKPGYKGEGKQCEDIDECENDYYNGGCVHECINIPGNYRCTCFDGFMLAHDGHNCLDVDECQDNNGGCQQICVNAMGSYECQCHSGFFLSDNQHTCIHRSNEGMNCMNKDHGCAHICRETPKGGVACDCRPGFDLAQNQKDCTLTCNYGNGGCQHSCEDTDTGPTCGCHQKYALHSDGRTCIETCAVNNGGCDRTCKDTATGVRCSCPVGFTLQPDGKTCKDINECLVNNGGCDHFCRNTVGSFECGCRKGYKLLTDERTCQDIDECSFERTCDHICINSPGSFQCLCHRGYILYGTTHCGDVDECSMSNGSCDQGCVNTKGSYECVCPPGRRLHWNGKDCVETGKCLSRAKTSPRAQLSCSKAGGVESCFLSCPAHTLFVPDSENSYVLSCGVPGPQGKALQKRNGTSSGLGPSCSDAPTTPIKQKARFKIRDAKCHLRPHSQARAKETARQPLLDHCHVTFVTLKCDSSKKRRRGRKSPSKEVSHITAEFEIETKMEEASDTCEADCLRKRAEQSLQAAIKTLRKSIGRQQFYVQVSGTEYEVAQRPAKALEGQGACGAGQVLQDSKCVACGPGTHFGGELGQCVSCMPGTYQDMEGQLSCTPCPSSDGLGLPGARNVSECGGQCSPGFFSADGFKPCQACPVGTYQPEPGRTGCFPCGGGLLTKHEGTTSFQDCEAKVHCSPGHHYNTTTHRCIRCPVGTYQPEFGQNHCITCPGNTSTDFDGSTNVTHCKNQHCGGELGDYTGYIESPNYPGDYPANAECVWHIAPPPKRRILIVVPEIFLPIEDECGDVLVMRKSASPTSITTYETCQTYERPIAFTSRSRKLWIQFKSNEGNSGKGFQVPYVTYDEDYQQLIEDIVRDGRLYASENHQEILKDKKLIKALFDVLAHPQNYFKYTAQESKEMFPRSFIKLLRSKVSRFLRPYK

SEQ ID NO: 7638 - protein, 999 aa, unidentified
MGVAGRNRPGAAWAVLLLLLLLPPLLLLAGAVPPGRGRAAGPQEDVDECAQGLDDCHADALCQNTPTSYKCSCKPGYQGEGRQCEDIDECGNELNGGCVHDCLNIPGNYRCTCFDGFMLAHDGHNCLDVDECLENNGGCQHTCVNVMGSYECCCKEGFFLSDNQHTCIHRSEEGLSCMNKDHGCSHICKEAPRGSVACECRPGFELAKNQRDCILTCNHGNGGCQHSCDDTADGPECSCHPQYKMHTDGRSCLEREDTVLEVTESNTTSVVDGDKRVKRRLLMETCAVNNGGCDRTCKDTSTGVHCSCPVGFTLQLDGKTCKDIDECQTRNGGCDHFCKNIVGSFDCGCKKGFKLLTDEKSCQDVDECSLDRTCDHSCINHPGTFACACNRGYTLYGFTHCGDTNECSINNGGCQQVCVNTVGSYECQCHPGYKLHWNKKDCVEVKGLLPTSVSPRVSLHCGKSGGGDGCFLRCHSGIHLSSDVTTIRTSVTFKLNEGKCSLKNAELFPEGLRPALPEKHSSVKESFRYVNLTCSSGKQVPGAPGRPSTPKEMFITVEFELETNQKEVTASCDLSCIVKRTEKRLRKAIRTLRKAVHREQFHLQLSGMNLDVAKKPPRTSERQAESCGVGQGHAENQCVSCRAGTYYDGARERCILCPNGTFQNEEGQMTCEPCPRPGNSGALKTPEAWNMSECGGLCQPGEYSADGFAPCQLCALGTFQPEAGRTSCFPCGGGLATKHQGATSFQDCETRVQCSPGHFYNTTTHRCIRCPVGTYQPEFGKNNCVSCPGNTTTDFDGSTNITQCKNRRCGGELGDFTGYIESPNYPGNYPANTECTWTINPPPKRRILIVVPEIFLPIEDDCGDYLVMRKTSSSNSVTTYETCQTYERPIAFTSRSKKLWIQFKSNEGNSARGFQVPYVTYDEDYQELIEDIVRDGRLYASENHQEILKDKKLIKALFDVLAHPQNYFKYTAQESREMFPRSFIRLLRSKVSRFLRPYK

SEQ ID NO: 7639 - protein, 993 aa, unidentified
MGSGRVPGLCLLVLLVHARAAQYSKAAQDVDECVEGTDNCHIDAICQNTPRSYKCICKSGYTGDGKHCKDVDECEREDNAGCVHDCVNIPGNYRCTCYDGFHLAHDGHNCLDVDECAEGNGGCQQSCVNMMGSYECHCREGFFLSDNQHTCIQRPEEGMNCMNKNHGCAHICRETPKGGIACECRPGFELTKNQRDCKLTCNYGNGGCQHTCDDTEQGPRCGCHIKFVLHTDGKTCIETCAVNNGGCDSKCHDAATGVHCTCPVGFMLQPDRKTCKDIDECRLNNGGCDHICRNTVGSFECSCKKGYKLLINERNCQDIDECSFDRTCDHICVNTPGSFQCLCHRGYLLYGITHCGDVDECSINRGGCRFGCINTPGSYQCTCPAGQGRLHWNGKDCTEPLKCQGSPGASKAMLSCNRSGKKDTCALTCPSRARFLPESENGFTVSCGTPSPRAAPARAGHNGNSTNSNHCHEAAVLSIKQRASFKIKDAKCRLHLRNKGKTEEAGRITGPGGAPCSECQVTFIHLKCDSSRKGKGRRARTPPGKEVTRLTLELEAEVRAEETTASCGLPCLRQRMERRLKGSLKMLRKSINQDRFLLRLAGLDYELAHKPGLVAGERAEPMESCRPGQHRAGTKCVSCPQGTYYHGQTEQCVPCPAGTFQEREGQLSCDLCPGSDAHGPLGATNVTTCAGQCPPGQHSVDGFKPCQPCPRGTYQPEAGRTLCFPCGGGLTTKHEGAISFQDCDTKVQCSPGHYYNTSIHRCIRCAMGSYQPDFRQNFCSRCPGNTSTDFDGSTSVAQCKNRQCGGELGEFTGYIESPNYPGNYPAGVECIWNINPPPKRKILIVVPEIFLPSEDECGDVLVMRKNSSPSSITTYETCQTYERPIAFTARSRKLWINFKTSEANSARGFQIPYVTYDEDYEQLVEDIVRDGRLYASENHQEILKDKKLIKAFFEVLAHPQNYFKYTEKHKEMLPKSFIKLLRSKVSSFLRPYK

SEQ ID NO: 7640 - protein, 310 aa, unidentified; identical to SEQ ID NO: 3859

SEQ ID NO: 7641 - protein, 211 aa, unidentified
MAVVPLLLLGGLWSAVGASSLGVVTCGSVVKLLNTRHNVRLHSHDVRYGSGSGQQSVTGVTSVDDSNSYWRIRGKSATVCERGTPIKCGQPIRLTHVNTGRNLHSHHFTSPLSGNQEVSAFGEEGEGDYLDDWTVLCNGPYWVRDGEVRFKHSSTEVLLSVTGEQYGRPISGQKEVHGMAQPSQNNYWKAMEGIFMKPSELLKAEAHHAEL

SEQ ID NO: 7642 - protein, 221 aa, unidentified
MWSAGRGGAAWPVLLGLLLALLVPGGGAAKTGAELVTCGSVLKLLNTHHRVRLHSHDIKYGSGSGQQSVTGVEASDDANSYWRIRGGSEGGCPRGSPVRCGQAVRLTHVLTGKNLHTHHFPSPLSNNQEVSAFGEDGEGDDLDLWTVRCSGQHWEREAAVRFQHVGTSVFLSVTGEQYGSPIRGQHEVHGMPSANTHNTWKAMEGIFIKPSVEPSAGHDEL

SEQ ID NO: 7643 - protein, 362 aa, unidentified
MVWPWVAMASRWGPLIGLAPCCLWLLGAVLLMDASARPANHSSTRERVANREENEILPPDHLNGVKLEMDGHLNRGFHQEVFLGKDLGGFDEDAEPRRSRRKLMVIFSKVDVNTDRKISAKEMQRWIMEKTAEHFQEAMEESKTHFRAVDPDGDGHVSWDEYKVKFLASKGHSEKEVADAIRLNEELKVDEETQEVLENLKDRWYQADSPPADLLLTEEEFLSFLHPEHSRGMLRFMVKEIVRDLDQDGDKQLSVPEFISLPVGTVENQQGQDIDDNWVKDRKKEFEELIDSNHDGIVTAEELESYMDPMNEYNALNEAKQMIAVADENQNHHLEPEEVLKYSEFFTGSKLVDYARSVHEEF

SEQ ID NO: 7644 - protein, 108 aa, unidentified
MTPSRLPWLLSWVSATAWRAARSPLLCHSLRKTSSSQGGKSELVKQSLKKPKLPEGRFDAPEDSHLEKEPLEKFPDDVNPVTKEKGGPRGPEPTRYGDWERKGRCIDF

SEQ ID NO: 7645 - protein, 280 aa, unidentified
MAAVVALSLRRRLPATTLGGACLQASRGAQTAAATAPRIKKFAIYRWDPDKAGDKPHMQTYEVDLNKCGPMVLDALIKIKNEVDSTLTFRRSCREGICGSCAMNINGGNTLACTRRIDTNLNKVSKIYPLPHMYVIKDLVPDLSNFYAQYKSIEPYLKKKDESQEGKQQYLQSIEEREKLDGLYECILCACCSTSCPSYWWNGDKYLGPAVLMQAYRWMIDSRDDFTEERLAKLQDPFSLYRCHTIMNCTRTCPKGLNPGKAIAEIKKMMATYKEKKASV

SEQ ID NO: 7646 - protein, 159 aa, unidentified; identical to SEQ ID NO: 3863

SEQ ID NO: 7647 - protein, 400 aa, unidentified
MSGRVGDLSPKQAETLAKFRENVQDVLPALPNPDDYFLLRWLRARNFDLQKSEALLRKYMEFRKTMDIDHILDWQPPEVIQKYMPGGLCGYDRDGCPVWYDIIGPLDPKGLLFSVTKQDLLKTKMRDCERILHECDLQTERLGKKIETIVMIFDCEGLGLKHFWKPLVEVYQEFFGLLEENYPETLKFMLIVKATKLFPVGYNLMKPFLSEDTRRKIIVLGNNWKEGLLKLISPEELPAQFGGTLTDPDGNPKCLTKINYGGEIPKSMYVRDQVKTQYEHSVQINRGSSHQVEYEILFPGCVLRWQFSSDGADIGFGVFLKTKMGERQRAGEMTDVLPSQRYNAHMVPEDGNLTCSEAGVYVLRFDNTYSFVHAKKVSFTVEVLLPDEGMQKYDKELTPV

SEQ ID NO: 7648 - protein, 2357 aa, unidentified
MQPPPQTVPSGMAGPPPAGNPRSVFWASSPYRRRANNNAAVAPTTCPLQPVTDPFAFSRQALQSTPLGSSSKSSPPVLQGPAPAGFSQHPGLLVPHTHARDSSQGPCEPLPGPLTQPRAHASPFSGALTPSAPPGPEMNRSAEVGPSSEPEVQTLPYLPHYIPGVDPETSHGGHPHGNMPGLDRPLSRQNPHDGVVTPAASPSLPQPGLQMPGQWGPVQGGPQPSGQHRSPCPEGPVPSGVPCATSVPHFPTPSILHQGPGHEQHSPLVAPPAALPSDGRDEVSHLQSGSHLANNSDPESTFRQNPRIVNHWASPELRQNPGVKNEHRPASALVNPLARGDSPENRTHHPLGAGAGSGCAPLEADSGASGALAMFFQGGETENEENLSSEKAGLSGQADFDDFCSSPGLGRPPAPTHVGAGSLCQALLPGPSNEAAGDVWGDTASTGVPDASGSQYENVENLEFVQNQEVLPSEPLNLDPSSPSDQFRYGPLPGPAVPRHGAVCHTGAPDATLHTVHPDSVSSSYSSRSHGRLSGSARPQELVGTFIQQEVGKPEDEASGSFFKQIDSSPVGGETDETTVSQNYRGSVSQPSTPSPPKPTGIFQTSANSSFEPVKSHLVGVKPFEADRANVVGEVRETCVRQKQCRPAAALPDASPGNLEQPPDNMETLCAPQVCPLPLNSTTEAVHMLPHAGAPPLDTVYPAPEKRPSARTQGPVKCESPATTLWAQSELPDFGGNVLLAPAAPALYVCAKPQPPVVQPPEEAMSGQQSRNPSSAAPVQSRGGIGASENLENPPKMGEEEALQSQASSGYASLLSSPPTESLQNPPVLIAQPDHSYNLAQPINFSVSLSNSHEKNQSWREALVGDRPAVSSWALGGDSGENTSLSGIPTSSVLSLSLPSSVAQSNFPQGSGASEMVSNQPANLLVQPPSQPVPENLVPESQKDRKAGSALPGFANSPAGSTSVVLVPPAHGTLVPDGNKANHSSHQEDTYGALDFTLSRTLENPVNVYNPSHSDSLASQQSVASHPRQSGPGAPNLDRFYQQVTKDAQGQPGLERAQQELVPPQQQASPPQLPKAMFSELSNPESLPAQGQAQNSAQSPASLVLVDAGQQLPPRPPQSSSVSLVSSGSGQAAVPSEQPWPQPVPALAPGPPPQDLAAYYYYRPLYDAYQPQYSLPYPPEPGAASLYYQDVYSLYEPRYRPYDGAASAYAQNYRYPEPERPSSRASHSSERPPPRQGYPEGYYSSKSGWSSQSDYYASYYSSQYDYGDPGHWDRYHYSARVRDPRTYDRRYWCDAEYDAYRREHSAFGDRPEKRDNNWRYDPRFTGSFDDDPDPHRDPYGEEVDRRSVHSEHSARSLHSAHSLASRRSSLSSHSHQSQIYRSHNVAAGSYEAPLPPGSFHGDFAYGTYRSNFSSGPGFPEYGYPADTVWPAMEQVSSRPTSPEKFSVPHVCARFGPGGQLIKVIPNLPSEGQPALVEVHSMEALLQHTSEQEEMRAFPGPLAKDDTHKVDVINFAQNKAMKCLQNENLIDKESASLLWNFIVLLCRQNGTVVGTDIAELLLRDHRTVWLPGKSPNEANLIDFTNEAVEQVEEEESGEAQLSFLTGGPAAAASSLERETERFRELLLYGRKKDALESAMKNGLWGHALLLASKMDSRTHARVMTRFANSLPINDPLQTVYQLMSGRMPAASTCCGDEKWGDWRPHLAMVLSNLNNNMDVESRTMATMGDTLASRGLLDAAHFCYLMAQAGFGVYTKKTTKLVLIGSNHSLPFLKFATNEAIQRTEAYEYAQSLGAETCPLPSFQVFKFIYSCRLAEMGLATQAFHYCEAIAKSILTQPHLYSPVLISQLVQMASQLRLFDPQLKEKPEEESLAAPTWLVHLQQVERQIKEGAGVWHQDGALPQQCPGTPSSEMEQLDRPGLSQPGALGIANPLLAVPAPSPEHSSPSVRLLPSAPQTLPDGPLASPARVPMFPVPLPPGPLEPGPGCVTPGPALGFLEPSGPGLPPGVPPLQERRHLLQEARSPDPGIVPQEAPVGNSLSELSEENFDGKFANLTPSRTVPDSEAPPGWDRADSGPTQPPLSLSPAPETKRPGQAAKKETKEPKKGESWFFRWLPGKKKTEAYLPDDKNKSIVWDEKKNQWVNLNEPEEEKKAPPPPPTSMPKTVQAAPPALPGPPGAPVNMYSRRAAGTRARYVDVLNPSGTQRSEPALAPADFVAPLAPLPIPSNLFVPTPDAEEPQLPDGTGREGPAAARGLANPEPAPEPKVLSSAASLPGSELPSSRPEGSQGGELSRCSSMSSLSREVSQHFNQAPGDLPAAGGPPSGAMPFYNPAQLAQACATSGSSRLGRIGQRKHLVLN

SEQ ID NO: 7649 - protein, 1060 aa, unidentified
MELWAPQRLPQTRGKATAPSKDPDRGFRRDGHHRPVPHSWHNGERFHQWQDNRGSPQPQQEPRADHQQQPHYASRPGDWHQPVSGVDYYEGGYRNQLYSRPGYENSYQSYQSPTMREEYAYGSYYYHGHPQWLQEERVPRQRSPYIWHEDYREQKYLDEHHYENQHSPFGTNSETHFQSNSRNPCKDSPASNSGQEWPGELFPGSLLAEAQKNKPSLASESNLLQQRESGLSSSSYELSQYIRDAPERDDPPASAAWSPVQADVSSAGPKAPMKFYIPHVPVSFGPGGQLVHVGPSSPTDGQAALVELHSMEVILNDSEEQEEMRSFSGPLIREDVHKVDIMTFCQQKAAQSCKSETLGSRDSALLWQLLVLLCRQNGSMVGSDIAELLMQDCKKLEKYKRQPPVANLINLTDEDWPVLSSGTPNLLTGEIPPSVETPAQIVEKFTRLLYYGRKKEALEWAMKNHLWGHALFLSSKMDPQTYSWVMSGFTSTLALNDPLQTLFQLMSGRIPQAATCCGEKQWGDWRPHLAVILSNQAGDPELYQRAIVAIGDTLAGKGLVEAAHFCYLMAHVPFGHYTVKTDHLVLLGSSHSQEFLKFATTEAIQRTEIFEYCQMLGRPKSFIPSFQVYKLLYASRLADYGLVSQALHYCEAIGAAVLSQGESSHPVLLVELIKLAEKLKLSDPLVLERRSGDRDLEPDWLAQLRRQLEQKVAGDIGDPHPTRSDISGAGGTTTENTFYQDFSGCQGYSEAPGYRSALWLTPEQTCLLQPSPQQPFPLQPGSYPAGGGAGQTGTPRPFYSVPETHLPGTGSSVAVTEATGGTVWEEMLQTHLGPGENTVSQETSQPPDGQEVISKPQTPLAARPRSISESSASSAKEDEKESSDEADKNSPRNTAQRGKLGDGKEHTKSSGFGWFSWFRSKPTKNASPAGDEDSSDSPDSEETPRASSPHQAGLGLSLTPSPESPPLPDVSAFSRGRGGGEGRGSASSGGAAAGAGVGGLSGPESVSFELCSNPGVLLPPPALKGAVPLYNPSQVPQLPTATSLNRPNRLAQRRYPTQPC

SEQ ID NO: 7650 - protein, 303 aa, unidentified; identical to SEQ ID NO: 3872

SEQ ID NO: 7651 - protein, 1220 aa, unidentified
MKLKEVDRTAMQAWSPAQNHPIYLATGTSAQQLDATFSTNASLEIFELDLSDPSLDMKSCATFSSSHRYHKLIWGPYKMDSKGDVSGVLIAGGENGNIILYDPSKIIAGDKEVVIAQNDKHTGPVRALDVNIFQTNLVASGANESEIYIWDLNNFATPMTPGAKTQPPEDISCIAWNRQVQHILASASPSGRATVWDLRKNEPIIKVSDHSNRMHCSGLAWHPDVATQMVLASEDDRLPVIQMWDLRFASSPLRVLENHARGILAIAWSMADPELLLSCGKDAKILCSNPNTGEVLYELPTNTQWCFDIQWCPRNPAVLSAASFDGRISVYSIMGGSTDGLRQKQVDKLSSSFGNLDPFGTGQPLPPLQIPQQTAQHSIVLPLKKPPKWIRRPVGASFSFGGKLVTFENVRMPSHQGAEQQQQQHHVFISQVVTEKEFLSRSDQLQQAVQSQGFINYCQKKIDASQTEFEKNVWSFLKVNFEDDSRGKYLELLGYRKEDLGKKIALALNKVDGANVALKDSDQVAQSDGEESPAAEEQLLGEHIKEEKEESEFLPSSGGTFNISVSGDIDGLITQALLTGNFESAVDLCLHDNRMADAIILAIAGGQELLARTQKKYFAKSQSKITRLITAVVMKNWKEIVESCDLKNWREALAAVLTYAKPDEFSALCDLLGTRLENEGDSLLQTQACLCYICAGNVEKLVACWTKAQDGSHPLSLQDLIEKVVILRKAVQLTQAMDTSTVGVLLAAKMSQYANLLAAQGSIAAALAFLPDNTNQPNIMQLRDRLCRAQGEPVAGHESPKIPYEKQQLPKGRPGPVAGHHQMPRVQTQQYYPHGENPPPPGFIMHGNVNPNAAGQLPTSPGHMHTQVPPYPQPQPYQPAQPYPFGTGGSAMYRPQQPVAPPTSNAYPNTPYISSASSYTGQSQLYAAQHQASSPTSSPATSFPPPPSSGASFQHGGPGAPPSSSAYALPPGTTGTLPAASELPASQRTGPQNGWNDPPALNRVPKKKKMPENFMPPVPITSPIMNPLGDPQSQMLQQQPSAPVPLSSQSSFPQPHLPGGQPFHGVQQPLGQTGMPPSFSKPNIEGAPGAPIGNTFQHVQSLPTKKITKKPIPDEHLILKTTFEDLIQRCLSSATDPQTKRKLDDASKRLEFLYDKLREQTLSPTITSGLHNIARSIETRNYSEGLTMHTHIVSTSNFSETSAFMPVLKVVLTQANKLGV

SEQ ID NO: 7652 - protein, 854 aa, unidentified
MASEGPREPESEGIKLSADVKPFVPRFAGLNVAWLESSEACVFPSSAATYYPFVQEPPVTEQKIYTEDMAFGASTFPPQYLSSEITLHPYAYSPYTLDSTQNVYSVPGSQYLYNQPSCYRGFQTVKHRNENTCPLPQEMKALFKKKTYDEKKTYDQQKFDSERADGTISSEIKSARGSHHLSIYAENSLKSDGYHKRTDRKSRIIAKNVSTSKPEFEFTTLDFPELQGAENNMSEIQKQPKWGPVHSVSTDISLLREVVKPAAVLSKGEIVVKNNPNESVTANAATNSPSCTRELSWTPMGYVVRQTLSTELSAAPKNVTSMINLKTIASSADPKNVSIPSSEALSSDPSYNKEKHIIHPTQKSKASQGSDLEQNEASRKNKKKKEKSTSKYEVLTVQEPPRIEDAEEFPNLAVASERRDRIETPKFQSKQQPQDNFKNNVKKSQLPVQLDLGGMLTALEKKQHSQHAKQSSKPVVVSVGAVPVLSKECASGERGRRMSQMKTPHNPLDSSAPLMKKGKQREIPKAKKPTSLKKIILKERQERKQRLQENAVSPAFTSDDTQDGESGGDDQFPEQAELSGPEGMDELISTPSVEDKSEEPPGTELQRDTEASHLAPNHTTFPKIHSRRFRDYCSQMLSKEVDACVTDLLKELVRFQDRMYQKDPVKAKTKRRLVLGLREVLKHLKLKKLKCVIISPNCEKIQSKGGLDDTLHTIIDYACEQNIPFVFALNRKALGRSLNKAVPVSVVGIFSYDGAQDQFHKMVELTVAARQAYKTMLENVQQELVGEPRPQAPPSLPTQGPSCPAEDGPPALKEKEEPHYIEIWKKHLEAYSGCTLELEESLEASTSQMMNLNL

SEQ ID NO: 7653 - protein, 248 aa, unidentified; identical to SEQ ID NO: 3879

SEQ ID NO: 7654 - protein, 794 aa, unidentified; identical to SEQ ID NO: 3880

SEQ ID NO: 7655 - protein, 590 aa, unidentified
MGRARPGQRGPPSPGPAAQPPAPPRRRARSLALLGALLAAAAAAAVRVCARHAEAQAAARQELALKTLGTDGLFLFSSLDTDGDMYISPEEFKPIAEKLTGSCSVTQTGVQWCSHSSLQPQLPWLNUSSCLSLLRSTPAASCEEEELPPDPSEETLTIEARFQPLLPETMTKSKDGFLGVSRLALSGLRNWTAAASPSAVFATRHFQPFLPPPGQELGEPWWIIPSELSMFTGYLSNNRFYPPPPKGKEVIIHRLLSMFHPRPFVKTRFAPQGAVACLTAISDFYYTVMFRIHAEFQLSEPPDFPFWFSPAQFTGHIILSKDATHVRDFRLFVPNHRSLNVDMEWLYGASESSNMEVDIGYIPQMELEATGPSVPSVILDEDGSMIDSHLPSGEPLQFVFEEIKWQQELSWEEAARRLEVAMYPFKKVSYLPFTEAFDRAKAENKLVHSILLWGALDDQSCUGSGRTLRETVLESSPILTLLNESFISTWSLVKELEELQNNQENSSHQKLAGLHLEKYSFPVEMMICLPNGTVVHHINANYFLDITSVKPEEIESNLFSFSSTFEDPSTATYMQFLKEGLRRGLPLLQP

SEQ ID NO: 7656 - protein, 381 aa, unidentified; identical to SEQ ID NO: 3885

SEQ ID NO: 7657 - protein, 771 aa, unidentified [sequence omitted]

SEQ ID NO: 7658 - protein, 751 aa, unidentified
MAFRTICVLVGVFICSICVKGSSQPQARVYLTFDELRETKTSEYFSLSHHPLDYRILLMDEDQDRIYVGSKDHILSLNINNISQEALSVFWPASTIKVEECKMAGKDPTHGCGNFVRVIQTFNRTHLYVCGSGAFSPVCTYLNRGRRSEDQVFMIDSKCESGKGRCSFNPNVNTVSVMINEELFSGMYIDFMGTDAAIFRSLTKRNAVRTDQHNSKWLSEPMFVDAHVIPDGTDPNDAKVYFFFKEKLTDNNRSTKQIHSMIARICPNDTGGLRSLVNKWTTFLKARLVCSVTDEDGPETHFDELEDVFLLETDNPRTTLVYGIFTTSSSVFKGSAVCVYHLSDIQTVFNGPFAHKEGPNHQLISYQGRIPYPRPGTCPGGAFTPNMRTTKEFPDDVVTFIRNHPLMYNSIYPIHKRPLIVRIGTDYKYTKIAVDRVNAADGRYHVLFLGTDRGTVQKVVVLPTNNSVSGELILEELEVFKNHAPITTMKISSKKQQLYVSSNEGVSQVSLHRCHIYGTACADCCLARDPYCAWDGHSCSRFYPTGKRRSRRQDVRHGNPLTQCRGFNLKAYRNAAEIVQYGVKNNTTFLECAPKSPQASIKWLLQKDKDRRKEVKLNERIIATSQGLLIRSVQGSDQGLYHCIATENSFKQTIAKINFKVLDSEMVAVVTDKWSPWTWASSVRALPFHPKDIMGAFSHSEMQMINQYCKDTRQQHQQGDESQKMRGDYGKLKALINSRKSRNRRNQLPES

SEQ ID NO: 7659 - protein, 775 aa, unidentified
MASAGHIITLLLWGYLLELWTGGHTADTTHPRLRLSHKELLNLNRTSIFHSPFGFLDLHTMLLDEYQERLFVGGRDLVYSLSLERISDGYKEIHWPSTALKMEECIMKGKDAGECANYVRVLHHYNRTHLLTCGTGAFDPVCAFIRVGYHLEDPLFHLESPRSERGRGRCPFDPSSSFISTLIGSELFAGLYSDYWSRDAAIFRSMGRLAHIRTEHDDERLLKEPKFVGSYMIPDNEDRDDNKVYFFFTEKALEAENNAHAIYTRVGRLCVNDVGGQRILVNKWSTFLKARLVCSVPGMNGIDTYFDELEDVFLLPTRDHKNPVIFGLFNTTSNIFRGHAICVYHMSSIRAAFNGPYAHKEGPEYHWSVYEGKVPYPRPGSCASKVNGGRYGTTKDYPDDAIRFARSHPLMYQAIKPAHKKPILVKTDGKYNLKQIAVDRVEAEDGQYDVLFIGTDNGIVLKVITIYNQEMESMEEVILEELQIFKDPVPIISMEISSKRQQLYIGSASAVAQVRFHHCDMYGSACADCCLARDPYCAWDGISCSRYYPTGTHAKRRFRRQDVRHGNAAQQCFGQQFVGDALDKTEEHLAYGIENNSTLLECTPRSLQAKVIWFVQKGRETRKEEVKTDDRVVKMDLGLLFLRLHKSDAGTYFCQTVEHSFVHTVRKITLEVVEEEKVEDMFNKDDEEDRHHRMPCPAQSSISQGAKPWYKEFLQLIGYSNFQRVEEYCEKVWCTDRKRKKLKMSPSKWKYANPQEKKLRSKPEHYRLPRHTLDS

SEQ ID NO: 7660 - protein, 785 aa, unidentified
MLVAGLLLWASLLTGAWPSFPTQDHLPATPRVRLSFKELKATGTAHFFNFLLNTTDYRILLKDEDHDRMYVGSKDYVLSLDLHDINREPLIIHWAASPQRIEECVLSGKDVNGECGNFVRLIQPWNRTHLYVCGTGAYNPMCTYVNRGRRAQATPWTQTQAVRGRGSRATDGALRPMPTAPRQDYIFYLEPERLESGKGKCPYDPKLDTASALINEELYAGVYIDFMGTDAAIFRTLGKQTAMRTDQYNSRWLNDPSFIHAELIPDSAERNDDKLYFFFRERSAEAPQSPAVYARIGRICLNDDGGHCCLVNKWSTFLKARLVCSVPGEDGIETHFDELQDVFVQQTQDVRNPVIYAVFTSSGSVFRGSAVCVYSMADIRMVFNGPFAHKEGPNYQWMPFSGKMPYPRPGTCPGGTFTPSMKSTKDYPDEVINFMRSHPLMYQAVYPLQRRPLVVRTGAPYRLTTIAVDQVDAADGRYEVLFLGTDRGTVQKVIVLPKDDQELEELMLEEVEVFKDPAPVKTMTISSKRQQLYVASAVGVTHLSLHRCQAYGAACADCCLARDPYCAWDGQACSRYTASSKRRSRRQDVRHGNPIRQCRGFNSNANKNAVESVQYGVAGSAAFLECQPRSPQATVKWLFQRDPGDRRREIRAEDRFLRTEQGLLLRALQLSDRGLYSCTATENNFKHVVTRVQLHVLGRDAVHAALFPPLSMSAPPPPGAGPPTPPYQELAQLLAQPEVGLIHQYCQGYWRHVPPSPREAPGAPRSPEPQDQKKPRNRRHHPPDT

SEQ ID NO: 7661 - protein, 782 aa, unidentified
MAPSAWAICWLLGGLLLHGGSSGPSPGPSVPRLRLSYRDLLSANRSAIFLGPQGSLNLQAMYLDEYRDRLFLGGLDALYSLRLDQAWPDPREVLWPPQPGQREECVRKGRDPLTECANFVRVLQPHNRTHLLACGTGAFQPTCALITVGHRGEHVLHLEPGSVESGRGRCPHEPSRPFASTFIDGELYTGLTADFLGREAMIFRSGGPRPALRSDSDQSLLHDPRFVMAARIPENSDQDNDKVYFFFSETVPSPDGGSNHVTVSRVGRVCVNDAGGQRVLVNKWSTFLKARLVCSVPGPGGAETHFDQLEDVFLLWPKAGKSLEVYALFSTVSAVFQGFAVCVYHMADIWEVFNGPFAHRDGPQHQWGPYGGKVPFPRPGVCPSKMTAQPGRPFGSTKDYPDEVLQFARAHPLMFWPVRPRHGRPVLVKTHLAQQLHQIVVDRVEAEDGTYDVIFLGTDSGSVLKVIALQAGGSAEPEEVVLEELQVFKVPTPITEMEISVKRQMLYVGSRLGVAQLRLHQCETYGTACAECCLARDPYCAWDGASCTHYRPSLGKRRFRRQDIRHGNPALQCLGQSQEEEAVGLVAATMVYGTEHNSTFLECLPKSPQAAVRWLLQRPGDEGPDQVKTDERVLHTERGLLFRRLSRFDAGTYTCTTLEHGFSQTVVRLALVVIVASQLDNLFPPEPKPEEPPARGGLASTPPKAWYKDILQLIGFANLPRVDEYCERVWCRGTTECSGCFRSRSRGKQARGKSWAGLELGKKMKSRVHAEHNRTPREVEAT

SEQ ID NO: 7662 - protein, 761 aa, unidentified; identical to SEQ ID NO: 3891

SEQ ID NO: 7663 - protein, 833 aa, unidentified; identical to SEQ ID NO: 3892

SEQ ID NO: 7664 - protein, 862 aa, unidentified; identical to SEQ ID NO: 3893

SEQ ID NO: 7665 - protein, 770 aa, unidentified; identical to SEQ ID NO: 3894

SEQ ID NO: 7666 - protein, 838 aa, unidentified; identical to SEQ ID NO: 3895

SEQ ID NO: 7667 - protein, 1074 aa, unidentified; identical to SEQ ID NO: 3896

SEQ ID NO: 7668 - protein, 1030 aa, unidentified; identical to SEQ ID NO: 3898

SEQ ID NO: 7669 - protein, 930 aa, unidentified; identical to SEQ ID NO: 3900

SEQ ID NO: 7670 - protein, 1073 aa, unidentified; identical to SEQ ID NO: 3901

SEQ ID NO: 7671 - protein, 462 aa, unidentified
MKPNIIFVLSLLLILEKQAAVMGQKGGSKGRLPSEFSQFPHGQKGQHYSGQKGKQQTESKGSFSIQYTYHVDANDHDQSRKSQQYDLNALHKTTKSQRHLGGSQQLLHNKQEGRDHDKSKGHFHRVVIHHKGGKAHRGTQNPSQDQGNSPSGKGISSQYSNTEERLWVHGLSKEQTSVSGAQKGRKQGGSQSSYVLQTEELVANKQQRETKNSHQNKGHYQNVVEVREEHSSKVQTSLCPAHQDKLQHGSKDIFSTQDELLVYNKNQHQTKNLNQDQQHGRKANKISYQSSSTEERRLHYGENGVQKDVSQSSIYSQTEEKAQGKSQKQITIPSQEQEHSQKANKISYQSSSTEERRLHYGENGVQKDVSQRSIYSQTEKLVAGKSQIQAPNPKQEPWHGENAKGESGQSTNREQDLLSHEQKGRHQHGSHGGLDIVIIEQEDDSDRHLAQHLNNDRNPLFT

SEQ ID NO: 7672 - protein, 582 aa, unidentified
MKSIILFVLSLLLILEKQAAVMGQKGGSKGQLPSGSSQFPHGQKGQHYFGQKDQQHTKSKGSFSIQHTYHVDINDHDWTRKSQQYDLNALHKATKSKQHLGGSQQLLNYKQEGRDHDKSKGHFHMIVIHHKGGQAHHGTQNPSQDQGNSPSGKGLSSQCSNTEKRLWVHGLSKEQASASGAQKGRTQGGSQSSYVLQTEELVVNKQQRETKNSHQNKGHYQNVVDVREEHSSKLQTSLHPAHQDRLQHGPKDIFTTQDELLVYNKNQHQTKNLSQDQEHGRKAHKISYPSSRTEERQLHHGEKSVQKDVSKGSISIQTEEKIHGKSQNQVTIHSQDQEHGHKENKISYQSSSTEERHLNCGEKGIQKGVSKGSISIQTEEQIHGKSQNQVRIPSQAQEYGHKENKISYQSSSTEERRLNSGEKDVQKGVSKGSISIQTEEKIHGKSQNQVTIPSQDQEHGHKENKMSYQSSSTEERRLNYGGKSTQKDVSQSSISFQIEKLVEGKSQIQTPNPNQDQWSGQNAKGKSGQSADSKQDLLSHEQKGRYKQESSESHNIVITEHEVAQDDHLTQQYNEDRNPIST

SEQ ID NO: 7673 - protein, 586 aa, unidentified
MKKSYSGGTRTSSGRLRRLGDSSGPALKRSFEVEEVETPNSTPPRRVQTPLLRATVASSTQKFQDLGVKNSEPSARHVDSLSQRSPKASLRRVELSGPKAAEPVSRRTELSIDISSKQVENAGAIGPSRFGLKRAEVLGHKTPEPAPRRTEITIVKPQESAHRRMEPPASKVPEVPTAPATDAAPKRVEIQMPKPAEAPTAPSPAQTLENSEPAPVSQLQSRLEPKPQPPVAEATPRSQEATEAAPSCVGDMADTPRDAGLKQAPASRNEKAPVDFGYVGIDSILEQMRRKAMKQGFEFNIMVVGQSGLGKSTLINTLFKSKISRKSVQPTSEERIPKTIEIKSITHDIEEKGVRMKLTVIDTPGFGDHINNENCWQPIMKFINDQYEKYLQEEVNINRKKRIPDTRVHCCLYFIPATGHSLRPLDIEFMKRLSKVVNIVPVIAKADTLTLEERVHFKQRITADLLSNGIDVYPQKEFDEDSEDRLVNEKFREMIPFAVVGSDHEYQVNGKRILGRKTKWGTIEVENTTHCEFAYLRDLLIRTHMQNIKDITSSIHFEAYRVKRLNEGSSAMANGMEEKEPEAPEM

SEQ ID NO: 7674 - protein, 418 aa, unidentified
MPSSVSWGILLLAGLCCLVPVSLAEDPQGDAAQKTDTSHHDQDHPTFNKITPNLAEFAFSLYRQLAHQSNSTNIFFSPVSIATAFAMLSLGTKADTHDEILEGLNFNLTEIPEAQIHEGFQELLRTLNQPDSQLQLTTGNGLFLSEGLKLVDKFLEDVKKLYHSEAFTVNFGDTEEAKKQINDYVEKGTQGKIVDLVKELDRDTVFALVNYIFFKGKWERPFEVKDTEEEDFHVDQVTTVKVPMMKRLGMFNIQHCKKLSSWVLLMKYLGNATAIFFLPDEGKLQHLENELTHDIITKFLENEDRRSASLHLPKLSITGTYDLKSVLGQLGITKVFSNGADLSGVTEEAPLKLSKAVHKAVLTIDEKGTEAAGAMFLEAIPMSIPPEVKFNKPFVFLMIEQNTKSPLFMGKVVNPTQK

SEQ ID NO: 7675 - protein, 444 aa, unidentified; identical to SEQ ID NO: 3913

SEQ ID NO: 7676 - protein, 422 aa, unidentified
MGPAWLWLLGTGILASVHCQPLLAHGDKSLQGPQPPRHQLSEPAPAYHRITPTITNFALRLYKELAADAPGNIFFSPVSISTTLALLSLGAQANTSALILEGLGFNLTETPEADIHQGFRSLLHTLALPSPKLELKVGNSLFLDKRLKPRQHYLDSIKELYGAFAFSANFTDSVTTGRQINDYLRRQTYGQVVDCLPEFSQDTFMVLANYIFFKAKWKHPFSRYQTQKQESFFVDERTSLQVPMMHQKEMHRFLYDQDLACTVLQIEYRGNALALLVLPDPGKMKQVEAALQPQTLRKWGQLLLPSLLDLHLPRFSISGTYNLEDILPQIGLTNILNLEADFSGVTGQLNKTISKVSHKAMVDMSEKGTEAGAASGLLSQPPSLNTMSDPHAHFNRPFLLLLWEVTTQSLLFLGKVVNPVAG

SEQ ID NO: 7677 - protein, 414 aa, unidentified
MNPTLGLAIFLAVLLTVKGLLKPSFSPRNYKALSEVQGWKQRMAAKELARQNMDLGFKLLKKLAFYNPGRNIFLSPLSISTAFSMLCLGAQDSTLDEIKQGFNFRKMPEKDLHEGFHYIIHELTQKTQDLKLSIGNTLFIDQRLQPQRKFLEDAKNFYSAETILTNFQNLEMAQKQINDFISQKTHGKINNLIENIDPGTVMLLANYIFFRARWKHEFDPNVTKEEDFFLEKNSSVKVPMMFRSGIYQVGYDDKLSCTILEIPYQKNITAIFILPDEGKLKHLEKGLQVDTFSRWKTLLSRRVVDVSVPRLHMTGTFDLKKTLSYIGVSKIFEEHGDLTKIAPHRSLKVGEAVHKAELKMDERGTEGAAGTGAQTLPMETPLVVKIDKPYLLLIYSEKIPSVLFLGKIVNPIGK

SEQ ID NO: 7678 - protein, 423 aa, unidentified
MERMLPLLALGLLAAGFCPAVLCHPNSPLDEENLTQENQDRGTHVDLGLASANVDFAFSLYKQLVLKAPDKNVIFSPLSISTALAFLSLGAHNTTLTEILKGLKFNLTETSEAEIHQSFQHLLRTLNQSSDELQLSMGNAMFVKEQLSLLDRFTEDAKRLYGSEAFATDFQDSAAAKKLINDYVKNGTRGKITDLIKDLDSQTMMVLVNYIFFKAKWEMPFDPQDTHQSRFYLSKKKWVMVPMMSLHHLTIPYFRDEELSCTVVELKYTGNASALFILPDQDKMEEVEAMLLPETLKRWRDSLEFREIGELYLPKFSISRDYNLNDILLQLGIEEAFTSKADLSGITGARNLAVSQVVHKAVLDVFEEGTEASAATAVKITLLSALVETRTIVRFNRPFLMIIVPTDTQNIFFMSKVTNPKQA

SEQ ID NO: 7679 - protein, 427 aa, unidentified
MHLIDYLLLLLVGLLALSHGQLHVEHDGESCSNSSHQQILETGEGSPSLKIAPANADFAFRFYYLIASETPGKNIFFSPLSISAAYAMLSLGACSHSRSQILEGLGFNLTELSESDVHRGFQHLLHTLNLPGHGLETRVGSALFLSHNLKFLAKFLNDTMAVYEAKLFHTNFYDTVGTIQLINDHVKKETRGKIVDLVSELKKDVLMVLVNYIYFKALWEKPFISSRTTPKDFYVDENTTVRVPMMLQDQEHHWYLHDRYLPCSVLRMDYKGDATVFFILPNQGKMREIEEVLTPEMLMRWNNLLRKRNFYKKLELHLPKFSISGSYVLDQILPRLGFTDLFSKWADLSGITKQQKLEASKSFHKATLDVDEAGTEAAAATSFAIKFFSAQTNRHILRFNRPFLVVIFSTSTQSVLFLGKVVDPTKP

SEQ ID NO: 7680 - protein, 406 aa, unidentified
MQLFLLLCLVLLSPQGASLHRHHPREMKKRVEDLHVGATVAPSSRRDFTFDLYRALASAAPSQSIFFSPVSISMSLAMLSLGAGSSTKMQILEGLGLNLQKSSEKELHRGFQQLLQELNQPRDGFQLSLGNALFTDLVVDLQDTFVSAMKTLYLADTFPTNFRDSAGAMKQINDYVAKQTKGKIVDLLKNLDSNAVVIMVNYIFFKAKWETSFNHKGTQEQDFYVTSETVVRVPMMSREDQYHYLLDRNLSCRVVGVPYQGNATALFILPSEGKMQQVENGLSEKTLRKWLKMFKKRQLELYLPKFSIEGSYQLEKVLPSLGISNVFTSHADLSGISNHSNIQVSEMVHKAVVEVDESGTRAAAATGTIFTFRSARLNSQRLVFNRPFLMFIVDNNILFLGKVNRP

SEQ ID NO: 7681 - protein, 405 aa, unidentified
MPLLLYTCLLWLPTSGLWTVQAMDPNAAYVNMSNHHRGLASANVDFAFSLYKHLVALSPKKNIFISPVSISMALAMLSLGTCGHTRAQLLQGLGFNLTERSETEIHQGFQHLHQLFAKSDTSLEMTMGNALFLDGSLELLESFSADIKHYYESEVLAMNFQDWATASRQINSYVKNKTQGKIVDLFSGLDSPAILVLVNYIFFKGTWTQPFDLASTREENFYVDETTVVKVPMMLQSSTISYLHDSELPCQLVQMNYVGNGTVFFILPDKGKMNTVIAALSRDTINRWSAGLTSSQVDLYIPKVTISGVYDLGDVLEEMGIADLFTNQANFSRITQDAQLKSSKVVHKAVLQLNEEGVDTAGSTGVTLNLTSKPIILRFNQPFIIMIFDHFTWSSLFLARVMNPV

SEQ ID NO: 7682 - protein, 415 aa, unidentified
MSPFLYLVLLVLGLHATIHCASPEGKVTACHSSQPNATLYKMSSINADFAFNLYRRFTVETPDKNIFFSPVSISAALVMLSFGACCSTQTEIVETLGFNLTDTPMVEIQHGFQHLICSLNFPKKELELQIGNALFIGKHLKPLAKFLNDVKTLYETEVFSTDFSNISAAKQEINSHVEMQTKGKVVGLIQDLKPNTIMVLVNYIHFKAQWANPFDPSKTEDSSSFLIDKTTTVQVPMMHQMEQYYHLVDMELNCTVLQMDYSKNALALFVLPKEGQMESVEAAMSSKTLKKWNRLLQKGWVDLFVPKFSISATYDLGATLLKMGIQHAYSENADFSGLTEDNGLKLSNAAHKAVLHIGEKGTEAAAVPEVELSDQPENTFLHPIIQIDRSFMLLILERSTRSILFLGKVVNPTEA

SEQ ID NO: 7683 - protein, 417 aa, unidentified
MASYLYGVLFAVGLCAPIYCVSPANAPSAYPRPSSTKSTPASQVYSLNTDFAFRLYRRLVLETPSQNIFFSPVSVSTSLAMLSLGAHSVTKTQILQGLGFNLTHTPESAIHQGFQHLVHSLTVPSKDLTLKMGSALFVKKELQLQANFLGNVKRLYEAEVFSTDFSNPSIAQARINSHVKKKTQGKVVDIIQGLDLLTAMVLVNHIFFKAKWEKPFHPEYTRKNFPFLVGEQVTVHVPMMHQKEQFAFGVDTELNCFVLQMDYKGDAVAFFVLPSKGKMRQLEQALSARTLRKWSHSLQKRWIEVFIPRFSISASYNLETILPKMGIQNVFDKNADFSGIAKRDSLQVSKATHKAVLDVSEEGTEATAATTTKFIVRSKDGPSYFTVSFNRTFLMMITNKATDGILFLGKVENPTKS

SEQ ID NO: 7684 - protein, 415 aa, unidentified
MEDLCVANTLFALNLFKHLAKASPTQNLFLSPWSISSTMAMVYMGSRGSTEDQMAKVLQFNEVGANAVTPMTPENFTSCGFMQQIQKGSYPDAILQAQAADKIHSSFRSLSSAINASTGNYLLESVNKLFGEKSASFREEYIRLCQKYYSSEPQAVDFLECAEEARKKINSWVKTQTKGKIPNLLPEGSVDGDTRMVLVNAVYFKGKWKTPFEKKLNGLYPFRVNSAQRTPVQMMYLREKLNIGYIEDLKAQILELPYAGDVSMFLLLPDEIADVSTGLELLESEITYDKLNKWTSKDKMAEDEVEVYIPQFKLEEHYELRSILRSMGMEDAFNKGRANFSGMSERNDLFLSEVFHQAMVDVNEEGTEAAAGTGGVMTGRTGHGGPQFVADHPFLFLIMHKITNCILFFGRFSSP

SEQ ID NO: 7685 - protein, 464 aa, unidentified
MYSNVIGTVTSGKRKVYLLSLLLIGFWDCVTCHGSPVDICTAKPRDIPMNPMCIYRSPEKKATEDEGSEQKIPEATNRRVWELSKANSRFATTFYQHLADSKNDNDNIFLSPLSISTAFAMTKLGACNDTLQQLMEVFKFDTISEKTSDQIHFFFAKLNCRLYRKANKSSKLVSANRLFGDKSLTFNETYQDISELVYGAKLQPLDFKENAEQSRAAINKWVSNKTEGRITDVIPSEAINELTVLVLVNTIYFKGLWKSKFSPENTRKELFYKADGESCSASMMYQEGKFRYRRVAEGTQVLELPFKGDDITMVLILPKPEKSLAKVEKELTPEVLQEWLDELEEMMLVVHMPRFRIEDGFSLKEQLQDMGLVDLFSPEKSKLPGIVAEGRDDLYVSDAFHKAFLEVNEEGSEAAASTAVVIAGRSLNPNRVTFKANRPFLVFIREVPLNTIIFMGRVANPCVK

SEQ ID NO: 7686 - protein, 499 aa, unidentified
MKHSLNALLIFLIITSAWGGSKGPLDQLEKGGETAQSADPQWEQLNNKNLSMPLLPADFHKENTVTNDWIPEGEEDDDYLDLEKIFSEDDDYIDIVDSLSVSPTDSDVSAGNILQLFHGKSRIQRLNILNAKFAFNLYRVLKDQVNTFDNIFIAPVGISTAMGMISLGLKGETHEQVHSILHFKDFVNASSKYEITTIHNLFRKLTHRLFRRNFGYTLRSVNDLYIQKQFPILLDFKTKVREYYFAEAQIADFSDPAFISKTNNHIMKLTKGLIKDALENIDPATQMMILNCIYFKGSWVNKFPVEMTHNHNFRLNEREVVKVSMMQTKGNFLAANDQELDCDILQLEYVGGISMLIVVPHKMSGMKTLEAQLTPRVVERWQKSMTNRTREVLLPKFKLEKNYNLVESLKLMGIRMLFDKNGNMAGISDQRIAIDLFKHQGTITVNEEGTQATTVTTVGFMPLSTQVRFTVDRPFLFLIYEHRTSCLLFMGRVANPSRS

SEQ ID NO: 7687 - protein, 402 aa, unidentified [sequence omitted]

SEQ ID NO: 7688 - protein, 398 aa, unidentified
MNWHLPLFLLASVTLPSICSHFNPLSLEELGSNTGIQVFNQIVKSRPHDNIVISPHGIASVLGMLQLGADGRTKKQLAMVMRYGVNGVGKILKKINKAIVSKKNKDIVTVANAVFVKNASEIEVPFVTRNKDVFQCEVRNVNFEDPASACDSINAWVKNETRDMIDNLLSPDLIDGVLTRLVLVNAVYFKGLWKSRFQPENTKKRTFVAADGKSYQVPMLAQLSVFRCGSTSAPNDLWYNFIELPYHGESISMLIALPTESSTPLSAIIPHISTKTIDSWMSIMVPKRVQVILPKFTAVAQTDLKEPLKVLGITDMFDSSKANFAKITTGSENLHVSHILQKAKIEVSEDGTKASAATTAILIARSSPPWFIVDRPFLFFIRHNPTGAVLFMGQINKP

SEQ ID NO: 7689 - protein, 424 aa, unidentified
MPPFLITLFLFHSCCLRANGHLREGMTLLKTEFALHLYQSVAACRNETNFVISPAGVSLPLEILQFGAEGSTGQQLADALGYTVHDKRVKDFLHAVYATLPTSSQGTEMELACSLFVQVGTPLSPCFVEHVSWWANSSLEPADLSEPNSTAIQTSEGASRETAGGGPSEGPGGWPWEQVSAAFAQLVLVSTMSFQGTWRKRFSSTDTQILPFTCAYGLVLQVPMMHQTTEVNYGQFQDTAGHQVGVLELPYLGSAVSLFLVLPRDKDTPLSHIEPHLTASTIHLWTTSLRRARMDVFLPRFRIQNQFNLKSILNSWGVTDLFDPLKANLKGISGQDGFYVSEAIHKAKIEVLEEGTKASGATALLLLKRSRIPIFKADRPFIYFLREPNTGITVFFDRIQIIYQCLSSNKGSFVHYPLKNKHSF

SEQ ID NO: 7690 - protein, 418 aa, unidentified
MQALVLLLCIGALLGHSSCQNPASPPEEGSPDPDSTGALVEEEDPFFKVPVNKLAAAVSNFGYDLYRVRSSTSPTTNVLLSPLSVATALSALSLGAEQRTESIIHRALYYDLISSPDIHGTYKELLDTVTAPQKNLKSASRIVFEKKLRIKSSFVAPLEKSYGTRPRVLTGNPRLDLQEINNWVQAQMKGKLARSTKEIPDEISILLLGVAHFKGQWVTKFDSRKTSLEDFYLDEERTVRVPMMSDPKAVLRYGLDSDLSCKIAQLPLTGSMSIIFFLPLKVTQNLTLIEESLTSEFIHDIDRELKTVQAVLTVPKLKLSYEGEVTKSLQEMKLQSLFDSPDFSKITGKPIKLTQVEHRAGFEWNEDGAGTTPSPGLQPAHLTFPLDYHLNQPFIFVLRDTDTGALLFIGKILDPRGP

SEQ ID NO: 7691 - protein, 491 aa, unidentified
MALLWGLLVLSWSCLQGPCSVFSPVSAMEPLGRQLTSGPNQEQVSPLTLLKLGNQEPGGQTALKSPPGVCSRDPTPEQTHRLARAMMAFTADLFSLVAQTSTCPNLILSPLSVALALSHLALGAQNHTLQRLQQVLHAGSGPCLPHLLSRLCQDLGPGAFRLAARMYLQKGFPIKEDFLEQSEQLFGAKPVSLTGKQEDDLANINQWVKEATEGKIQEFLSGLPEDTVLLLLNAIHFQGFWRNKFDPSLTQRDSFHLDEQFTVPVEMMQARTYPLRWFLLEQPEIQVAHFPFKNNMSFVVLVPTHFEWNVSQVLANLSWDTLHPPLVWERPTKVRLPKLYLKHQMDLVATLSQLGLQELFQAPDLRGISEQSLVVSGVQHQSTLELSEVGVEAAAATSIAMSRMSLSSFSVNRPFLFFIFEDTTGLPLFVGSVRNPNPSAPRELKEQQDSPGNKDFLQSLKGFPRGDKLFGPDLKLVPPMEEDYPQFGSPK

SEQ ID NO: 7692 - protein, 500 aa, unidentified
MASRLTLLTLLLLLLAGDRASSNPNATSSSSQDPESLQDRGEGKVATTVISKMLFVEPILEVSSLPTTNSTTNSATKITANTTDEPTTQPTTEPTTQPTIQPTQPTTQLPTDSPTQPTTGSFCPGPVTLCSDLESHSTEAVLGDALVDFSLKLYHAFSAMKKVETNMAFSPFSIASLLTQVLLGAGENTKTNLESILSYPKDFTCVHQALKGFTTKGVTSVSQIFHSPDLAIRDTFVNASRTLYSSSPRVLSNNSDANLELINTWVAKNTNNKISRLLDSLPSDTRLVLLNAIYLSAKWKTTFDPKKTRMEPFHFKNSVIKVPMMNSKKYPVAHFIDQTLKAKVGQLQLSHNLSLVILVPQNLKHRLEDMEQALSPSVFKAIMEKLEMSKFQPTLLTLPRIKVTTSQDMLSIMEKLEFFDFSYDLNLCGLTEDPDLQVSAMQHQTVLELTETGVEAAAASAISVARTLLVFEVQQPFLFVLWDQQHKFPVFMGRVYDPRA

SEQ ID NO: 7693 - protein, 418 aa, unidentified
MRSLLLLSAFCLLEAALAAEVKKPAAAAAPGTAEKLSPKAATLAERSAGLAFSLYQAMAKDQAVENILVSPVVVASSLGLVSLGGKATTASQAKAVLSAEQLRDEEVHAGLGELLRSLSNSTARNVTWKLGSRLYGPSSVSFADDFVRSSKQHYNCEHSKINFRDKRSALQSINEWAAQTTDGKLPEVTKDVERTDGALLVNAMFFKPHWDEKFHHKMVDNRGFMVTRSYTVGVMMMHRTGLYNYYDDEKEKLQIVEMPLAHKLSSLIILMPHHVEPLERLEKLLTKEQLKIWMGKMQKKAVAISLPKGVVEVTHDLQKHLAGLGLTEAIDKNKADLSRMSGKKDLYLASVFHATAFELDTDGNPFDQDIYGREELRSPKLFYADHPFIFLVRDTQSGSLLFIGRLVRPKGDKMRDEL

SEQ ID NO: 7694 - protein, 410 aa, unidentified
MAFLGLFSLLVLQSMATGATFPEEAIADLSVNMYNRLRATGEDENILFSPLSIALAMGMMELGAQGSTQKEIRHSMGYDSLKNGEEFSFLKEFSNMVTAKESQYVMKIANSLFVQNGFHVNEEFLQMMKKYFNAAVNHVDFSQNVAVANYINKWVENNTNNLVKDLVSPRDFDAATYLALINAVYFKGNWKSQFRPENTRTFSFTKDDESEVQIPMMYQQGEFYYGEFSDGSNEAGGIYQVLEIPYEGDEISMMLVLSRQEVPLATLEPLVKAQLVEEWANSVKKQKVEVYLPRFTVEQEIDLKDVLKALGITEIFIKDANLTGLSDNKEIFLSKAIHKSFLEVNEEGSEAAAVSGMIAISRMAVLYPQVIVDHPFFFLIRNRRTGTILFMGRVMHPETMNTSGHDFEEL

SEQ ID NO: 7695 - protein, 405 aa, unidentified
MDTIFLWSLLLLFFGSQASRCSAQKNTEFAVDLYQEVSLSHKDNIIFSPLGITLVLEMVQLGAKGKAQQQIRQTLKQQETSAGEEFFVLKSFFSAISEKKQEFTFNLANALYLQEGFTVKEQYLHGNKEFFQSAIKLVDFQDAKACAEMISTWVERKTDGKIKDMFSGEEFGPLTRLVLVNAIYFKGDWKQKFRKEDTQLINFTKKNGSTVKIPMMKALLRTKYGYFSESSLNYQVLELSYKGDEFSLIIILPAEGMDIEEVEKLITAQQILKWLSEMQEEEVEISLPRFKVEQKVDFKDVLYSLNITEIFSGGCDLSGITDSSEVYVSQVTQKVFFEINEDGSEAATSTGIHIPVIMSLAQSQFIANHPFLFIMKHNPTESILFMGRVTNPDTQEIKGRDLDSL

SEQ ID NO: 7696 - protein, 910 aa, unidentified; identical to SEQ ID NO: 3919

SEQ ID NO: 7697 - protein, 314 aa, unidentified
MGIGRSEGGRRGAALGVLLALGAALLAVGSASEYDYVSFQSDIGPYQSGRFYTKPPQCVDIPADLRLCHNVGYKKMVLPNLLEHETMAEVKQQASSWVPLLNKNCHAGTQVFLCSLFAPVCLDRPIYPCRWLCEAVRDSCEPVMQFFGFYWPEMLKCDKFPEGDVCIAMTPPNATEASKPQGTTVCPPCDNELKSEAIIEHLCASEFALRMKIKEVKKENGDKKIVPKKKKPLKLGPIKKKDLKKLVLYLKNGADCPCHQLDNLSHHFLIMGRKVKSQYLLTAIHKWDKKNKEFKNFMKKMKNHECPTFQSVFK

SEQ ID NO: 7698 - protein, 295 aa, unidentified
MLQGPGSLLLLFLASHCCLGSARGLFLFGQPDFSYKRSNCKPIPANLQLCHGIEYQNMRLPNLLGHETMKEVLEQAGAWIPLVMKQCHPDTKKFLCSLFAPVCLDDLDETIQPCHSLCVQVKDRCAPVMSAFGFPWPDMLECDRFPQDNDLCIPLASSDHLLPATEEAPKVCEACKNKNDDDNDIMETLCKNDFALKIKVKEITYINRDTKIILETKSKTIYKLNGVSERDLKKSVLWLKDSLQCTCEEMNDINAPYLVMGQKQGGELVITSVKRWQKGQREFKRISRSIRKLQC

SEQ ID NO: 7699 - protein, 346 aa, unidentified
MFLSILVALCLWLHLALGVRGAPCEAVRIPMCRHMPWNITRMPNHLHHSTQENAILAIEQYEELVDVNCSAVLRFFLCAMYAPICTLEFLHDPIKPCKSVCQRARDDCEPLMKMYNHSWPESLACDELPVYDRGVCISPEAIVTDLPEDVKWIDITPDMMVQERPLDVDCKRLSPDRCKCKKVKPTLATYLSKNYSYVIHAKIKAVQRSGCNEVTTVVDVKEIFKSSSPIPRTQVPLITNSSCQCPHILPHQDVLIMCYEWRSRMMLLENCLVEKWRDQLSKRSIQWEERLQEQRRTVQDKKKTAGRTSRSNPPKPKGKPPAPKPASPKKNIKTRSAQKRTNPKRV

SEQ ID NO: 7700 - protein, 317 aa, unidentified
MRAAAAGGGVRTAALALLLGALHWAPARCEEYDYYGWQAEPLHGRSYSKPPQCLDIPADLPLCHTVGYKRMRLPNLLEHESLAEVKQQASSWLPLLAKRCHSDTQVFLCSLFAPVCLDRPIYPCRSLCEAVRAGCAPLMEAYGFPWPEMLHCHKFPLDNDLCIAVQFGHLPATAPPVTKICAQCEMEHSADGLMEQMCSSDFVVKMRIKEIKIENGDRKLIGAQKKKKLLKPGPLKRKDTKRLVLHMKNGAGCPCPQLDSLAGSFLVMGRKVDGQLLLMAVYRWDKKNKEMKFAVKFMFSYPCSLYYPFFYGAAEPH

SEQ ID NO: 7701 - protein, 78 aa, unidentified
MGSGLPLVLLLTLLGSSHGTGPGMTLQLKLKESFLTNSSYESSFLELLEKLCLLLHLPSGTSVTLHHARSQHHVVCNT

SEQ ID NO: 7702 - protein, 248 aa, unidentified
MWLCPLALNLILMAASGAVCEVKDVCVGSPGIPGTPGSHGLPGRDGRDGLKGDPGPPGPMGPPGEMPCPPGNDGLPGAPGIPGECGEKGEPGERGPPGLPAHLDEELQATLHDFRHQILQTRGALSLQGSIMTVGEKVFSSNGQSITFDAIQEACARAGGRIAVPRNPEENEAIASFVKKYNTYAYVGLTEGPSPGDFRYSDGTPVNYTNWYRGEPAGRGKEQCVEMYTDGQWNDRNCLYSRLTICEF

SEQ ID NO: 7703 - protein, 248 aa, unidentified
MWLCPLALNLILMAASGAACEVKDVCVGSPGIPGTPGSHGLPGRDGRDGVKGDPGPPGPMGPPGETPCPPGNNGLPGAPGVPGERGEKGEAGERGPPGLPAHLDEELQATLHDFRHQILQTRGALSLQGSIMTVGEKVFSSNGQSITFDAIQEACARAGGRIAVPRNPEENEAIASFVKKYNTYAYVGLTEGPSPGDFRYSDGTPVNYTNWYRGEPAGRGKEQCVEMYTDGQWNDRNCLYSRLTICEF

SEQ ID NO: 7704 - protein, 381 aa, unidentified
MAESHLLQWLLLLLPTLCGPGTAAWTTSSLACAQGPEFWCQSLEQALQCRALGHCLQEVWGHVGADDLCQECEDIVHILNKMAKEAIFQDTMRKFLEQECNVLPLKLLMPQCNQVLDDYFPLVIDYFQNQTDSNGICMHLGLCKSRQPEPEQEPGMSDPLPKPLRDPLPDPLLDKLVLPVLPGALQARPGPHTQDLSEQQFPIPLPYCWLCRALIKRIQAMIPKGALAVAVAQVCRVVPLVAGGICQCLAERYSVILLDTLLGRMLPQLVCRLVLRCSMDDSAGPRSPTGEWLPRDSECHLCMSVTTQAGNSSEQAIPQAMLQACVGSWLDREKCKQFVEQHTPQLLTLVPRGWDAHTTCQALGVCGTMSSPLQCIHSPDL

SEQ ID NO: 7705 - protein, 375 aa, unidentified
MLLFLLSALVLLTQPLGYLEAEMKTYSHRTMPSACTLVMCSSVESGLPGRDGRDGREGPRGEKGDPGLPGAAGQAGMPGQAGPVGPKGDNGSVGEPGPKGDTGPSGPPGPPGVPGPAGREGPLGKQGNIGPQGKPGPKGEAGPKGEVGAPGMQGSAGARGLAGPKGERGVPGERGVPGNTGAAGSAGAMGPQGSPGARGPPGLKGDKGIPGDKGAKGESGLPDVASLRQQVEALQGQVQHLQAAFSQYKKVELFPNGQSVGEKIFKTAGFVKPFTEAQLLCTQAGGQLASPRSAAENAALQQLVVAKNEAAFLSMTDSKTEGKFTYPTGESLVYSNWAPGEPNDDGGSEDCVEIFTNGKWNDRACGEKRLVVCEF

SEQ ID NO: 7706 - protein, 340 aa, unidentified; identical to SEQ ID NO: 3928

SEQ ID NO: 7707 - protein, 387 aa, unidentified; identical to SEQ ID NO: 3929

SEQ ID NO: 7708 - protein, 502 aa, unidentified
MSCPVPACCALLLVLGLCRARPRNALLLLADDGGFESGAYNNSAIATPHLDALARRSLLFRNAFTSVSSCSPSRASLLTGLPQHQNGMYGLHQDVHHFNSFDKVRSLPLLLSQAGVRTGIIGKKHVGPETVYPFDFAYTEENGSVLQVGRNITRIKLLVRKFLQTQDDRPFFLYVAFHDPHRCGHSQPQYGTFCEKFGNGESGMGRIPDWTPQAYDPLDVLVPYFVPNTPAARADLAAQYTTVGRMDQGVGLVLQELRDAGVLNDTLVIFTSDNGIPFPSGRTNLYWPGTAEPLLVSSPEHPKRWGQVSEAYVSLLDLTPTILDWFSIPYPSYAIFGSKTIHLTGRSLLPALEAEPLWATVFGSQSHHEVTMSYPMRSVQHRHFRLVHNLNFKMPFPIDQDFYVSPTFQDLLNRTTAGQPTGWYKDLRHYYYRARWELYDRSRDPHETQNLATDPRFAQLLEMLRDQLAKWQWETHDPWVCAPDGVLEEKLSPQCQPLHNEL

SEQ ID NO: 7709 - protein, 882 aa, unidentified
MLLGASWLCASKAAAAAAQSEGDEDRPGERRRRRAAATAAGAGEDMDESSLLDLLECSVCLERLDTTAKVLPCQHTFCRRCLESIVCSRHELRCPECRILVGCGVDELPANILLVRLLDGIRQRPRAGTSPGGSPPARPIPGQSAAPTLAGGGGGAAGSTPGSPVFLSAAAGSTAGSLRELATSRTAPAAKNPCLLPYGKALYSYEGKEPGDLKFNKGDIIVLRRKVDEQWYHGELHGTQGFLPASYIQCIQPLPHAPPQGKALYDFEMKDKDQDKDCLTFTKDEILTVLRRVDENWAEGMLGDKIGIFPLLYVELNDSAKQLIEMDKPCPAAASSCNASLPSDSGAVASVAPSPTLSSSGAVSAFQRRVDGKKNTKKRHSFTALSVTHRSSQAASHRHSMEISAPVLISSSDPRAAARIGDLAHLSCAAPTQDVSSSAGSTPTAVPRAASVSGEQGTPPKVQLPLNVYLALYAYKPQKSDELELHKGEMYRVLEKCQDGWFKGASLRTGVSGVFPGNYVTPVSRVPAGGAGPPRNNVVGGSPLAKGITTTMHPGSGSLSSLATATRPALPITTPQAHAQHPTASPPTGSCLRHSAQPTASQARSTISTAAHSAAQAQDRPTATVSPLRTQNSPSRLPATSLRPHSVVSPQHSHQPPVQMCPRPAIPLTSAASAITPPNVSAANLNGEAGGGPIGVLSTSSPTNTGCKLDEKKSEKKEKKSGLLKLLAGASTKKKSRSPPSVSPTHDPQVAVDALLQGAVGPEVSSLSIHGRAGSCPIESEMQGAMGMEPLHRKAGSLDLNFTSPSRQAPLSMAAIRPEPKLLPRERYRVVVSYPPQSEAEIELKEGDIVFVHKKREDGWYKGTLQRNGRTGLFPGSFVESF

SEQ ID NO: 7710 - protein, 402 aa, unidentified
MESRGPLATSRLLLLLLLLLLRHTRQGWALRPVLPTQSAHDPPAVHLSNGPGQEPIAVMTFDLTKITKTSSSFEVRTWDPEGVIFYGDTNPKDDWFMLGLRDGRPEIQLHNHWAQLTVGAGPRLDDGRWHQVEVKMEGDSVLLEVDGEEVLRLRQVSGPLTSKRHPIMRIALGGLLFPASNLRLPLVPALDGCLRRDSWLDKQAEISASAPTSLRSCDVESNPGIFLPPGTQAEFNLRDIPQPHAEPWAFSLDLGLKQAAGSGHLLALGTPENPSWLSLHLQDQKVVLSSGSGPGLDLPLVLGLPLQLKLSMSRVVLSQGSKMKALALPPLGLAPLLNLWAKPQGRLFLGALPGEDSSTSFCLNGLWAQGQRLDVDQALNRSHEIWTHSCPQSPGNGTDASH

SEQ ID NO: 7711 - protein, 495 aa, unidentified
MQWSPTPGASACLGWASSLACSTAPTLLGRAGRGPLMAAKWFKEFPLNLKTVSERAKPGGGGGKLRKNSEAGGAGPGPGKGRKNSAAELGSGRAGVGPKDSRLSRDSLQGLIQAAAGKGRKNSRATEEEPHRGATKSSGCSTYINRLIKVDTQEKNGKSNYPSSSSSSSSSSSSASSSPSSLGPELDKGKIIKQQETVIILEDYADPYDAKRTKGQRDAERVGENDGYMEPYDAQQMITEIRRRGSKDPLVKALQLLDSPCEPADGGLKSETLAKRRSSKDLLGKPPQLYDTPYEPAEGGPRAEGKARPPDSRLPENDERPAAEYEQPWEWKKEQIVRALSVQFEGAERPSFREETVRQHHRQKSWTQKILKPALSDHSEGEKVDPGLPLEKQPWYHGAISRAEAESRLQPCKEAGYLVRNSESGNSRYSIALKTSQGCVHIIVAQTKDNKYTLNQTSAVFDSIPEVVHYYSNEKLPFKGAEHMTLLYPVHSKLH

SEQ ID NO: 7712 - protein, 462 aa, unidentified
MLLLARCLLLVLVSSLLVCSGLACGPGRGFGKRRHPKKLTPLAYKQFIPNVAEKTLGASGRYEGKISRNSERFKELTPNYNPDIIFKDEENTGADRLMTQRCKDKLNALAISVMNQWPGVKLRVTEGWDEDGHHSEESLHYEGRAVDITTSDRDRSKYGMLARLAVEAGFDWVYYESKAHIHCSVKAENSVAAKSGGCFPGSATVHLEQGGTKLVKDLSPGDRVLAADDQGRLLYSDFLTFLDRDDGAKKVFYVIETREPRERLLLTAAHLLFVAPHNDSATGEPEASSGSGPPSGGALGPRALFASRVRPGQRVYVVAERDGDRRLLPAAVHSVTLSEEAAGAYAPLTAQGTILINRVLASCYAVIEEHSWAHRAFAPFRLAHALLAALAPARTDRGGDSGGGDRGGGGGRVALTAPGAADAPGAGATAGIHWYSQLLYQIGTWLLDSEALHPLGMAVKSS

SEQ ID NO: 7713 - protein, 707 aa, unidentified
MAAAATAAEGVPSRGPPGEVIHLNVGGKRFSTSRQTLTWIPDSFFSSLLSGRISTLKDETGAIFIDRDPTVFAPILNFLRTKELDPRGVHGSSLLHEAQFYGLTPLVRRLQLREELDRSSCGNVLFNGYLPPPVFPVKRRNRHSLVGPQQLGGRPAPVRRSNTMPPNLGNAGLLGRMLDEKTPPSPSGQPEEPGMVRLVCGHHNWIAVAYTQFLVCYRLKEASGWQLVFSSPRLDWPIERLALTARVHGGALGEHDKMVAAATGSEILLWALQAEGGGSEIGVFHLGVPVEALFFVGNQLIATSHTGRIGVWNAVTKHWQVQEVQPITSYDAAGSFLLLGCNNGSIYYVDVQKFPLRMKDNDLLVSELYRDPAEDGVTALSVYLTPKTSDSGNWIEIAYGTSSGGVRVIVQHPETVGSGPQLFQTFTVHRSPVTKIMLSEKHLISVCADNNHVRTWSVTRFRGMISTQPGSTPLASFKILALESADGHGGCSAGNDIGPYGERDDQQVFIQKVVPSASQLFVRLSSTGQRVCSVRSVDGSPTTAFTVLECEGSRRLGSRPRRYLLTGQANGSLAMWDLTTAMDGLGQAPAGGLTEQELMEQLEHCELAPPAPSAPSWGCLPSPSPRISLTSLHSASSNTSLSGHRGSPSPPQAEARRRGGGSFVERCQELVRSGPDLRRPPTPAPWPSSGLGTPLTPPKMKLNETSF

SEQ ID NO: 7714 - protein, 523 aa, unidentified
MVAPGLVLGLVLPLILWADRSAGIGFRFASYINNDMVLQKEPAGAVIWGFGTPGATVTVTLRQGQETIMKKVTSVKAHSDTWMVVLDPMKPGGPFEVMAQQTLEKINFTLRVHDVLFGDVWLCSGQSNMQMTVLQIFNATRELSNTAAYQSVRILSVSPIQAEQELEDLVAVDLQWSKPTSENLGHGYFKYMSAVCWLFGRHLYDTLQYPIGLIASSWGGTPIEAWSSGRSLKACGVPKQGSIPYDSVTGPSKHSVLWNAMIHPLCNMTLKGVVWYQGESNINYNTDLYNCTFPALIEDWRETFHRGSQGQTERFFPFGLVQLSSDLSKKSSDDGFPQIRWHQTADFGYVPNPKMPNTFMAVAMDLCDRDSPFGSIHPRDKQTVAYRLHLGARALAYGEKNLTFEGPLPEKIELLAHKGLLNLTYYQQIQVQKKDNKIFEISCCSDHRCKWLPASMNTVSTQSLTLAIDSCHGTVVALRYAWTTWPCEYKQCPLYHPSSALPAPPFIAFITDQGPGHQSNVAK

SEQ ID NO: 7715 - protein, 832 aa, unidentified; identical to SEQ ID NO: 3951

SEQ ID NO: 7716 - protein, 697 aa, unidentified; identical to SEQ ID NO: 3954

SEQ ID NO: 7717 - protein, 453 aa, unidentified; identical to SEQ ID NO: 3960

SEQ ID NO: 7718 - protein, 467 aa, unidentified; identical to SEQ ID NO: 3961

SEQ ID NO: 7719 - protein, 197 aa, unidentified; identical to SEQ ID NO: 3964

SEQ ID NO: 7720 - protein, 223 aa, unidentified; identical to SEQ ID NO: 3965

SEQ ID NO: 7721 - protein, 461 aa, unidentified
MAPQSLPSSRMAPLGMLLGLLMAACFTFCLSHQNLKEFALTNPEKSSTKETERKETKAEEELDAEVLEVFHPTHEWQALQPGQAVPAGSHVRLNLQTGEREAKLQYEDKFRNNLKGKRLDINTNTYTSQDLKSALAKFKEGAEMESSKEDKARQAEVKRLFRPIEELKKDFDELNVVIETDMQIMVRLINKFNSSSSSLEEKIAALFDLEYYVHQMDNAQDLLSFGGLQVVINGLNSTEPLVKEYAAFVLGAAFSSNPKVQVEAIEGGALQKLLVILATEQPLTAKKKVLFALCSLLRHFPYAQRQFLKLGGLQVLRTLVQEKGTEVLAVRVVTLLYDLVTEKMFAEEEAELTQEMSPEKLQQYRQVHLLPGLWEQGWCEITAHLLALPEHDAREKVLQTLGVLLTTCRDRYRQDPQLGRTLASLQAEYQVLASLELQDGEDEGYFQELLGSVNSLLKELR

SEQ ID NO: 7722 - protein, 398 aa, unidentified; identical to SEQ ID NO: 3970

SEQ ID NO: 7723 - protein, 197 aa, unidentified
MPIPASPLHPPLPSLLLYLLLELAGVTHVFHVQQTEMSQTVSTGESIILSCSVPNTLPNGPVLWFKGTGPNRKLIYNFKQGNFPRVKEIGDTTKPGNTDFSTRIREISLADAGTYYCVKFIKGRAIKEYQSGRGTQVFVTEQNPRPPKNRPAGRAGSRAHHDAHTCLSALPERNSTNYFVQPCCCLRLLGLTGLLSK

SEQ ID NO: 7724 - protein, 335 aa, unidentified; identical to SEQ ID NO: 3974

SEQ ID NO: 7725 - protein, 335 aa, unidentified; identical to SEQ ID NO: 3976

SEQ ID NO: 7726 - protein, 477 aa, unidentified; identical to SEQ ID NO: 3981

SEQ ID NO: 7727 - protein, 581 aa, unidentified; identical to SEQ ID NO: 4006

SEQ ID NO: 7728 - protein, 325 aa, unidentified; identical to SEQ ID NO: 4078

SEQ ID NO: 7729 - protein, 469 aa, unidentified
MLCLCLYVPVIGEAQTEFQYFESKGLPAELKSIFKLSVFIPSQEFSTYRQWKQKIVQAGDKDLDGQLDFEEFVHYLQDHEKKLRLVFKSLDKKNDGRIDAQEIMQSLRDLGVKISEQQAEKILKSMDKNGTMTIDWNEWRDYHLLHPVENIPEIILYWKHSTIFDVGENLTVPDEFTVEERQTGMWWRHLVAGGGAGAVSRTCTAPLDRLKVLMQVHASRSNNMGIVGGFTQMIREGGARSLWRGNGINVLKIAPESAIKFMAYEQIKRLVGSDQETLRIHERLVAGSLAGAIAQSSIYPMEVLKTRMALRKTGQYSGMLDCARRILAREGVAAFYKGYVPNMLGIIPYAGIDLAVYETLKNAWLQHYAVNSADPGVFVLLACGTMSSTCGQLASYPLALVRTRMQAQASIEGAPEVTMSSLFKHILRTEGAFGLYRGLAPNFMKVIPAVSISYVVYENLKITLGVQSR

SEQ ID NO: 7730 - protein, 501 aa, unidentified; identical to SEQ ID NO: 4143

SEQ ID NO: 7731 - protein, 313 aa, unidentified; identical to SEQ ID NO: 4181

SEQ ID NO: 7732 - protein, 831 aa, unidentified; identical to SEQ ID NO: 4212

SEQ ID NO: 7733 - protein, 492 aa, unidentified; identical to SEQ ID NO: 4216

SEQ ID NO: 7734 - protein, 647 aa, unidentified; identical to SEQ ID NO: 4219

SEQ ID NO: 7735 - protein, 540 aa, unidentified; identical to SEQ ID NO: 4220

SEQ ID NO: 7736 - protein, 685 aa, unidentified; identical to SEQ ID NO: 4225

SEQ ID NO: 7737 - protein, 1137 aa, unidentified; identical to SEQ ID NO: 4255

SEQ ID NO: 7738 - protein, 340 aa, unidentified; identical to SEQ ID NO: 4260

SEQ ID NO: 7739 - protein, 445 aa, unidentified; identical to SEQ ID NO: 4263

SEQ ID NO: 7740 - protein, 635 aa, unidentified; identical to SEQ ID NO: 4273

SEQ ID NO: 7741 - protein, 706 aa, unidentified; identical to SEQ ID NO: 4294

SEQ ID NO: 7742 - protein, 973 aa, unidentified; identical to SEQ ID NO: 4308

SEQ ID NO: 7743 - protein, 584 aa, unidentified; identical to SEQ ID NO: 4311

SEQ ID NO: 7744 - protein, 669 aa, unidentified; identical to SEQ ID NO: 4317

SEQ ID NO: 7745 - protein, 670 aa, unidentified; identical to SEQ ID NO: 4325

SEQ ID NO: 7746 - protein, 1534 aa, unidentified
MALTPGWGSSAGPVRPELWLLLWAAAWRLGASACPALCTCTGTTVDCHGTGLQAIPKNIPRNTERLELNGNNITRIHKNDFAGLKQLRVLQLMENQIGAVERGAFDDMKELERLRLNRNQLHMLPELLFQNNQALSRLDLSENAIQAIPRKAFRGATDLKNLQLDKNQISCIEEGAFRALRGLEVLTLNNNNITTIPVSSFNHMPKLRTFRLHSNHLFCDCHLAWLSQWLRQRPTIGLFTQCSGPASLRGLNVAEVQKSEFSCSGQGEAGRVPTCTLSSGSCPAMCTCSNGIVDCRGKGLTAIPANLPETMTEIRLELNGIKSIPPGAFSPYRKLRRIDLSNNQIAEIAPDAFQGLRSLNSLVLYGNKITDLPRGVFGGLYTLQLLLLNANKINCIRPDAFQDLQNLSLLSLYDNKIQSLAKGTFTSLRAIQTLHLAQNPFICDCNLKWLADFLRTNPIETSGARCASPRRLANKRIGQIKSKKFRCSAKEQYFIPGTEDYQLNSECNSDVVCPHKCRCEANVVECSSLKLTKIPERIPQSTAELRLNNNEISILEATGMFKKLTHLKKINLSNNKVSEIEDGAFEGAASVSELHLTANQLESIRSGMFRGLDGLRTLMLRNNRISCIHNDSFTGLRNVRLLSLYDNQITTVSPGAFDTLQSLSTLNLLANPFNCNCQLAWLGGWLRKRKIVTGNPRCQNPDFLRQIPLQDVAFPDFRCEEGQEEGGCLPRPQCPQECACLDTVVRCSNKHLRALPKGIPKNVTELYLDGNQFTLVPGQLSTFKYLQLVDLSNNKISSLSNSSFTNMSQLTTLILSYNALQCIPPLAFQGLRSLRLLSLHGNDISTLQEGIFADVTSLSHLAIGANPLYCDCHLRWLSSWVKTGYKEPGIARCAGPQDMEGKLLLTTPAKKFECQGPPTLAVQAKCDLCLSSPCQNQGTCHNDPLEVYRCACPSGYKGRDCEVSLDSCSSGPCENGGTCHAQEGEDAPFTCSCPTGFEGPTCGVNTDDCVDHACANGGVCVDGVGNYTCQCPLQYEGKACEQLVDLCSPDLNPCQHEAQCVGTPDGPRCECMPGYAGDNCSENQDDCRDHRCQNGAQCMDEVNSYSCLCAEGYSGQLCEIPPHLPAPKSPCEGTECQNGANCVDQGNRPVCQCLPGFGGPECEKLLSVNFVDRDTYLQFTDLQNWPRANITLQVSTAEDNGILLYNGDNDHIAVELYQGHVRVSYDPGSYPSSAIYSAETINDGQFHTVELVAFDQMVNLSIDGGSPMTMDNFGKHYTLNSEAPLYVGGMPVDVNSAAFRLWQILNGTGFHGCIRNLYINNELQDFTKTQMKPGVVPGCEPCRKLYCLHGICQPNATPGPMCHCEAGWVGLHCDQPADGPCHGHKCVHGQCVPLDALSYSCQCQDGYSGALCNQAGALAEPCRGLQCLHGHCQASGTKGAHCVCDPGFSGELCEQESECRGDPVRDFHQVQRGYAICQTTRPLSWVECRGSCPGQGCCQGLRLKRRKFTFECSDGTSFAEEVEKPTKCGCALCA

SEQ ID NO: 7747 - protein, 1529 aa, unidentified; identical to SEQ ID NO: 4340

SEQ ID NO: 7748 - protein, 1523 aa, unidentified
MAPGWAGVGAAVRARLALALALASVLSGPPAVACPTKCTCSAASVDCHGLGLRAVPRGIPRNAERLDLDRNNITRITKMDFAGLKNLRVLHLEDNQVSVIERGAFQDLKQLERLRLNKNKLQVLPELLFQSTPKLTRLDLSENQIQGIPRKAFRGITDVKNLQLDNNHISCIEDGAFRALRDLEILTLNNNNISRILVTSFNHMPKIRTLRLHSNHLYCDCHLAWLSDWLRQRRTVGQFTLCMAPVHLRGFNVADVQKKEYVCPAPHSEPPSCNANSISCPSPCTCSNNIVDCRGKGLMEIPANLPEGIVEIRLEQNSIKAIPAGAFTQYKKLKRIDISKNQISDIAPDAFQGLKSLTSLVLYGNKITEIVKGLFDGLVSLQLLLLNANKINCLRVNTFQDLQNLNLLSLYDNKLQTISKGLFAPLQSIQTLHLAQNPFVCDCHLKWLADYLQDNPIETSGARCSSPRRLANKRISQIKSKKFRCSGSEDYRSRFSSECFMDLVCPEKCRCEGTIVDCSNQKLVRIPSHLPEYVTDLRLNDNEVSVLEATGIFKKLPNLRKINLSNNKIKEVREGAFDGAASVQELMLTGNQLETVHGRVFRGLSGLKTLMLRSNLIGCVSNDTFAGLSSVRLLSLYDNRITTITPGAFTTLVSLSTINLLSNPFNCNCHLAWLGKWLRKRRIVSGNPRCQKPFFLKEIPIQDVAIQDFTCDGNEESSCQLSPRCPEQCTCMETVVRCSNKGLRALPRGMPKDVTELYLEGNHLTAVPRELSALRHLTLIDLSNNSISMLTNYTFSNMSHLSTLILSYNRLRCIPVHAFNGLRSLRVLTLHGNDISSVPEGSFNDLTSLSHLALGTNPLHCDCSLRWLSEWVKAGYKEPGIARCSSPEPMADRLLLTTPTHRFQCKGPVDINIVAKCNACLSSPCKNNGTCTQDPVELYRCACPYSYKGKDCTVPINTCIQNPCQHGGTCHLSDSHKDGFSCSCPLGFEGQRCEINPDDCEDNDCENNATCVDGINNYVCICPPNYTGELCDEVIDHCVPELNLCQHEAKCIPLDKGFSCECVPGYSGKLCETDNDDCVAHKCRHGAQCVDTINGYTCTCPQGFSGPFCEHPPPMVLLQTSPCDQYECQNGAQCIVVQQEPTCRCPPGFAGPRCEKLITVNFVGKDSYVELASAKVRPQANISLQVATDKDNGILLYKGDNDPLALELYQGHVRLVYDSLSSPPTTVYSVETVNDGQFHSVELVTLNQTLNLVVDKGTPKSLGKLQKQPAVGINSPLYLGGIPTSTGLSALRQGTDRPLGGFHGCIHEVRINNELQDFKALPPQSLGVSPGCKSCTVCKHGLCRSVEKDSVVCECRPGWTGPLCDQEARDPCLGHRCHHGKCVATGTSYMCKCAEGYGGDLCDNKNDSANACSAFKCHHGQCHISDQGEPYCLCQPGFSGEHCQQENPCLGQVVREVIRRQKGYASCATASKVPIMECRGGCGPQCCQPTRSKRRKYVFQCTDGSSFVEEVERHLECGCLACS

SEQ ID NO: 7749 - protein, 977 aa, unidentified; identical to SEQ ID NO: 4343

SEQ ID NO: 7750 - protein, 132 aa, unidentified
MKSSGLFPFLVLLALGTLAPWAVEGSGKSFKAGVCPPKKSAQCLRYKKPECQSDWQCPGKKRCCPDTCGIKCLDPVDTPNPTRRKPGKCPVTYGQCLMLNPPNFCEMDGQCKRDLKCCMGMCGKSCVSPVKA

SEQ ID NO: 7751 - protein, 1034 aa, unidentified
MAAATGAVAASAASGQAEGKKITDLRVIDLKSELKRRNLDITGVKTVLISRLKQAIEEEGGDPDNIELTVSTDTPNKKPTKGKGKKHEADELSGDASVEDDAFIKDCELENQEAHEQDGNDELKDSEEFGENEEENVHSKELLSAEENKRAHELIEAEGIEDIEKEDIESQEIEAQEGEDDTFLTAQDGEEEENEKDIAGSGDGTQEVSKPLPSEGSLAEADHTAHEEMEAHTTVKEAEDDNISVTIQAEDAITLDFDGDDLLETGKNVKITDSEASKPKDGQDAIAQSPEKESKDYEMNANHKDGKKEDCVKGDPVEKEARESSKKAESGDKEKDTLKKGPSSTGASGQAKSSSKESKDSKTSSKDDKGSTSSTSGSSGSSTKNIWVSGLSSNTKAADLKNLFGKYGKVLSAKVVTNARSPGAKCYGIVTMSSSTEVSRCIAHLHRTELHGQLISVEKVKGDPSKKEMKKENDEKSSSRSSGDKKNTSDRSSKTQASVKKEEKRSSEKSEKKESKDTKKIEGKDEKNDNGASGQTSESIKKSEEKKRISSKSPGHMVILDQTKGDHCRPSRRGRYEKIHGRSKEKERASLDKKRDKDYRRKEILPFEKMKEQRLREHLVRFERLRRAMELRRRREIAERERRERERIRIIREREERERLQRERERLEIERQKLERERMERERLERERIRIEQERRKEAERIAREREELRRQQQQLRYEQEKRNSLKRPRDVDHRRDDPYWSENKKLSLDTDARFGHGSDYSRQQNRFNDFDHRERGRFPESSAVQSSSFERRDRFVGQSEGKKARPTARREDPSFERYPKNFSDSRRNEPPPPRNELRESDRREVRGERDERRTVIIHDRPDITHPRHPREAGPNPSRPTSWKSEGSMSTDKRETRVERPERSGREVSGHSVRGAPPGNRSSASGYGSREGDRGVITDRGGGSQHYPEERHVVERHGRDTSGPRKEWHGPPSQGPSYHDTRRMGDGRAGAGMITQHSSNASPINRIVQISGNSMPRGSGSGFKPFKGGPPRRF

SEQ ID NO: 7752 - protein, 103 aa, unidentified
MASRWAVQLLLVAAWSMGCGEALKCYTCKEPMTSASCRTITRCKPEDTACMTTLVTVEAEYPFNQSPVVTRSCSSSCVATDPDSIGAAHLIFCCFRDLCNSEL

SEQ ID NO: 7753 - protein, 1590 aa, unidentified
MSTPTDPGAMPHPGPSPGPGPSPGPILGPSPGPGPSPGSVHSMMGPSPGPPSVSHPMPTMGSTDFPQEGMHQMHKPIDGIHDKGIVEDIHCGSMKGTGMRPPHPGMGPPQSPMDQHSQGYMSPHPSPLGAPEHVSSPMSGGGPTPPQMPPSQPGALIPGDPQAMSQPNRGPSPFSPVQLHQLRAQILAYKMLARGQPLPETLQLAVQGKRTLPGLQQQQQQQQQQQQQQQQQQQQQQQPQQQPPQPQTQQQQQPALVNYNRPSGPGPELSGPSTPQKLPVPAPGGRPSPAPPAAAQPPAAAVPGPSVPQPAPGQPSPVLQLQQKQSRISPIQKPQGLDPVEILQEREYRLQARIAHRIQELENLPGSLPPDLRTKATVELKALRLLNFQRQLRQEVVACMRRDTTLETALNSKAYKRSKRQTLREARMTEKLEKQQKIEQERKRRQKHQEYLNSILQHAKDFKEYHRSVAGKIQKLSKAVATWHANTEREQKKETERIEKERMRRLMAEDEEGYRKLIDQKKDRRLAYLLQQTDEYVANLTNLVWEHKQAQAAKEKKKRRRRKKKAEENAEGGESALGPDGEPIDESSQMSDLPVKVTHTETGKVLFGPEAPKASQLDAWLEMNPGYEVAPRSDSEESDSDYEEEDEEEESSRQETEEKILLDPNSEEVSEKDAKQIIETAKQDVDDEYSMQYSARGSQSYYTVAHAISERVEKQSALLINGTLKHYQLQGLEWMVSLYNNNLNGILADEMGLGKTIQTIALITYLMEHKRLNGPYLIIVPLSTLSNWTYEFDKWAPSVVKISYKGTPAMRRSLVPQLRSGKFNVLLTTYEYIIKDKHILAKIRWKYMIVDEGHRMKNHHCKLTQVLNTHYVAPRRILLTGTPLQNKLPELWALLNFLLPTIFKSCSTFEQWFNAPFAMTGERVDLNEEETILIIRRLHKVLRPFLLRRLKKEVESQLPEKVEYVIKCDMSALQKILYRHMQAKGILLTDGSEKDKKGKGGAKTLMNTIMQLRKICNHPYMFQHIEESFAEHLGYSNGVINGAELYRASGKFELLDRILPKLRATNHRVLLFCQMTSLMTIMEDYFAFRNFLYLRLDGTTKSEDRAALLKKFNEPGSQYFIFLLSTRAGGLGLNLQAADTVVIFDSDWNPHQDLQAQDRAHRIGQQNEVRVLRLCTVNSVEEKILAAAKYKLNVDQKVIQAGMFDQKSSSHERRAFLQAILEHEEENEEEDEVPDDETLNQMIARREEEFDLFMRMDMDRRREDARNPKRKPRLMEEDELPSWIIKDDAEVERLTCEEEEEKIFGRGSRQRRDVDYSDALTEKQWLRAIEDGNLEEMEEEVRLKKRKRRRNVDKDPAKEDVEKAKKRRGRPPAEKLSPNPPKLTKQMNAIIDTVINYKDRCNVEKVPSNSQLEIEGNSSGRQLSEVFIQLPSRKELPEYYELIRKPVDFKKIKERIRNHKYRSLGDLEKDVMLLCHNAQTFNLEGSQIYEDSIVLQSVFKSARQKIAKEEESEDESNEEEEEEDEEESESEAKSVKVKIKLNKKDDKGRDKGKGKKRPNRGKAKPVVSDFDSDEEQDEREQSEGSGTDDE

SEQ ID NO: 7754 - protein, 1419 aa, unidentified
MAEGLERVRISASELRGILATLAPQAGSRENMKELKEARPRKDNRRPDLEIYKPGLSRLRNKPKIKEPPGSEEFKDEIVNDRDCSAVENGTQPVKDVCKELNNQEQNGPIDPENNRGQESFPRTAGQEDRSLKIIKRTKKPDLQIYQPGRRLQTVSKESASRVEEEEVLNQVEQLRVEEDECRGNVAKEEVANKPDRAEIEKSPGGGRVGAAKGEKGKRMGKGEGVRETHDDPARGRPGSAKRYSRSDKRRNRYRTRSTSSAGSNNSAEGAGLTDNGCRRRRQDRTKERPRLKKQVSVSSTDSLDEDRIDEPDGLGPRRSSERKRHLERNWSGRGEGEQKNSAKEYRGTLRVTFDAEAMNKESPMVRSARDDMDRGKPDKGLSSGGKGSEKQESKNPKQELRGRGRGILILPAHTTLSVNSAGSPESAPLGPRLLFGSGSKGSRSWGRGGTTRRLWDPNNPDQKPALKTQTPQLHFLDTDDEVSPTSWGDSRQAQASYYKFQNSDNPYYYPRTPGPASQYPYTGYNPLQYPVGPTNGVYPGPYYPGYPTPSGQYVCSPLPTSTMSPEEVEQHMRNLQQQELHRLLRVADNQELQLSNLLSRDRISPEGLEKMAQLRAELLQLYERCILLDIEFSDNQNVDQILWKNAFYQVIEKFRQLVKDPNVENPEQIRNRLLELLDEGSDFFDSLLQKLQVTYKFKLEDYMDGLAIRSKPLRKTVKYALISAQRCMICQGDIARYREQASDTANYGKARSWYLKAQHIAPKNGRPYNQLALLAVYTRRKLDAVYYYMRSLAASNPILTAKESLMSLFEETKRKAEQMEKKQHEEFDLSPDQWRKGKKSTFRHVGDDTTRLEIWIHPSHPRSSQGTESGKDSEQENGLGSLSPSDLNKRFILSFLHAHGKLFTRIGMETFPAVAEKVLKEFQVLLQHSPSPIGSTRMLQLMTINMFAVHNSQLKDCFSEECRSVIQEQAAALGLAMFSLLVRRCTCLLKESAKAQLSSPEDQDDQDDIKVSSFVPDLKELLPSVKVWSDWMLGYPDTWNPPPTSLDLPSHVAVDVWSTLADFCNILTAVNQSEVPLYKDPDDDLTLLILEEDRLLSGFVPLLAAPQDPCYVEKTSDKVIAADCKRVTVLKYFLEALCGQEEPLLAFKGGKYVSVAPVPDTMGKEMGSQEGTRLEDEEEDVVIEDFEEDSEAEGSGGEDDIRELRAKKLALARKIAEQQRRQEKIQAVLEDHSQMRQMELEIRPLFLVPDTNGFIDHLASLARLLESRKYILVVPLIVINELDGLAKGQETDHRAGGYARVVQEKARKSIEFLEQRFESRDSCLRALTSRGNELESIAFRSEDITGQLGNNDDLILSCCLHYCKDKAKDFMPASKEEPIRLLREVVLLTDDRNLRVKALTRNVPVRDIPAFLTWAQVG

SEQ ID NO: 7755 - protein, 75 aa, unidentified; identical to SEQ ID NO: 4376

SEQ ID NO: 7756 - protein, 434 aa, unidentified
MLPARCARLLTPHLLLVLVQLSPARGHRTTGPRFLISDRDPQCNLHCSRTQPKPICASDGRSYESMCEYQRAKCRDPTLGVVHRGRCKDAGQSKCRLERAQALEQAKKPQEAVFVPECGEDGSFTQVQCHTYTGYCWCVTPDGKPISGSSVQNKTPVCSGSVTDKPLSQGNSGRKDDGSKPTPTMETQPVFDGDEITAPTLWIKHLVIKDSKLNNTNIRNSEKVYSCDQERQSALEEAQQNPREGIVIPECAPGGLYKPVQCHQSTGYCWCVLVDTGRPLPGTSTRYVMPSCESDARAKTTEADDPFKDRELPGCPEGKKMEFITSLLDALTTDMVQAINSAAPTGGGRFSEPDPSHTLEERVVHWYFSQLDSNSSNDINKREMKPFKRYVKKKAKPKKCARRFTDYCDLNKDKVISLPELKGCLGVSKEGRLV

SEQ ID NO: 7757 - protein, 446 aa, unidentified; identical to SEQ ID NO: 4381

SEQ ID NO: 7758 - protein, 453 aa, unidentified
MALVRALVCCLLTAWHCRSGLGLPVAPAGGRNPPPAIGQFWHVTDLHLDPTYHITDDHTKVCASSKGANASNPGPFGDVLCDSPYQLILSAFDFIKNSGQEASFMIWTGDSPPHVPVPELSTDTVINVITNMTTTIQSLFPNLQVFPALGNHDYWPQDQLPVVTSKVYNAVANLWKPWLDEEAISTLRKGGFYSQKVTTNPNLRIISLNTNLYYGPNIMTLNKTDPANQFEWLESTLNNSQQNKEKVYIIAHVPVGYLPSSQNITAMREYYNEKLIDIFQKYSDVIAGQFYGHTHRDSIMVLSDKKGSPVNSLFVAPAVTPVKSVLEKQTNNPGIRLFQYDPRDYKLLDMLQYYLNLTEANLKGESIWKLEYILTQTYDIEDLQPESLYGLAKQFTILDSKQFIKYYNYFFVSYDSSVTCDKTCKAFQICAIMNLDNISYADCLKQLYIKHNY

SEQ ID NO: 7759 - protein, 455 aa, unidentified
MRLLAWLIFLANWGGARAEPGKFWHIADLHLDPDYKVSKDPFQVCPSAGSQPVPDAGPWGDYLCDSPWALINSSIYAMKEIEPEPDFILWTGDDTPHVPDEKLGEAAVLEIVERLTKLIREVFPDTKVYAALGNHDFHPKNQFPAGSNNIYNQIAELWKPWLSNESIALFKKGAFYCEKLPGPSGAGRIVVLNTNLYYTSNALTADMADPGQQFQWLEDVLTDASKAGDMVYIVGHVPPGFFEKTQNKAWFREGFNEKYLKVVRKHHRVIAGQFFGHHHTDSFRMLYDDAGVPISAMFITPGVTPWKTTLPGVVNGANNPAIRVFEYDRATLSLKDMVTYFMNLSQANAQGTPRWELEYQLTEAYGVPDASAHSMHTVLDRIAGDQSTLQRYYVYNSVSYSAGVCDEACSMQHVCAMRQVDIDAYTTCLYASGTTPVPQLPLLLMALLGLCTLVL

SEQ ID NO: 7760 - protein, 134 aa, unidentified
MKSLTWILGLWALAACFTPGESQRGPRGPYPPGPLAPPPPPCFPFGTGFVPPPHPPPYGPGRFPPPLSPPYGPGRIPPSPPPPYGPGRIQSHSLPPPYGPGYPQPPSQPRPYPPGPPFFPVNSPTDPALPTPAP

SEQ ID NO: 7761 - protein, 79 aa, unidentified
MKSLTWILGLWALAACFTPGESQRGPRGPYPPGPLAPPQPFGPGFVPPPPPPPYGPGRIPPPPPAPYGPGIFPPPPPQP

SEQ ID NO: 7762 - protein, 1413 aa, unidentified
MRHGVAWALLVAAALGLGARGVRGAVALADFYPFGAERGDAVTPKQDDGGSGLRPLSVPFPFFGAEHSGLYVNNNGIISFLKEVSQFTPVAFPIAKDRCVVAAFWADVDNRRAGDVYYREATDPAMLRRATEDVRHYFPELLDFNATWVFVATWYRVTFFGGSSSSPVNTFQTVLITDGKLSFTIFNYESIVWTTGTHASSGGNATGLGGIAAQAGFNAGDGQRYFSIPGSRTADMAEVETTTNVGVPGRWAFRIDDAQVRVGGCGHTTSVCLALRPCLNGGKCIDDCVTGNPSYTCSCLSGFTGRRCHLDVNECASQPCQNGGTCTHGINSFRCQCPAGFGGPTCETAQSPCDTKECQHGGQCQVENGSAVCVCQAGYTGAACEMDVDDCSPDPCLNGGSCVDLVGNYTCLCAEPFKGLRCETGDHPVPDACLSAPCHNGGTCVDADQGYVCECPEGFMGLDCRERVPDDCECRNGGRCLGANTTLCQCPLGFFGLLCEFEITAMPCNMNTQCPDGGYCMEHGGSYLCVCHTDHNASHSLPSPCDSDPCFNGGSCDAHDDSYTCECPRGFHGKHCEKARPHLCSSGPCRNGGTCKEAGGEYHCSCPYRFTGRHCEIGKPDSCASGPCHNGGTCFHYIGKYKCDCPPGFSGRHCEIAPSPCFRSPCVNGGTCEDRDTDFFCHCQAGYMGRRCQAEVDCGPPEEVKHATLRFNGTRLGAVALYACDRGYSLSAPSRIRVCQPHGVWSEPPQCLEIDECRSQPCLHGGSCQDRVAGYLCLCSTGYEGAHCELERDECRAHPCRNGGSCRNLPGAYVCRCPAGFVGVHCETEVDACDSSPCQHGGRCESGGGAYLCVCPESFFGYHCETVSDPCFSSPCGGRGYCLASNGSHSCTCKVGYTGEDCAKELFPPTALKMERVEESGVSISWNPPNGPAARQMLDGYAVTYVSSDGSYRRTDFVDRTRSSHQLQALAAGRAYNISVFSVKRNSNNKNDISRPAVLLARTRPRPVEGFEVTNVTASTISVQWALHRIRHATVSGVRVSIRHPEALRDQATDVDRSVDRFTFRALLPGKRYTIQLTTLSGLRGEEHPTESLATAPTHVWTRPLPPANLTAARVTATSAHVVWDAPTPGSLLEAYVINVTTSQSTKSRYVPNGKLASYTVRDLLPGRRYQLSVIAVQSTELGPQHSEPAHLYIITSPRDGADRRWHQGGHHPRVLKNRPPPARLPELRLLNDHSAPETPTQPPRFSELVDGRGRVSARFGGSPSKAATVRSQPTASAQLENMEEAPKRVSLALQLPEHGSKDIGNVPGNCSENPCQNGGTCVPGADAHSCDCGPGFKGRRCELACIKVSRPCTRLFSETKAFPVWEGGVCHHVYKRVYRVHQDICFKESCESTSLKKTPNRKQSKSQTLEKS

SEQ ID NO: 7763 - protein, 538 aa, unidentified [sequence omitted]

SEQ ID NO: 7764 - protein, 540 aa, unidentified
MRVAAATAAAGAGPAMAVWTRATKAGLVELLLRERWVRVVAELSGESLSLTGDAAAAELEPALGPAAAAFNGLPNGGGAGDSLPGSPSRGLGPPSPPAPPRGPAGEAGASPPVRRVRVVKQEAGGLGISIKGGRENRMPILISKIFPGLAADQSRALRLGDAILSVNGTDLRQATHDQAVQALKRAGKEVLLEVKFIREVTPYIKKPSLVSDLPWEGAAPQSPSFSGSEDSGSPKHQNSTKDRKIIPLKMCFAARNLSMPDLENRLIELHSPDSRNTLILRCKDTATAHSWFVAIHTNIMALLPQVLAELNAMLGATSTAGGSKEVKHIAWLAEQAKLDGGRQQWRPVLMAVTEKDLLLYDCMPWTRDAWASPCHSYPLVATRLVHSGSGCRSPSLGSDLTFATRTGSRQGIEMHLFRVETHRDLSSWTRILVQGCHAAAELIKEVSLGCMLNGQEVRLTIHYENGFTISRENGGSSSILYRYPFERLKMSADDGIRNLYLDFGGPEGELTMDLHSCPKPIVFVLHTFLSAKVTRMGLLV

SEQ ID NO: 7765 - protein, 946 aa, unidentified; identical to SEQ ID NO: 4392

SEQ ID NO: 7766 - protein, 240 aa, unidentified
MLALLCSCLLLAAGASDAWTGEDSAEPNSDSAEWIRDMYAKVTEIWQEVMQRRDDDGALHAACQVQPSATLDAAQPRVTGVVLFRQLAPRAKLDAFFALEGFPTEPNSSSRAIHVHQFGDLSQGCESTGPHYNPLAVPHPQHPGDFGNFAVRDGSLWRYRAGLAASLAGPHSIVGRAVVVHAGEDDLGRGGNQASVENGNAGRRLACCVVGVCGPGLWERQAREHSERKKRRRESECKAA

SEQ ID NO: 7767 - protein, 213 aa, unidentified
MQLPLALCLVCLLVHTAFRVVEGQGWQAFKNDATEIIPELGEYPEPPPELENNKTMNRAENGGRPPHHPFETKDVSEYSCRELHFTRYVTDGPCRSAKPVTELVCSGQCGPARLLPNAIGRGKWWRPSGPDFRCIPDRYRAQRVQLLCPGGEAPRARKVRLVASCKCKRLTRFHNQSELKDFGTEAARPQKGRKPRPRARSAKANQAELENAY

SEQ ID NO: 7768 - protein, 206 aa, unidentified
MLPPAIHFYLLPLACILMKSCLAFKNDATEILYSHVVKPVPAHPSSNSTLNQARNGGRHFSNTGLDRNTRVQVGCRELRSTKYISDGQCTSISPLKELVCAGECLPLPVLPNWIGGGYGTKYWSRRSSQEWRCVNDKTRTQRIQLQCQDGSTRTYKITVVTACKCKRYTRQHNESSHNFESMSPAKPVQHHRERKRASKSSKHSMS

SEQ ID NO: 7769 - protein, 549 aa, unidentified
MALAAAAAAAAAGVSQAAVLGFLQEHGGKVRNSELLSRFKPLLDAGDPRGRAARRDRFKQFVNNVAVVKELDGVKFVVLRKKPRPPEPEPAPFGPPGAAAQPSKPTSTVLPRSASAPGAPPLVRVPRPVEPPGDLGLPTEPQDTPGGPASEPAQPPGERSADPPLPALELAQATERPSADAAPPPRAPSEAASPCSDPPDAEPGPGAAKGPPQQKPCMLPVRCVPAPATLRLRAEEPGLRRQLSEEPSPRSSPLLLRRLSVEESGLGLGLGPGRSPHLRRLSRAGPRLLSPDAEELPAAPPPSAVPLEPSEHEWLVRTAGGRWTHQLHGLLLRDRGLAAKRDFMSGFTALHWAAKSGDGEMALQLVEVARRSGAPVDVNARSHGGYTPLHLAALHGHEDAAVLLVVRLGAQVHVRDHSGRRAYQYLRPGSSYALRRLLGDPGLRGTTEPDATGGGSGSLAARRPVQVAATILSSTTSAFLGVLADDLMLQDLARGLKKSSSFSKFLSASPMAPRKKTKIRGGLPAFSEISRRPTPGPLAGLVPSFPPTT

SEQ ID NO: 7770 - protein, 215 aa, unidentified [sequence omitted]

SEQ ID NO: 7771 - protein, 124 aa, unidentified
MVLCWLLLLVMALPPGTTGVKDCVFCELTDSMQCPGTYMHCGDDEDCFTGHGVAPGTGPVINKGCLRATSCGLEEPVSYRGVTYSLTTNCCTGRLCNRAPSSQTVGATTSLALGLGMLLPPRLL

SEQ ID NO: 7772 - protein, 159 aa, unidentified
MKAWGTVVVTLATLMVVTVDAKIYERCELAARLERAGLNGYKGYGVGDWLCMAHYESGFDTAFVDHNPDGSSEYGIFQLNSAWWCDNGITPTKNLCHMDCHDLLNRHILDDIRCAKQIVSSQNGLSAWTSWRLHCSGHDLSEWLKGCDMHVKIDPKIHP

SEQ ID NO: 7773 - protein, 159 aa, unidentified; identical to SEQ ID NO: 7772

SEQ ID NO: 7774 - protein, 195 aa, unidentified
MAVSQGDGTLCFVLLLCCWQETELRPRTVIPGSPTEIPFSSKQEDMSELLDEILVQEILDLNKTTPSEMPSTASTLSTPLHAGIDENYQAGGSENYHELLENLQFSPGIEVKISNDEANANANLHGDPSENYRGPQVSPGSEKSVSSKEKNSKNTQYENLSILDQILQNIGRSSGNIFHKEQQRTSAQRRSQGSQ

SEQ ID NO: 7775 - protein, 123 aa, unidentified
MRQRLLPSVTSLLLVALLFPGSSQARHVNHSATEALGELRERAPGQGTNGFQLLRHAVKRDLLPPRTPPYQVHISHQEARGPSFKICVGFLGPRWARGCSTGNEKYHLPYAARDLQTFFLPFW

SEQ ID NO: 7776 - protein, 103 aa, unidentified
MRQRLLPSVTSLLLVALLFPGSSQARHVNHSATEALGELRERAPGQGTNGFQLLRHAVKRDLLPPRTPPYQVHISHREARGPSFRICVDFLGPRWARGCSTGN

SEQ ID NO: 7777 - protein, 303 aa, unidentified
MRAWIFFLLCLAGRALAAPQQEALPDETEVVEETVAEVTEVSVGANPVQVEVGEFDDGAEETEEEVVAENPCQNHHCKHGKVCELDENNTPMCVCQDPTSCPAPIGEFEKVCSNDNKTFDSSCHFFATKCTLEGTKKGHKLHLDYIGPCKYIPPCLDSELTEFPLRMRDWLKNVLVTLYERDEDNNLLTEKQKLRVKKIHENEKRLEAGDHPVELLARDFEKNYNMYIFPVHWQFGQLDQHPIDGYLSHTELAPLRAPLIPMEHCTTRFFETCDLDNDKYIALDEWAGCFGIKQKDIDKDLVI

SEQ ID NO: 7778 - protein, 664 aa, unidentified
MKTGLFFLCLLGTAAAIPTNARLLSDHSKPTAETVAPDNTAIPSLRAEAEENEKETAVSTEDDSHHKAEKSSVLKSKEESHEQSAEQGKSSSQELGLKDQEDSDGHLSVNLEYAPTEGTLDIKEDMSEPQEKKLSENTDFLAPGVSSFTDSNQQESITKREENQEQPRNYSHHQLNRSSKHSQGLRDQGNQEQDPNISNGEEEEEKEPGEVGTHNDNQERKTELPREHANSKQEEDNTQSDDILEESDQPTQVSKMQEDEFDQGNQEQEDNSNAEMEEENASNVNKHIQETEWQSQEGKTGLEAISNHKETEEKTVSEALLMEPTDDGNTTPRNHGVDDDGDDDGDDGGTDGPRHSASDDYFIPSQAFLEAERAQSIAYHLKIEEQREKVHENENIGTTEPGEHQEAKKAENSSNEEETSSEGNMRVHAVDSCMSFQCKRGHICKADQQGKPHCVCQDPVTCPPTKPLDQVCGTDNQTYASSCHLFATKCRLEGTKKGHQLQLDYFGACKSIPTCTDFEVIQFPLRMRDWLKNILMQLYEANSEHAGYLNEKQRNKVKKIYLDEKRLLAGDHPIDLLLRDFKKNYHMYVYPVHWQFSELDQHPMDRVLTHSELAPLRASLVPMEHCITRFFEECDPNKDKHITLKEWGHCFGIKEEDIDENLLF

SEQ ID NO: 7779 - protein, 786 aa, unidentified
MLGARAWLGRVLLLPRAGAGLAASRRGSSSRDKDRSATVSSSVPMPAGGKGSHPSSTPQRVPNRLIHEKSPYLLQHAYNPVDWYPWGQEAFDKARKENKPIFLSVGYSTCHWCHMMEEESFQNEEIGRLLSEDFVSVKVDREERPDVDKVYMTFVQATSSGGGWPMNVWLTPNLQPFVGGTYFPPEDGLTRVGFRTVLLRIREQWKQNKNTLLENSQRVTTALLARSEISVGDRQLPPSAATVNNRCFQQLDEGYDEEYGGFAEAPKFPTPVILSFLFSYWLSHRLTQDGSRAQQMALHTLKMMANGGIRDHVGQGFHRYSTDRQWHVPHFEKMLYDQAQLAVAYSQAFQLSGDEFYSDVAKGILQYVARSLSHRSGGFYSAEDADSPPERGQRPKEGAYYVWTVKEVQQLLPEPVLGATEPLTSGQLLMKHYGLTEAGNISPSQDPKGELQGQNVLTVRYSLELTAARFGLDVEAVRTLLNSGLEKLFQARKHRPKPHLDSKMLAAWNGLMVSGYAVTGAVLGQDRLINYATNGAKFLKRHMFDVASGRLMRTCYTGPGGTVEHSNPPCWGFLEDYAFVVRGLLDLYEASQESAWLEWALRLQDTQDKLFWDSQGGGYFCSEAELGAGLPLRLKDDQDGAEPSANSVSAHNLLRLHGFTGHKDWMDKCVCLLTAFSERMRRVPVALPEMVRALSAQQQTLKQIVICGDRQAKDTKALVQCVHSVYIPNKVLILADGDPSSFLSRQLPFLSTLRRLEDQATAYVCENQACSVPITDPCELRKLLHP

SEQ ID NO: 7780 - protein, 350 aa, unidentified
MKPLVLLVALLLWPSSVPAYPSITVTPDEEQNLNHYIQVLENLVRSVPSGEPGREKKSNSPKHVYSIASKGSKFKELVTHGDASTENDVLTNPISEETTTFPTGGFTPEIGKKKHTESTPFWSIKPNNVSIVLHAEEPYIENEEPEPEPEPAAKQTEAPRMLPVVTESSTSPYVTSYKSPVTTLDKSTGIGISTESEDVPQLSGETAIEKPEEFGKHPESWNNDDILKKILDINSQVQQALLSDTSNPAYREDIEASKDHLKRSLALAAAAEHKLKTMYKSQLLPVGRTSNKIDDIETVINMLCNSRSKLYEYLDIKCVPPEMREKAATVFNTLKNMCRSRRVTALLKVY

SEQ ID NO: 7781 - protein, 79 aa, unidentified
MKVTGIFLLSALALLSLSGNTGADSLGREAKCYNELNGCTKIYDPVCGTDGNTYPNECVLCFENRKRQTSILIQKSGPC

SEQ ID NO: 7782 - protein, 94 aa, unidentified
MAAFPHKIIFFLVCSTLTHVAFSGIFNKRDFTRWPKPRCKMYIPLDPDYNADCPNVTAPVCASNGHTFQNECFFCVEQREFHYRIKFEKYGKCD

SEQ ID NO: 7783 - protein, 97 aa, unidentified
MAKSFPVFSLLSFILIHLVLSSVSGPRHWWPPRGIIKVKCPYEKVNLSWYNGTVNPCPGLYQPICGTNFITYDNPCILCVESLKSHGRIRFYHDGKC

SEQ ID NO: 7784 - protein, 84 aa, unidentified
MALSVLRLALLLLAVTFAASLIPQFGLFSKYRTPNCSQYRLPGCPRHFNPVCGSDMSTYANECTLCMKIREGGHNIKIIRNGPC

SEQ ID NO: 7785 - protein, 86 aa, unidentified
MAVRQWVIALALAALLVVDREVPVAAGKLPFSRMPICEHMVESPTCSQMSNLVCGTDGLTYTNECQLCLARIKTKQDIQIMKDGKC

SEQ ID NO: 7786 - protein, 1064 aa, unidentified
MKIATVSVLLPLALCLIQDAASKNEDQEMCHEFQAFMKNGKLFCPQDKKFFQSLDGIMFINKCATCKMILEKEAKSQKRARHLARAPKATAPTELNCDDFKKGERDGDFICPDYYEAVCGTDGKTYDNRCALCAENAKTGSQIGVKSEGECKSSNPEQDVCSAFRPFVRDGRLGCTRENDPVLGPDGKTHGNKCAMCAELFLKEAENAKREGETRIRRNAEKDFCKEYEKQVRNGRLFCTRESDPVRGPDGRMHGNKCALCAEIFKQRFSEENSKTDQNLGKAEEKTKVKREIVKLCSQYQNQAKNGILFCTRENDPIRGPDGKMHGNLCSMCQAYFQAENEEKKKAEARARNKRESGKATSYAELCSEYRKLVRNGKLACTRENDPIQGPDGKVHGNTCSMCEVFFQAEEEEKKKKEGKSRNKRQSKSTASFEELCSEYRKSRKNGRLFCTRENDPIQGPDGKMHGNTCSMCEAFFQQEERARAKAKREAAKEICSEFRDQVRNGTLICTREHNPVRGPDGKMHGNKCAMCASVFKLEEEEKKNDKEEKGKVEAEKVKREAVQELCSEYRHYVRNGRLPCTRENDPIEGLDGKIHGNTCSMCEAFFQQEAKEKERAEPRAKVKREAEKETCDEFRRLLQNGKLFCTRENDPVRGPDGKTHGNKCAMCKAVFQKENEERKRKEEEDQRNAAGHGSSGGGGGNTQDECAEYREQMKNGRLSCTRESDPVRDADGKSYNNQCTMCKAKLEREAERKNEYSRSRSNGTGSESGKDTCDEFRSQMKNGKLICTRESDPVRGPDGKTHGNKCTMCKEKLEREAAEKKKKEDEDRSNTGERSNTGERSNDKEDLCREFRSMQRNGKLICTRENNPVRGPYGKMHINKCAMCQSIFDREANERKKKDEEKSSSKPSNNAKDECSEFRNYIRNNELICPRENDPVHGADGKFYTNKCYMCRAVFLTEALERAKLQEKPSHVRASQEEDSPDSFSSLDSEMCKDYRVLPRIGYLCPKDLKPVCGDDGQTYNNPCMLCHENLIRQTNTHIRSTGKCEESSTPGTTAASMPPSDE

SEQ ID NO: 7787 - protein, 80 aa, unidentified
MKLSGMFLLLSLALFCFLTGVFSQGGQVDCGEFQDPKVYCTRESNPHCGSDGQTYGNKCAFCKAIVKSGGKISLKHPGKC

SEQ ID NO: 7788 - protein, 85 aa, unidentified
MKITGGLLLLCTVVYFCSSSEAASLSPKKVDCSIYKKYPVVAIPCPITYLPVCGSDYITYGNECHLCTESLKSNGRVQFLHDGSC

SEQ ID NO: 7789 - protein, 97 aa, unidentified
MKGICSDAILVLATSMWMAFAIDFPLPMASERGQLDKTIVECLKNVNKCWFLSYIKPSEPICGSDQVTYSSDCHLCSKILFEGLNITKLYDGQCENS

SEQ ID NO: 7790 - protein, 86 aa, unidentified
MRATAIVLLLALTLATMFSIECAKQTKQMVDCSHYKKLPPGQQRFCHHMYDPICGSDGKTYKNDCFFCSKVKKTDGTLKFVHFGKC

SEQ ID NO: 7791 - protein, 529 aa, unidentified; identical to SEQ ID NO: 4421

SEQ ID NO: 7792 - protein, 252 aa, unidentified; identical to SEQ ID NO: 4422

SEQ ID NO: 7793 - protein, 89 aa, unidentified
MQLQASLSFLLILTLCLELRSELARDTIKDLLPNVCAFPMEKGPCQTYMTRWFFNFETGECELFAYGGCGGNSNNFLRKEKCEKFCKFT

SEQ ID NO: 7794 - protein, 99 aa, unidentified
MKSAKLGFLLRFFIFCSLNTLLLGGVNKIAEKICGDLKDPCKLDMNFGSCYEVHFRYFYNRTSKRCETFVFSGCNGNLNNFKLKIEREVACVAKYKPPR

SEQ ID NO: 7795 - protein, 439 aa, unidentified
MPAIAVLAAAAAAWCFLQVESRHLDALAGGAGPNHGNFLDNDQWLSTVSQYDRDKYWNRFRDDDYFRNWNPNKPFDQALDPSKDPCLKVKCSPHKVCVTQDYQTALCVSRKHLLPRQKKGNVAQKHWVGPSNLVKCKPCPVAQSAMVCGSDGHSYTSKCKLEFHACSTGKSLATLCDGPCPCLPEPEPPKHKAERSACTDKELRNLASRLKDWFGALHEDANRVIKPTSSNTAQGRFDTSILPICKDSLGWMFNKLDMNYDLLLDPSEINAIYLDKYEPCIKPLFNSCDSFKDGKLSNNEWCYCFQKPGGLPCQNEMNRIQKLSKGKSLLGAFIPRCNEEGYYKATQCHGSTGQCWCVDKYGNELAGSRKQGAVSCEEEQETSGDFGSGGSVVLLDDLEYERELGPKDKEGKLRVHTRAVTEDDEDEDDDKEDEVGYIW

SEQ ID NO: 7796 - protein, 424 aa, unidentified
MRAPGCGRLVLPLLLLAAAALAEGDAKGLKEGETPGNFMEDEQWLSSISQYSGKIKHWNRFRDEVEDDYIKSWEDNQQGDEALDTTKDPCQKVKCSRHKVCIAQGYQRAMCISRKKLEHRIKQPTVKLHGNKDSICKPCHMAQLASVCGSDGHTYSSVCKLEQQACLSSKQLAVRCEGPCPCPTEQAATSTADGKPETCTGQDLADLGDRLRDWFQLLHENSKQNGSASSVAGPASGLDKSLGASCKDSIGWMFSKLDTSADLFLDQTELAAINLDKYEVCIRPFFNSCDTYKDGRVSTAEWCFCFWREKPPCLAELERIQIQEAAKKKPGIFIPSCDEDGYYRKMQCDQSSGDCWCVDQLGLELTGTRTHGSPDCDDIVGFSGDFGSGVGWEDEEEKETEEAGEEAEEEEGEAGEADDGGYIW

SEQ ID NO: 7797 - protein, 436 aa, unidentified
MLKVSAVLCVCAAAWCSQSLAAAAAVAAAGGRSDGGNFLDDKQWLTTISQYDKEVGQWNKFRDEVEDDYFRTWSPGKPFDQALDPAKDPCLKMKCSRHKVCIAQDSQTAVCISHRRLTHRMKEAGVDHRQWRGPILSTCKQCPVVYPSPVCGSDGHTYSFQCKLEYQACVLGKQISVKCEGHCPCPSDKPTSTSRNVKRACSDLEFREVANRLRDWFKALHESGSQNKKTKTLLRPERSRFDTSILPICKDSLGWMFNRLDTNYDLLLDQSELRSIYLDKNEQCTKAFFNSCDTYKDSLISNNEWCYCFQRQQDPPCQTELSNIQKRQGVKKLLGQYIPLCDEDGYYKPTQCHGSVGQCWCVDRYGNEVMGSRINGVADCAIDFEISGDFASGDFHEWTDDEDDEDDIMNDEDEIEDDDEDEGDDDDGGDDHDVYI

SEQ ID NO: 7798 - protein, 807 aa, unidentified
MRLSPAPLKLSRTPALLALALPLAAALAFSDETLDKVPKSEGYCSRILRAQGTRREGYTEFSLRVEGDPDFYKPGTSYRVTLSAAPPSYFRGFTLIALRENREGDKEEDHAGTFQIIDEEETQFMSNCPVAVTESTPRRRTRIQVFWIAPPAGTGCVILKASIVQKRIIYFQDEGSLTKKLCEQDSTFDGVTDKPILDCCACGTAKYRLTFYGNWSEKTHPKDYPRRANHWSAIIGGSHSKNYVLWEYGGYASEGVKQVAELGSPVKMEEEIRQQSDEVLTVIKAKAQWPAWQPLNVRAAPSAEFSVDRTRHLMSFLTMMGPSPDWNVGLSAEDLCTKECGWVQKVVQDLIPWDAGTDSGVTYESPNKPTIPQEKIRPLTSLDHPQSPFYDPEGGSITQVARVVIERIARKGEQCNIVPDNVDDIVADLAPEEKDEDDTPETCIYSNWSPWSACSSSTCDKGKRMRQRMLKAQLDLSVPCPDTQDFQPCMGPGCSDEDGSTCTMSEWITWSPCSISCGMGMRSRERYVKQFPEDGSVCTLPTEETEKCTVNEECSPSSCLMTEWGEWDECSATCGMGMKKRHRMIKMNPADGSMCKAETSQAEKCMMPECHTIPCLLSPWSEWSDCSVTCGKGMRTRQRMLKSLAELGDCNEDLEQVEKCMLPECPIDCELTEWSQWSECNKSCGKGHVIRTRMIQMEPQFGGAPCPETVQRKKCRIRKCLRNPSIQKLRWREARESRRSEQLKEESEGEQFPGCRMRPWTAWSECTKLCGGGIQERYMTVKKRFKSSQFTSCKDKKEIRACNVHPC

SEQ ID NO: 7799 - protein, 331 aa, unidentified
MENPSPAAALGKALCALLLATLGAAGQPLGGESICSARALAKYSITFTGKWSQTAFPKQYPLFRPPAQWSSLLGAAHSSDYSMWRKNQYVSNGLRDFAERGEAWALMKEIEAAGEALQSVHEVFSAPAVPSGTGQTSAELEVQRRHSLVSFVVRIVPSPDWFVGVDSLDLCDGDRWREQAALDLYPYDAGTDSGFTFSSPNFATIPQDTVTEITSSSPSHPANSFYYPRLKALPPIARVTLVRLRQSPRAFIPPAPVLPSRDNEIVDSASVPETPLDCEVSLWSSWGLCGGHCGRLGTKSRTRYVRVQPANNGSPCPELEEEAECVPDNCV

SEQ ID NO: 7800 - protein, 314 aa, unidentified
MRIAVICFCLLGITCAIPVKQADSGSSEEKQLYNKYPDAVATWLNPDPSQKQNLLAPQNAVSSEETNDFKQETLPSKSNESHDHMDDMDDEDDDDHVDSQDSIDSNDSDDVDDTDDSHQSDESHHSDESDELVTDFPTDLPATEVFTPVVPTVDTYDGRGDSVVYGLRSKSKKFRRPDIQYPDATDEDITSHMESEELNGAYKAIPVAQDLNAPSDWDSRGKDSYETSQLDDQSAETHSHKQSRLYKRKANDESNEHSDVIDSQELSKVSREFHSHEFHSHEDMLVVDPKSKEEDKHLKFRISHELDSASSEVN

SEQ ID NO: 7801 - protein, 211 aa, unidentified
MISRMEKMTMMMKILIMFALGMNYWSCSGFPVYDYDPSSLRDALSASVVKVNSQSLSPYLFRAFRSSLKRVEVLDENNLVMNLEFSIRETTCRKDSGEDPATCAFQRDYYVSTAVCRSTVKVSAQQVQGVHARCSWSSSTSESYSSEEMIFGDMLGSHKWRNNYLFGLISDESISEQFYDRSLGIMRRVLPPGNRRYPNHRHRARINTDFE

SEQ ID NO: 7802 - protein, 151 aa, unidentified
MNWAPATCWALLLAAAFLCDSGAAKGGRGGARGSARGGVRGGARGASRVRVRPAQRYGAPGSSLRVAAAGAAAGAAAGAAAGLAAGSGWRRAAGPGERGLEDEEDGVPGGNGTGPGIYSYRAWTSGAGPTRGPRLCLVLGGALGALGLLRP

SEQ ID NO: 7803 - protein, 442 aa, unidentified
MRRTRRPRFVLMNKMDDLNLHYRFLNWRRRIREIREVRAFRYQERFKHILVDGDTLSYHGNSGEVGCYVASRPLTKDSNYFEVSIVDSGVRGTIAVGLVPQYYSLDHQPGWLPDSVAYHADDGKLYNGRAKGRQFGSKCNSGDRIGCGIEPVSFDVQTAQIFFTKNGKRVGSTIMPMSPDGLFPAVGMHSLGEEVRLHLNAELGREDDSVMMVDSYEDEWGRLHDVRVCGTLLEYLGKGKSIVDVGLAQARHPLSTRSHYFEVEIVDPGEKCYIALGLARKDYPKNRHPGWSRGSVAYHADDGKIFHGSGVGDPFGPRCYKGDIMGCGIMFPRDYILDSEGDSDDSCDTVILSPTARAVRNVRNVMYLHQEGEEEEEEEEEEEDGEEIEPEHEGRKVVVFFTRNGKIIGKKDAVVPSGGFFPTIGMLSCGEKVKVDLHPLSG

SEQ ID NO: 7804 - protein, 116 aa, unidentified
MKGLRSLAATTLALFLVFVFLGNSSCAPQRLLERRNWTPQAMLYLKGAQGRRFISDQSRRKDLSDRPLPERRSPNPQLLTIPEAATILLASLQKSPEDEEKNFDQTRFLEDSLLNW

SEQ ID NO: 7805 - protein, 158 aa, unidentified
MMQKLLKCSRLVLALALILVLESSVQGYPTRRARYQWVRCNPDSNSANCLEEKGPMFELLPGESNKIPRLRTDLFPKTRIQDLNRIFPLSEDYSGSGFGSGSGSGSGSGSGFLTEMEQDYQLVDESDAFHDNLRSLDRNLPSDSQDLGQHGLEEDFML

SEQ ID NO: 7806 - protein, 932 aa, unidentified
MRALVLLGCLLASLLFSGQAELQVSASGGTEDVGNLLENHFSAGDASLEEKERALYADTAPQDKKLLLHYPDGREAESPKKTPASAASAGPDPEASLSNASATESPPPGERDDRDAAGPGEEKNGPPVASALPPGGAKGPVEEEWPEPSSGEGQGEEETGFGLPTEGTASGEAGGQAGGHELPEEVQEVQGDSLVQGAVAGTAEPKAEGASPHSEGDGVGPLNAEAEGSPGPGEEPAVPEGAPDVAAVGGESEPDIDTQASEGTEDQGEPGPAAEASAEPGGAQSVKAGDTEESQAPEMTEEDADEASSEEESGDGSGSEEEGGVPSEEESEEDSGDGASSEEAEGASEEATEPQEAGEPQEAREPQEGGDLQEAEESQEGGDPQEAEEPQEGGAPQEGGEPQEGGDPQEAREPQEAREPQEGAELPEATGTTSHRDRGAQPGPEELNTESMGSETLDMKAEEPEEGHQGRESPIIVAQEETEDANEEAPLRDRSHIEKTLMLNEDKPSDDYSAVLQRLRKIYHSSIKPLEQSYKYNELRQHEITDGEITSKPMVLFLGPWSVGKSTMINYLLGLENTRYQLYTGAEPTTSEFTVLMHGPKLKTIEGIVMAADSARSFSPLEKFGQNFLEKLIGIEVPHKLLERVTFVDTPGIIENRKQQERGYPFNDVCQWFIDRADLIFVVFDPTKLDVGLELEMLFRQLKGRESQIRIILNKADNLATQMLMRVYGALFWSLAPLINVTEPPRVYVSSFWPQEYKPDTHQELFLQEEISLLEDLNQVIENRLENKIAFIRQHAIRVRIHALLVDRYLQTYKDKMTFFSDGELVFKDIVEDPDKFYIFKTILAKTNVSKFDLPNREAYKDFFGINPISSFKLLSQQCSYMGGCFLEKIERAITQELPGLLGSLGLGKNPGALNCDKTGCSETPKNRYRKH

SEQ ID NO: 7807 - protein, 136 aa, unidentified
MVLLESEQFLTELTRLFQKCRTSGSVYITLKKYDGRTKPIPKKGTVEGFEPADNKCLLRATDGKKKISTVVSSKEVNKFQMAYSNLLRANMDGLKKRDKKNKTKKTKAAAAAAAAAPAAAATAPTTAATTAATAAQ

SEQ ID NO: 7808 - protein, 464 aa, unidentified
MGSPAHRPALLLLLPPLLLLLLLRVPPSRSFPGSGDSPLEDDEVGYSHPRYKDTPWCSPIKVKYGDVYCRAPQGGYYKTALGTRCDIRCQKGYELHGSSLLICQSNKRWSDKVICKQKRCPTLAMPANGGFKCVDGAYFNSRCEYYCSPGYTLKGERTVTCMDNKAWSGRPASCVDMEPPRIKCPSVKERIAEPNKLTVRVSWETPEGRDTADGILTDVILKGLPPGSNFPEGDHKIQYTVYDRAENKGTCKFRVKVRVKRCGKLNAPENGYMKCSSDGDNYGATCEFSCIGGYELQGSPARVCQSNLAWSGTEPTCAAMNVNVGVRTAAALLDQFYEKRRLLIVSTPTARNLLYRLQLGMLQQAQCGLDLRHITVVELVGVFPTLIGRIGAKIMPPALALQLRLLLRIPLYSFSMVLVDKHGMDKERYVSLVMPVALFNLIDTFPLRKEEMVLQAEMSQTCNT

SEQ ID NO: 7809 - protein, 465 aa, unidentified
MASQLTQRGALFLLFFLTPAVTPTWYAGSGYYPDESYNEVYAEEVPQAPALDYRVPRWCYTLNIQDGEATCYSPKGGNYHSSLGTRCELSCDRGFRLIGRRSVQCLPSRRWSGTAYCRQMRCHALPFITSGTYTCTNGVLLDSRCDYSCSSGYHLEGDRSRICMEDGRWSGGEPVCVDIDPPKIRCPHSREKMAEPEKLTARVYWDPPLVKDSADGTITRVTLRGPEPGSHFPEGEHVIRYTAYDRAYNRASCKFIVKVQVRRCPTLKPPQHGYLTCTSAGDNYGATCEYHCDGGYDRQGTPSRVCQSSRQWSGSPPICAPMKINVNVNSAAGLLDQFYEKQRLLIISAPDPSNRYYKMQISMLQQSTCGLDLRHVTIIELVGQPPQEVGRIREQQLSANIIEELRQFQRLTRSYFNMVLIDKQGIDRDRYMEPVTPEEIFTFIDDYLLSNQELTQRREQRDICE

SEQ ID NO: 7810 - protein, 575 aa, unidentified
MHKEAEMLIGPQLDEKRWGWRLGDGSAAPPFLPQALSFLLLLPLASALQPTPLPFQELRLVGGPSRCRGRLEVMHGGSWGSVCDDDWDVVDANVVCRQLGCGLALPVPRPLAFGQGRGPILLDNVECRGQEAALSECGSRGWGVHNCFHYEDVAVLCDEFLPTQPPTRKMLTSRAPPTTLPNGKSEGSVRLVGGANLCQGRVEILHSGLWGTVCDDDWGLPDAAVVCRQLGCGAAMAATTNAFFGYGTGHILLDNVHCEGGEPRLAACQSLGWGVHNCGHHEDAGALCAGLGPPTLTALPSSATREDWAWQTDPSATGVGPQPSRETALLTTAAWAAGKKSGRLRLVGGPGPCRGRVEVLHAGGWGTVCDDDWDFADARVACREAGCGPALGATGLGHFGYGRGPVLLDNVGCAGTEARLSDCFHLGWGQHNCGHHEDAGALCAGPEELGLQVQQDGSETTRVPTPRPRDGHLRLVNGAHRCEGRVELYLGQRWGTVCDDAWDLRAAGVLCRQLGCGQALAAPGEAHFGPGRGPILLDNVKCRGEESALLLCSHIRWDAHNCDHSEDASVLCQPS

SEQ ID NO: 7811 - protein, 1573 aa, unidentified
MRVLACLLAALVGIQAVERLRLADGPHGCAGRLEVWHGGRWGTVCDDGWDLRDAAVACRQLGCGGALAAPGGAFFGEGAGPVWLSELACRGNEGQLGLCHHRGWKAHICSHEEDAGVVCAGQRVANSRDDSTSPLDGAPWPGLLLELSPSTEEPLVTHAPRPAGNPQNASRKKSPRPKQAKSTRAPLLTTGAPRQERLRLVSGPHRCAGRLEVWHGGRWGTVCDDGWDLRDAAVACRELGCGGALAAPGGARFGPGAGPVWMDDVGCGGGEQALRDCPRSPWGRSNCDHSEDAGLVCTGPAPRLRLADGPHGCAGRLEVWHGGRWGSVCDDAWDLRDAAVACRELGCGGALAAPGGAFFGEGSGPIILDDLRCRGNETALRFCPARPWGQHDCHHREDAGAVCDGMPLGYVPPTAPTDSNNSTPREAASRPPSTMTSQAPGTAGVSPPPASPTVLWEPGPEAGSPQLRLVAGPSKCSGRLEVWHDQRWGTVCDDSWDMRDSAVVCRELGCGGPQQPDPAAGRFGWGAGPIWLDDVGCVGTEASLSDCPAAPWGKHNCAHNEDVGVTCTGPPGLDSISDPFSWSWIPGLGRDRDAWLPGELATKPSASVTASVLEKTTTKAPGKMPKSTKKWVTKNAKRPTTQPPVMPTTKHSRAQSPPDLTSQTTAALTTEASRRPTSEFTRRPTTEAPQRWTSHTTATLTPQAPRERTTKTMAMLTTQGPQEMTSESTIKSIPQASLEPSAEIPEGSPESPKDPAPSPSVSTTGESGLFRVRLADGPNRCAGRLEVWHAGRWGTVCDDNWDLRDATVACWELGCGKVRPRVGKTHYGPGTGPIWLDDMGCKGSEASLSDCPSGAWGKHNCDHEEDVGLTCTGYTDYDDYPPWTWDPTSREDLAKGTTTAGVPGHTLPWRTTRRPGSSSPAIRRLPDTGSKDGYKLPWTWDTPSGRGLAEGTPTAGKLGPTLGAGTTRSPGSPPTLRVHGDTGSPRKPWPERRPPRPAATRTAPPTPSPGPSASPGPPGPALTSDSSRELTPHSALTSEATSDAPDTSPPTPDPASRTNPDLILTSPDFALSTPDSSVVPALTPEPSPTPLPTLPKELTSDPSTPSEVTSLSPTSEQVPESDTTPDLDTTPYSSTVSEYSRSPDPSPSPHPTTTPDPTMAPDPITTLNPTVTPHFPTTPHPTTTPHPTTITHSTMIPDPTTTPQPFTTITHSTMIPDPTTTPQPFTTMQPTTTPHSTTPHPTTTPHPTTITHSTMIPDPTTTPQPFTTMQPTTMPHPTTTPHPTTTPHPTTTPHPTTTPHPTMTPDPTTTPYPTTTPDPTTTPHPTTPDPSSTPVITTVSLPTSLGTELSSPTLAPTVKPSLHPQLTFTAPAPHTSTSQIPTLEPSPALESSPSRSSTATSMDPLSTEDFKPPRSQSPNLTPPPTHTPHSASDLTVSPDPLLSPTAHPLDHPPLDPLTLGPTPGQSPGPHGPCVAPTPPVRVMACEPPALVELVAAVRDVGGQLQRLTQVVEQERQERQALLLGLTQLVEAARGLGQLGEAVKRLAEMAWTTSMPAPTTTTPEEEERPLRGDV

SEQ ID NO: 7812 - protein, 183 aa, unidentified; identical to SEQ ID NO: 4452

SEQ ID NO: 7813 - protein, 116 aa, unidentified
MLSCRLQCALAALSIVLALGCVTGAPSDPRLRQFLQKSLAAAAGKQELAKYFLAELLSEPNQTENDALEPEDLSQAAEQDEMRLELQRSANSNPAMAPRERKAGCKNFFWKTFTSC

SEQ ID NO: 7814 - protein, 340 aa, unidentified
MVTLRKRTLKVLTFLVLFIFLTSFFLNYSHTMVATTWFPKQMVLELSENLKRLIKHRPCTCTHCIGQRKLSAWFDERFNQTMQPLLTAQNALLEDDTYRWWLRLQREKKPNNLNDTIKELFRVVPGNVDPMLEKRSVGCRRCAVVGNSGNLRESSYGPEIDSHDFVLRMNKAPTAGFEADVGTKTTHHLVYPESFRELGDNVSMILVPFKTIDLEWVVSAITTGTISHTYIPVPAKIRVKQDKILIYHPAFIKYVFDNWLQGHGRYPSTGILSVIFSMHVCDEVDLYGFGADSKGNWHHYWENNPSAGAFRKTGVHDADFESNVTATLASINKIRIFKGR

SEQ ID NO: 7815 - protein, 333 aa, unidentified; identical to SEQ ID NO: 4462

SEQ ID NO: 7816 - protein, 406 aa, unidentified
MIHTNLKKKFSCCVLVFLLFAVICVWKEKKKGSYYDSFKLQTKEFQVLKSLGKLAMGSDSQSVSSSSTQDPHRGRQTLGSLRGLAKAKPEASFQVWNKDSSSKNLIPRLQKIWKNYLSMNKYKVSYKGPGPGIKFSAEALRCHLRDHVNVSMVEVTDFPFNTSEWEGYLPKESIRTKAGPWGRCAVVSSAGSLKSSQLGREIDDHDAVLRFNGAPTANFQQDVGTKTTIRLMNSQLVTTEKRFLKDSLYNEGILIVWDPSVYHSDIPKWYQNPDYNFFNNYKTYRKLHPNQPFYILKPQMPWELWDILQEISPEEIQPNPPSSGMLGIIIMMTLCDQVDIYEFLPSKRKTDVCYYYQKFFDSACTMGAYHPLLYEKNLVKHLNQGTDEDIYLLGKATLPGFRTIHC

SEQ ID NO: 7817 - protein, 374 aa, unidentified
MGLPRGSFFWLLLLLTAACSGLLFALYFSAVQRYPGPAAGARDTTSFEAFFQSKASNSWTGKGQACRHLLHLAIQRHPHFRGLFNLSIPVLLWGDLFTPALWDRLSQHKAPYGWRGLSHQVIASTLSLLNGSESAKLFAPPRDTPPKCIRCAVVGNGGILNGSRQGPNIDAHDYVFRLNGAVIKGFERDVGTKTSFYGFTVNTMKNSLVSYWNLGFTSVPQGQDLQYIFIPSDIRDYVMLRSAILGVPVPEGLDKGDRPHAYFGPEASASKFKLLHPDFISYLTERFLKSKLINTHFGDLYMPSTGALMLLTALHTCDQVSAYGFITSNYWKFSDHYFERKMKPLIFYANHDLSLEAALWRDLHKAGILQLYQR

SEQ ID NO: 7818 - protein, 336 aa, unidentified
MKTLMRHGLAVCLALTTMCTSLLLVYSSLGGQKERPPQQQQQQQQQQQQASATGSSQPAAESSTQQRPGVPAGPRPLDGYLGVADHKPLKMHCRDCALVTSSGHLLHSRQGSQIDQTECVIRMNDAPTRGYGRDVGNRTSLRVIAHSSIQRILRNRHDLLNVSQGTVFIFWGPSSYMRRDGKGQVYNNLHLLSQVLPRLKAFMITRHKMLQFDELFKQETGKDRKISNTWLSTGWFTMTIALELCDRINVYGMVPPDFCRDPNHPSVPYHYYEPFGPDECTMYLSHERGRKGSHHRFITEKRVFKNWARTFNIHFFQPDWKPESLAINHPENKPVF

SEQ ID NO: 7819 - protein, 333 aa, unidentified; identical to SEQ ID NO: 4469

SEQ ID NO: 7820 - protein, 375 aa, unidentified
MQLQFRSWMLAALTLLVVFLIFADISEIEEEIGNSGGRGTIRSAVNSLHSKSNRAEVVINGSSSPAVVDRSNESIKHNIQPASSKWRHNQTLSLRIRKQILKFLDAEKDISVLKGTLKPGDIIHYIFDRDSTMNVSQNLYELLPRTSPLKNKHFGTCAIVGNSGVLLNSGCGQEIDAHSFVIRCNLAPVQEYARDVGLKTDLVTMNPSVIQRAFEDLVNATWREKLLQRLHSLNGSILWIPAFMARGGKERVEWVNELILKHHVNVRTAYPSLRLLHAVRGYWLTNKVHIKRPTTGLLMYTLATRFCKQIYLYGFWPFPLDQNQNPVKYHYYDSLKYGYTSQASPHTMPLEFKALKSLHEQGALKLTVGQCDGAT

SEQ ID NO: 7821 - protein, 359 aa, unidentified
MRSIRKRWTICTISLLLIFYKTKEIARTEEHQETQLIGDGELSLSRSLVNSSDKIIRKAGSSIFQHNVEGWKINSSLVLEIRKNILRFLDAERDVSVVKSSFKPGDVIHYVLDRRRTLNISHDLHSLLPEVSPMKNRRFKTCAVVGNSGILLDSECGKEIDSHNFVIRCNLAPVVEFAADVGTKSDFITMNPSVVQRAFGGFRNESDREKFVHRLSMLNDSVLWIPAFMVKGGEKHVEWVNALILKNKLKVRTAYPSLRLIHAVRGYWLTNKVPIKRPSTGLLMYTLATRFCDEIHLYGFWPFPKDLNGKAVKYHYYDDLKYRYFSNASPHRMPLEFKTLNVLHNRGALKLTTGKCVKQ

SEQ ID NO: 7822 - protein, 398 aa, unidentified
MRPGGALLALLASLLLLLLLRLLWCPADAPGRARILVEESREATHGTPAALRTLRSPATAVPRATNSTYLNEKSLQLTEKCKNLQYGIESFSNKTKGYSENDYLQIITDIQSCPWKRQAEEYANFRAKLASCCDAVQNFVVSQNNTPVGTNMSYEVESKKEIPIKKNIFHMFPVSQPFVDYPYNQCAVVGNGGILNKSLCGTEIDKSDFVFRCNLPPTTGDVSKDVGSKTNLVTINPSIITLKYGNLKEKKALFLEDIATYGDAFFLLPAFSFRANTGTSFKVYYTLEESKARQKVLFFHPKYLKDLALFWRTKGVTAYRLSTGLMITSVAVELCKNVKLYGFWPFSKTVEDIPVSHHYYDNKLPKHGFHQMPKEYSQILQLHMKGILKLQFSKCEVA

SEQ ID NO: 7823 - protein, 370 aa, unidentified
MLPRRLLAAWLAGTRGGGLLALLANQCRFVTGLRVRRAQQIAQLYGRLYSESSRRVLLGRLWRRLHGRPGHASALMAALAGVFVWDEERIQEEELQRSINEMKRLEEMSNMFQSSGVQHHPPEPKAQTEGNEDSEGKEQRWEMVMDKKHFKLWRRPITGTHLYQYRVFGTYTDVTPRQFFNVQLDTEYRKKWDALVIKLEVIERDVVSGSEVLHWVTHFPYPMYSRDYVYVRRYSVDQENNMMVLVSRAVEHPSVPESPEFVRVRSYESQMVIRPHKSFDENGFDYLLTYSDNPQTVFPRYCVSWMVSSGMPDFLEKLHMATLKAKNMEIKVKDYISAKPLEMSSEAKATSQSSERKNEGSCGPARIEYA

SEQ ID NO: 7824 - protein, 62 aa, unidentified
MKFLVFAFILALMVSMIGADSSEEKFLRRIGRFGYGYGPYQPVPEQPLYPQPYQPQYQQYTF

SEQ ID NO: 7825 - protein, 247 aa, unidentified
MLQNSAVLLVLVISASATHEAEQNDSVSPRKSRVAAQNSAEVVRCLNSALQVGCGAFACLENSTCDTDGMYDICKSFLYSAAKFDTQGKAFVKESLKCIANGVTSKVFLAIRRCSTFQRMIAEVQEECYSKLNVCSIAKRNPEAITEVVQLPNHFSNRYYNRLVRSLLECDEDTVSTIRDSLMEKIGPNMASLFHILQTDHCAQTHPRADFNRRRTNEPQKLKVLLRNLRGEEDSPSHIKRTSHESA

SEQ ID NO: 7826 - protein, 302 aa, unidentified
MCAERLGQFMTLALVLATFDPARGTDATNPPEGPQDRSSQQKGRLSLQNTAEIQHCLVNAGDVGCGVFECFENNSCEIRGLHGICMTFLHNAGKFDAQGKSFIKDALKCKAHALRHRFGCISRKCPAIREMVSQLQRECYLKHDLCAAAQENTRVIVEMIHFKDLLLHEPYVDLVNLLLTCGEEVKEAITHSVQVQCEQNWGSLCSILSFCTSAIQKPPTAPPERQPQVDRTKLSRAHHGEAGHHLPEPSSRETGRGAKGERGSKSHPNAHARGRVGGLGAQGPSGSSEWEDEQSEYSDIRR

SEQ ID NO: 7827 - protein, 276 aa, unidentified
MGCGPSQPAEDRRRVRAPKKGWKEEFKADVSVPHTGENCSPRMEAALTKNTVDIAEGLEQVQMGSLPGTISENSPSPSERNRRVNSDLVTNGLINKPQSLESRERQKSSDILEELIVQGIIQSHSKVFRNGESYDVTLTTTEKPLRKPPSRLKKLKIKKQVKDFTMKDIEEKMEAAEERRKTKEEEIRKRLRSDRLLPSANHSDSAELDGAEVAFAKGLQRVRSAGFEPSDLQGGKPLKRKKSKCDATLIDRNESDESFGVVESDMSYNQADDIVY

SEQ ID NO: 7828 - protein, 356 aa, unidentified
MLARAARGTGALLLRGSLLASGRAPRRASSGLPRNTVVLFVPQQEAWVVERMGRFHRILEPGLNILIPVLDRIRYVQSLKEIVINVPEQSAVTLDNVTLQIDGVLYLRIMDPYKASYGVEDPEYAVTQLAQTTMRSELGKLSLDKVFRERESLNASIVDAINQAADCWGIRCLRYEIKDIHVPPRVKESMQMQVEAERRKRATVLESEGTRESAINVAEGKKQAQILASEAEKAEQINQAAGEASAVLAKAKAKAEAIRILAAALTQHNGDAAASLTVAEQYVSAFSKLAKDSNTILLPSNPGDVTSMVAQAMGVYGALTKAPVPGTPDSLSSGSSRDVQGTDASLDEELDRVKMS

SEQ ID NO: 7829 - protein, 989 aa, unidentified
MARPVQLAPGSLALVLCRLEAQKAAGAAEEPGGRAVFRAFRRANARCFWNARLARAASRLAFQGWLRRGVLLVRAPPACLQVLRDAWRRRALRPPRGFRIRAVGDVFPVQMNPITQSQFVPLGEVLCCAISDMNTAQIVVTQESLLERLMKHYPGIAIPSEDILYTTLGTLIKERKIYHTGEGYFIVTPQTYFITNTTTQENKRMLPSDESRLMPASMTYLVSMESCAESAQENAAPISHCQSCQCFRDMHTQDVQEAPVAAEVTRKSHRGLGESVSWVQNGAVSVSAEHHICESTKPLPYTRDKEKGKKFGFSLLWRSLSRKEKPKTEHSSFSAQFPPEEWPVRDEDDLDNIPRDVEHEIIKRINPILTVDNLIKHTVLMQKYEEQKKYNSQGTSTDMLTIGHKYPSKEGVKKRQGLSAKPQGQGHSRRDRHKARNQGSEFQPGSIRLEKHPKLPATQPIPRIKSPNEMVGQKPLGEITTVLGSHLIYKKRISNPFQGLSHRGSTISKGHKIQKTSDLKPSQTGPKEKPFQKPRSLDSSRIFDGKAKEPYAEQPNDKMEAESIYINDPTVKPINDDFRGHLFSHPQQSMLQNDGKCCPFMESMLRYEVYGGENEVIPEVLRKSHSHFDKLGETKQTPHSLPSRGASFSDRTPSACRLVDNTIHQFQNLGLLDYPVGVNPLRQAARQDKDSEELLRKGFVQDAETTSLENEQLSNDDQALYQNEVEDDDGACSSLYLEEDDISENDDLRQMLPGHSQYSFTGGSQGNHLGKQKVIERSLTEYNSTMERVESQVLKRNECYKPTGLHATPGESQEPNLSAESCGLNSGAQFGFNYEEEPSVAKCVQASAPADERIFDYYSARKASFEAEVIQDTIGDTGKKPASWSQSPQNQEMRKHFPQKFQLFNTSHMPVLAQDVQYEHSHLEGTENHSMAGDSGIDSPRTQSLGSNNSVILDGLKRRQNFLQNVEGTKSSQPLTSNSLLPLTPVINV

SEQ ID NO: 7830 - protein, 926 aa, unidentified
MKKTRSTTLRRAWPSSDFSDRASDRMRSRSEKDYRLHKRFPAAFAPQASRGYMTSGDVSPISMSPISQSQFIPLGEILCLAISAMNSARKPVTQEALMEHLTTCFPGVPTPSQEILRHTLNTLVRERKIYPTPDGYFIVTPQTYFITPSLIRTNSKWYHLDERIPDRSQCTSPQPGTITPSASGCVRERTLPRNHCDSCHCCREDVHSTHAPTLQRKSAKDCKDPYCPPSLCQVPPTEKSKSTVNFSYKTETLSKPKDSEKQSKKFGLKLFRLSFKKDKTKQLANFSAQFPPEEWPLRDEDTPATIPREVEMEIIRRINPDLTVENVMRHTALMKKLEEEKAQRSKAGSSAHHSGRSKKSRTHRKSHGKSRSHSKTRVSKGDPSDGSHLDIPAEREYDFCDPLTRVPREGCFIIEHKGDNFIMHSNTNVLESHFPMTPEWDVSGELAKRRTEMPFPEPSRGSSHSKVHRSHSHTQDRRSRNERSNKAKERSRSMDNSKGPLGASSLGTPEDLAEGCSQDDQTPSQSYIDDSTLRPAQTVSLQRAHISSTSYKEVCIPEIVSGSKEPSSACSLLEPGKPPESLPSYGELNSCPTKTATDDYFQCNTSSETVLTAPSPLGKNKEDHDTLTLAEGVKKLSPSDRQVPHSSREPVGHKEESPKGPGGGPAASGGVAEGIANGRLVQHHGAEPSSLDKRKEIFSKDTLFKPLHSTLSVNSYHKSSLSLLKSHPKTPADTLPGRCEKLEPSLGTSAAQAMPASQRQQESGGNQEASFDYYNVSDDDDSEEGANKNTEEEKNREDVGTMQWLLEREKERDLQRKFEKNLTLLAPKETDSSSNQRATHSARLDSMDSSSITVDSGFNSPRTRESLASNTSSIVESNRRQNPALSPAHGGAGPAFNFRASAEPPTNEAEKLQKPSNCLQASVTSV

SEQ ID NO: 7831 - protein, 1775 aa, unidentified
MALSLWPLLLLLLLLLLLSFAVTLAPTGPHSLDPGLSFLKSLLSTLDQAPQGSLSRSRFFTFLANISSSFEPGRMGEGPVGEPPPLQPPALRLHDFLVTLRGSPDWEPMLGLLGDMLALLGQEQTPRDFLVHQAGVLGGLVEVLLGALVPGGPPTPTRPPCTRDGPSDCVLAADWLPSLLLLLEGTRWQALVQVQPSVDPTNATGLDGREAAPHFLQGLLGLLTPTGELGSKEALWGGLLRTVGAPLYAAFQEGLLRVTHSLQDEVFSILGQPEPDTNGQCQGGNLQQLLLWGVRHNLSWDVQALGFLSGSPPPPPALLHCLSTGVPLPRASQPSAHISPRQRRAITVEALCENHLGPAPPYSISNFSIHLLCQHTKPATPQPHPSTTAICQTAVWYAVSWAPGAQGWLQACHDQFPDEFLDAICSNLSFSALSGSNRRLVKRLCAGLLPPPTSCPEGLPPVPLTPDIFWGCFLENETLWAERLCGEASLQAVPPSNQAWVQHVCQGPTPDVTASPPCHIGPCGERCPDGGSFLVMVCANDTMYEVLVPFWPWLAGQCRISRGGNDTCFLEGLLGPLLPSLPPLGPSPLCLTPGPFLLGMLSQLPRCQSSVPALAHPTRLHYLLRLLTFLLGPGAGGAEAQGMLGRALLLSSLPDNCSFWDAFRPEGRRSVLRTIGEYLEQDEEQPTPSGFEPTVNPSSGISKMELLACFSPVLWDLLQREKSVWALQILVQAYLHMPPENLQQLVLSAEREAAQGFLTLMLQGKLQGKLQVPPSEEQALGRLTALLLQRYPRLTSQLFIDLSPLIPFLAVSDLMRFPPSLLANDSVLAAIRDYSPGMRPEQKEALAKRLLAPELFGEVPAWPQELLWAVLPLLPHLPLENFLQLSPHQIQALEDSWPAAGLGPGHARHVLRSLVNQSVQDGEEQVRRLGPLACFLSPEELQSLVPLSDPTGPVERGLLECAANGTLSPEGRVAYELLGVLRSSGGAVLSPRELRVWAPLFSQLGLRFLQELSEPQLRAMLPVLQGTSVTPAQAVLLLGRLLPRHDLSLEELCSLHLLLPGLSPQTLQAIPRRVLVGACSCLAPELSRLSACQTAALLQTFRVKDGVKNMGTTGAGPAVCIPGQPIPTTWPDCLLPLLPLKLLQLDSLALLANRRRYWELPWSEQQAQFLWKKMQVPTNLTLRNLQALGTLAGGMSCEFLQQINSMVDFLEVVHMIYQLPTRVRGSLRACIWAELQRRMAMPEPEWTTVGPELNGLDSKLLLDLPIQLMDRLSNESIMLVVELVQRAPEQLLALTPLHQAALAERALQNLAPKETPVSGEVLETLGPLVGFLGTESTRQIPLQILLSHLSQLQGFCLGETFATELGWLLLQESVLGKPELWSQDEVEQAGRLVFTLSTEAISLIPREALGPETLERLLEKQQSWEQSRVGQLCREPQLAAKKAALVAGVVRPAAEDLPEPVPNCADVRGTFPAAWSATQIAEMELSDFEDCLTLFAGDPGLGPEELRAAMGKAKQLWGPPRGFRPEQILQLGRLLIGLGDRELQELILVDWGVLSTLGQIDGWSTTQLRIVVSSFLRQSGRHVSHLDFVHLTALGYTLCGLRPEELQHISSWEFSQAALFLGTLHLQCSEEQLEVLAHLLVLPGGFGPISNWGPEIFTEIGTIAAGIPDLALSALLRGQIQGVTPLAISVIPPPKFAVVFSPIQLSSLTSAQAVAVTPEQMAFLSPEQRRAVAWAQHEGKESPEQQGRSTAWGLQDWSRPSWSLVLTISFLGHLL

SEQ ID NO: 7832 - protein, 346 aa, unidentified
MTATLAAAADIATMVSGSSGLAAARLLSRSFLLPQNGIRHCSYTASRQHLYVDKNTKIICQGFTGKQGTFHSQQALEYGTKLVGGTTPGKGGQTHLGLPVFNTVKEAKEQTGATASVIYVPPPFAAAAINEAIEAEIPLVVCITEGIPQQDMVRVKHKLLRQEKTRLIGPNCPGVINPGECKIGIMPGHIHKKGRIGIVSRSGTLTYEAVHQTTQVGLGQSLCVGIGGDPFNGTDFIDCLEIFLNDSATEGIILIGEIGGNAEENAAEFLKQHNSGPNSKPVVSFIAGLTAPPGRRMGHAGAIIAGGKGGAKEKISALQSAGVVVSMSPAQLGTTIYKEFEKRKML

SEQ ID NO: 7833 - protein, 328 aa, unidentified
MSAAGLLAPAPAQAGAPPAPEYYPEEDEELESAEDDERSCRGRESDEDTEDASETDLAKHDEEDYVEMKEQMYQDKLASLKRQLQQLQEGTLQEYQKRMKKLDQQYKERIRNAELFLQLETEQVERNYIKEKKAAVKEFEDKKVELKENLIAELEEKKKMIENEKLTMELTGDSMEVKPIMTRKLRRRPNDPVPIPDKRRKPAPAQLNYLLTDEQIMEDLRTLNKLKSPKRPASPSSPEHLPATPAESPAQRFEARIEDGKLYYDKRWYHKSQAIYLESKDNQKLSCVISSVGANEIWVRKTSDSTKMRIYLGQLQRGLFVIRRRSAA

SEQ ID NO: 7834 - protein, 871 aa, unidentified
MKYSCCALVLAVLGTELLGSLCSTVRSPRFRGRIQQERKNIRPNIILVLTDDQDVELGSLQVMNKTRKIMEHGGATFINAFVTTPMCCPSRSSMLTGKYVHNHNVYTNNENCSSPSWQAMHEPRTFAVYLNNTGYRTAFFGKYLNEYNGSYIPPGWREWLGLIKNSRFYNYTVCRNGIKEKHGFDYAKDYFTDLITNESINYFKMSKRMYPHRPVMMVISHAAPHGPEDSAPQFSKLYPNASQHITPSYNYAPNMDKHWIMQYTGPMLPIHMEFTNILQRKRLQTLMSVDDSVERLYNMLVETGELENTYIIYTADHGYHIGQFGLVKGKSMPYDFDIRVPFFIRGPSVEPGSIVPQIVLNIDLAPTILDIAGLDTPPDVDGKSVLKLLDPEKPGNRFRTNKKAKIWRDTFLVERGKFLRKKEESSKNIQQSNHLPKYERVKELCQQARYQTACEQPGQKWQCIEDTSGKLRIHKCKGPSDLLTVRQSTRNLYARGFHDKDKECSCRESGYRASRSQRKSQRQFLRNQGTPKYKPRFVHTRQTRSLSVEFEGEIYDINLEEEEELQVLQPRNIAKRHDEGHKGPRDLQASSGGNRGRMLADSSNAVGPPTTVRVTHKCFILPNDSIHCERELYQSARAWKDHKAYIDKEIEALQDKIKNLREVRGHLKRRKPEECSCSKQSYYNKEKGVKKQEKLKSHLHPFKEAAQEVDSKLQLFKENNRRRKKERKEKRRQRKGEECSLPGLTCFTHDNNHWQTAPFWNLGSFCACTSSNNNTYWCLRTVNETHNFLFCEFATGFLEYFDMNTDPYQLTNTVHTVERGILNQLHVQLMELRSCQGYKQCNPRPKNLDVGNKDGGSYDLHRGQLWDGWEG

SEQ ID NO: 7835 - protein, 870 aa, unidentified
MGPPSLVLCLLSATVFSLLGGSSAFLSHHRLKGRFQRDRRNIRPNIILVLTDDQDVELGSMQVMNKTRRIMEQGGAHFINAFVTTPMCCPSRSSILTGKYVHNHNTYTNNENCSSPSWQAQHESRTFAVYLNSTGYRTAFFGKYLNEYNGSYVPPGWKEWVGLLKNSRFYNYTLCRNGVKEKHGSDYSKDYLTDLITNDSVSFFRTSKKMYPHRPVLMVISHAAPHGPEDSAPQYSRLFPNASQHITPSYNYAPNPDKHWIMRYTGPMKPIHMEFTNMLQRKRLQTLMSVDDSMETIYNMLVETGELDNTYIVYTADHGYHIGQFGLVKGKSMPYEFDIRVPFYVRGPNVEAGCLNPHIVLNIDLAPTILDIAGLDIPADMDGKSILKLLDTERPVNRFHLKKKMRVWRDSFLVERGKLLHKRDNDKVDAQEENFLPKYQRVKDLCQRAEYQTACEQLGQKWQCVEDATGKLKLHKCKGPMRLGGSRALSNLVPKYYGQGSEACTCDSGDYKLSLAGRRKKLFKKKYKASYVRSRSIRSVAIEVDGRVYHVGLGDAAQPRNLTKRHWPGAPEDQDDKDGGDFSGTGGLPDYSAANPIKVTHRCYILENDTVQCDLDLYKSLQAWKDHKLHIDHEIETLQNKIKNLREVRGHLKKKRPEECDCHKISYHTQHKGRLKHRGSSLHPFRKGLQEKDKVWLLREQKRKKKLRKLLKRLQNNDTCSMPGLTCFTHDNQHWQTAPFWTLGPFCACTSANNNTYWCMRTINETHNFLFCEFATGFLEYFDLNTDPYQLMNAVNTLDRDVLNQLHVQLMELRSCKGYKQCNPRTRNMDLGLKDGGSYEQYRQFQRRKWPEMKRPSSKSLGQLWEGWEG

SEQ ID NO: 7836 - protein, 374 aa, unidentified
MAAPALGLVCGRCPELGLVLLLLLLSLLCGAAGSQEAGTGAGAGSLAGSCGCGTPQRPGAHGSSAAAHRYSREANAPGPVPGERQLAHSKMVPIPAGVFTMGTDDPQIKQDGEAPARRVTIDAFYMDAYEVSNTEFEKFVNSTGYLTEAEKFGDSFVFEGMLSEQVKTNIQQAVAAAPWWLPVKGANWRHPEGPDSTILHRPDHPVLHVSWNDAVAYCTWAGKRLPTEAEWEYSCRGGLHNRLFPWGNKLQPKGQHYANIWQGEFPVTNTGEDGFQGTAPVDAFPPNGYGLYNIVGNAWEWTSDWWTVHHSVEETLNPKGPPSGKDRVKKGGSYMCHRSYCYRYRCAARSQNTPDSSASNLGFRCAADRLPTMD

SEQ ID NO: 7837 - protein, 301 aa, unidentified
MARHGLPLLPLLSLLVGAWLKLGNGQATSMVQLQGGRFLMGTNSPDSRDGDGPVREATVKPFAIDIFPVTNKDFRDFVREKKYRTEAEMFGWSFVFEDFVSDELRNKATQPMKSVLWWLPVEKAFWRQPAGPGSGIRERLEHPVLHVSWNDARAYCAWRGKRLPTEEEWEFAARGGLKGQVYPWGNWFQPNRTNLWQGKFPKGDKAEDGFHGVSPVNAFPAQNNYGLYDLLGNVWEWTASPYQAAEQDMRVLRGASWIDTADGSANHRARVTTRMGNTPDSASDNLGFRCAADAGRPPGEL

SEQ ID NO: 7838 - protein, 747 aa, unidentified; identical to SEQ ID NO: 4524

SEQ ID NO: 7839 - protein, 629 aa, unidentified; identical to SEQ ID NO: 4528

SEQ ID NO: 7840 - protein, 3571 aa, unidentified
MWPRLAFCCWGLALVSGWATFQQMSPSRNFSFRLFPETAPGAPGSIPAPPAPGDEAAGSRVERLGQAFRRRVRLLRELSERLELVFLVDDSSSVGEVNFRSELMFVRKLLSDFPVVPTATRVAIVTFSSKNYVVPRVDYISTRRARQHKCALLLQEIPAISYRGGGTYTKGAFQQAAQILLHARENSTKVVFLITDGYSNGGDPRPIAASLRDSGVEIFTFGIWQGNIRELNDMASTPKEEHCYLLHSFEEFEALARRALHEDLPSGSFIQDDMVHCSYLCDEGKDCCDRMGSCKCGTHTGHFECICEKGYYGKGLQYECTACPSGTYKPEGSPGGISSCIPCPDENHTSPPGSTSPEDCVCREGYRASGQTCELVHCPALKPPENGYFIQNTCNNHFNAACGVRCHPGFDLVGSSIILCLPNGLWSGSESYCRVRTCPHLRQPKHGHISCSTREMLYKTTCLVACDEGYRLEGSDKLTCQGNSQWDGPEPRCVERHCSTFQMPKDVIISPHNCGKQPAKFGTICYVSCRQGFILSGVKEMLRCTTSGKWNVGVQAAVCKDVEAPQINCPKDIEAKTLEQQDSANVTWQIPTAKDNSGEKVSVHVHPAFTPPYLFPIGDVAIVYTATDLSGNQASCIFHIKVIDAEPPVIDWCRSPPPVQVSEKVHAASWDEPQFSDNSGAELVITRSHTQGDLFPQGETIVQYTATDPSGNNRTCDIHIVIKGSPCEIPFTPVNGDFICTPDNTGVNCTLTCLEGYDFTEGSTDKYYCAYEDGVWKPTYTTEWPDCAKKRFANHGFKSFEMFYKAARCDDTDLMKKFSEAFETTLGKMVPSFCSDAEDIDCRLEENLTKKYCLEYNYDYENGFAIGPGGWGAANRLDYSYDDFLDTVQETATSIGNAKSSRIKRSAPLSDYKIKLIFNITASVPLPDERNDTLEWENQQRLLQTLETITNKLKRTLNKDPMYSFQLASEILIADSNSLETKKASPFCRPGSVLRGRMCVNCPLGTYYNLEHFTCESCRIGSYQDEEGQLECKLCPSGMYTEYIHSRNISDCKAQCKQGTYSYSGLETCESCPLGTYQPKFGSRSCLSCPENTSTVKRGAVNISACGVPCPEGKFSRSGLMPCHPCPRDYYQPNAGKAFCLACPFYGTTPFAGSRSITECSSFSSTFSAAEESVVPPASLGHIKKRHEISSQVFHECFFNPCHNSGTCQQLGRGYVCLCPLGYTGLKCETDIDECSPLPCLNNGVCKDLVGEFICECPSGYTGQRCEENINECSSSPCLNKGICVDGVAGYRCTCVKGFVGLHCETEVNECQSNPCLNNAVCEDQVGGFLCKCPPGFLGTRCGKNVDECLSQPCKNGATCKDGANSFRCLCAAGFTGSHCELNINECQSNPCRNQATCVDELNSYSCKCQPGFSGKRCETEQSTGFNLDFEVSGIYGYVMLDGMLPSLHALTCTFWMKSSDDMNYGTPISYAVDNGSDNTLLLTDYNGWVLYVNGREKITNCPSVNDGRWHHIAITWTSANGIWKVYIDGKLSDGGAGLSVGLPIPGGGALVLGQEQDKKGEGFSPAESFVGSISQLNLWDYVLSPQQVKSLATSCPEELSKGNVLAWPDFLSGIVGKVKIDSKSIFCSDCPRLGGSVPHLRTASEDLKPGSKVNLFCDPGFQLVGNPVQYCLNQGQWTQPLPHCERISCGVPPPLENGFHSADDFYAGSTVTYQCNNGYYLLGDSRMFCTDNGSWNGVSPSCLDVDECAVGSDCSEHASCLNVDGSYICSCVPPYTGDGKNCAEPIKCKAPGNPENGHSSGEIYTVGAEVTFSCQEGYQLMGVTKITCLESGEWNHLIPYCKAVSCGKPAIPENGCIEELAFTFGSKVTYRCNKGYTLAGDKESSCLANSSWSHSPPVCEPVKCSSPENINNGKYILSGLTYLSTASYSCDTGYSLQGPSIIECTASGIWDRAPPACHLVFCGEPPAIKDAVITGNNFTFRNTVTYTCKEGYTLAGLDTIECLADGKWSRSDQQCLAVSCDEPPIVDHASPETAHRLFGDIAFYYCSDGYSLADNSQLLCNAQGKWVPPEGQDMPRCIAHFCEKPPSVSYSILESVSKAKFAAGSVVSFKCMEGFVLNTSAKIECMRGGQWNPSPMSIQCIPVRCGEPPSIMNGYASGSNYSFGAMVAYSCNKGFYIKGEKKSTCEATGQWSSPIPTCHPVSCGEPPKVENGFLEHTTGRIFESEVRYQCNPGYKSVGSPVFVCQANRHWHSESPLMCVPLDCGKPPPIQNGFMKGENFEVGSKVQFFCNEGYELVGDSSWTCQKSGKWNKKSNPKCMPAKCPEPPLLENQLVLKELTTEVGVVTFSCKEGHVLQGPSVLKCLPSQQWNDSFPVCKIVLCTPPPLISFGVPIPSSALHFGSTVKYSCVGGFFLRGNSTTLCQPDGTWSSPLPECVPVECPQPEEIPNGIIDVQGLAYLSTALYTCKPGFELVGNTTTLCGENGHWLGGKPTCKAIECLKPKEILNGKFSYTDLHYGQTVTYSCNRGFRLEGPSALTCLETGDWDVDAPSCNAIHCDSPQPIENGFVEGADYSYGAIIIYSCFPGFQVAGHAMQTCEESGWSSSIPTCMPIDCGLPPHIDFGDCTKLKDDQGYFEQEDDMMEVPYVTPHPPYHLGAVAKTWENTKESPATHSSNFLYGTMVSYTCNPGYELLGNPVLICQEDGTWNGSAPSCISIECDLPTAPENGFLRFTETSMGSAVQYSCKPGHILAGSDLRLCLENRKWSGASPRCEAISCKKPNPVMNGSIKGSNYTYLSTLYYECDPGYVLNGTERRTCQDDKNWDEDEPICIPVDCSSPPVSANGQVRGDEYTFQKEIEYTCNEGFLLEGARSRVCLANGSWSGATPDCVPVRCATPPQLANGVTEGLDYGFMKEVTFHCHEGYILHGAPKLTCQSDGNWDAEIPLCKPVNCGPPEDLAHGFPNGFSFIHGGHIQYQCFPGYKLHGNSSRRCLSNGSWSGSSPSCLPCRCSTPVIEYGTVNGTDFDCGKAARIQCFKGFKLLGLSEITCEADGQWSSGFPHCEHTSCGSLPMIPNAFISETSSWKENVITYSCRSGYVIQGSSDLICTEKGVWSQPYPVCEPLSCGSPPSVANAVATGEAHTYESEVKLRCLEGYTMDTDTDTFTCQKDGRWFPERISCSPKKCPLPENITHILVHGDDFSVNRQVSVSCAEGYTFEGVNISVCQLDGTWEPPFSDESCSPVSCGKPESPEHGFVVGSKYTFESTIIYQCEPGYELEGNRERVCQENRQWSGGVAICKETRCETPLEFLNGKADIENRTTGPNVVYSCNRGYSLEGPSEAHCTENGTWSHPVPLCKPNPCPVPFVIPENALLSEKEFYVDQNVSIKCREGFLLQGHGIITCNPDETWTQTSAKCEKISCGPPAHVENAIARGVHYQYGDMITYSCYSGYMLEGFLRSVCLENGTWTSPPICRAVCRFPCQNGGICQRPNACSCPEGWMGRLCEEPICILPCLNGGRCVAPYQCDCPPGWTGSRCHTAVCQSPCLNGGKCVRPNRCHCLSSWTGHNCSRKRRTGF

SEQ ID NO: 7841 - protein, 229 aa, unidentified
MPAAGPPLLLLGTPGSGKTALLFAAALEAAGEGQGPVLFLTRRPLQSMPRGTGTTLDPMRLQKIRFQYPPSTRELFRLLCSAHEAPGPAPSLLLLDGLEEYLAEDPEPQEAAYLIALLLDTAAHFSHRLGPGRDCGLMVALQTQEEAGSGDVLHLALLQRYFPAQCWLQPDAPGPGEHGLRACLEPGGLGPRTEWWVTFRSDGEMMIAPWPTQAGDPSSGKGSSSGGQP

SEQ ID NO: 7842 - protein, 352 aa, unidentified
MFRGLSSWLGLQQPVAGGGQPNGDAPPEQPSETVAESAEEELQQAGDQELLHQAKDFGNYLFNFASAATKKITESVAETAQTIKKSVEEGKIDGIIDKTIIGDFQKEQKKFVEEQHTKKSEAAVPPWVDTNDEETIQQQILALSADKRNFLRDPPAGVQFNFDFDQMYPVALVMLQEDELLSKMRFALVPKLVKEEVFWRNYFYRVSLIKQSAQLTALAAQQQAAGKEEKSNGREQDLPLAEAVRPKTPPVVIKSQLKTQEDEEEISTSPGVSEFVSDAFDACNLNQEDLRKEMEQLVLDKKQEETAVLEEDSADWEKELQQELQEYEVVTESEKRDENWDKEIEKMLQEEN

SEQ ID NO: 7843 - protein, 134 aa, unidentified
MSPLRPLLLALALASVPCAQGACPASADLKHSDGTRTCAKLYDKSDPYYENCCGGAELSLESGADLPYLPSNWANTASSLVVAPRCELTVWSRQGKAGKTHKFSAGTYPRLEEYRRGILGDWSNAISALYCRCS

SEQ ID NO: 7844 - protein, 129 aa, unidentified
MKILVALAVFFLVSTQLFAEEIGANDDLNYWSDWYDSDQIKEELPEPFEHLLQRIARRPKPQQFFGLMGKRDADSSIEKQVALLKALYGHGQISHKRHKTDSFVGLMGKRALNSVAYERSAMQNYERRR

SEQ ID NO: 7845 - protein, 121 aa, unidentified
MRIMLLFTAILAFSLAQSFGAVCKEPQEEVVPGGGRSKRDPDLYQLLQRLFKSHSSLEGLLKALSQASTDPKESTSPEKRDMHDFFVGLMGKRSVQPDSPTDVNQENVPSFGILKYPPRAE

SEQ ID NO: 7846 - protein, 113 aa, unidentified
MLPCLALLLLMELSVCTVAGDGGEEQTLSTEAETWVIVALEEGAGPSIQLQLQEVKTGKASQFFGLMGKRVGGRPLIQPRRKKAYQLEHTFQGLLGKRSLFTEGREDEAQGSE

SEQ ID NO: 7847 - protein, 199 aa, unidentified
MANRGPAYGLSREVQQKIEKQYDADLEQILIQWITTQCRKDVGRPQPGRENFQNWLKDGTVLCELINALYPEGQAPVKKIQASTMAFKQMEQISQFLQAAERYGINTTDIFQTVDLWEGKNMACVQRTLMNLGGLAVARDDGLFSGDPNWFPKKSKENPRNFSDNQLQEGKNVIGLQMGTNRGASQAGMTGYGMPRQIL

SEQ ID NO: 7848 - protein, 448 aa, unidentified; identical to SEQ ID NO: 4581

SEQ ID NO: 7849 - protein, 468 aa, unidentified; identical to SEQ ID NO: 4582

SEQ ID NO: 7850 - protein, 447 aa, unidentified
MELSQMSELMGLSVLLGLLALMATAAVARGWLRAGEERSGRPACQKANGFPPDKSSGSKKQKQYQRIRKEKPQQHNFTHRLLAAALKSHSGNISCMDFSSNGKYLATCADDRTIRIWSTKDFLQREHRSMRANVELDHATLVRFSPDCRAFIVWLANGDTLRVFKMTKREDGGYTFTATPEDFPKKHKAPVIDIGIANTGKFIMTASSDTTVLIWSLKGQVLSTINTNQMNNTHAAVSPCGRFVASCGFTPDVKVWEVCFGKKGEFQEVVRAFELKGHSAAVHSFAFSNDSRRMASVSKDGTWKLWDTDVEYKKKQDPYLLKTGRFEEAAGAAPCRLALSPNAQVLALASGSSIHLYNTRRGEKEECFERVHGECIANLSFDITGRFLASCGDRAVRLFHNTPGHRAMVEEMQGHLKRASNESTRQRLQQQLTQAQETLKSLGALKK

SEQ ID NO: 7851 - protein, 385 aa, unidentified
MAAFLSAGLGILAPSETYPLPTTSSGWEPRLGSPFPSGPCTSSTGAQAVAEPTGQGPKNPRVSRVTVQLEMKPLWEEFNQLGTEMIVTKAGRRMFPPFQVKILGMDSLADYALLMDFIPLDDKRYRYAFHSSAWLVAGKADPATPGRVHFHPDSPAKGAQWMRQIVSFDKLKLTNNLLDDNGHIILNSMHRYQPRFHVVFVDPRKDSERYAQENFKSFIFTETQFTAVTAYQNHRITQLKIASNPFAKGFRESDLDSWPVAPRPLLSVPARSHSSLSPCVLKGATDREKDPNKASASTSKTPAWLHHQLLPPPEVLLAPATYRPVTYQSLYSGAPSHLGIPRTRPAPYPLPNIRADRDQGGLPLPAGLGLLSPTVVCLGPGQDSQ

SEQ ID NO: 7852 - protein, 682 aa, unidentified
MNPQQQRMAAIGTDKELSDLLDFSAMFSPPVNSGKTRPTTLGSSQFSGSGIDERGGTTSWGTSGQPSPSYDSSRGFTDSPHYSDHLNDSRLGAHEGLSPTPFMNSNLMGKTSERGSFSLYSRDTGLPGCQSSLLRQDLGLGSPAQLSSSGKPGTAYYSFSATSSRRRPLHDSAALDPLQAKKVRKVPPGLPSSVYAPSPNSDDFNRESPSYPSPKPPTSMFASTFFMQDGTHNSSDLWSSSNGMSQPGFGGILGTSTSHMSQSSSYGNLHSHDRLSYPPHSVSPTDINTSLPPMSSFHRGSTSSSPYVAASHTPPINGSDSILGTRGNAAGSSQTGDALGKALASIYSPDHTSSSFPSNPSTPVGSPSPLTGTSQWPRPGGQAPSSPSYENSLHSLQSRMEDRLDRLDDAIHVLRNHAVGPSTSLPAGHSDIHSLLGPSHNAPIGSLNSNYGGSSLVASSRSASMVGTHREDSVSLNGNHSVLSSTVTTSSTDLNHKTQENYRGGLQSQSGTVVTTEIKTENKEKDENLHEPPSSDDMKSDDESSQKDIKVSSRGRTSSTNEDEDLNPEQKIEREKERRMANNARERLRVRDINEAFKELGRMCQLHLKSEKPQTKLLILHQAVAVILSLEQQVRERNLNPKAACLKRREEEKVSAVSAEPPTTLPGTHPGLSETTNPMGHM

SEQ ID NO: 7853 - protein, 433 aa, unidentified
MRQSHQLPLVGLLLFSFIPSQLCEICEVSEENYIRLKPLLNTMIQSNYNRGTSAVNVVLSLKLVGIQIQTLMQKMIQQIKYNVKSRLSDVSSGELALIILALGVCRNAEENLIYDYHLIDKLENKFQAEIENMEAHNGTPLTNYYQLSLDVLALCLFNGNYSTAEVVNHFTPENKNYYFGSQFSVDTGAMAVLALTCVKKSLINGQIKADEGSLKNISIYTKSLVEKILSEKKENGLIGNTFSTGEAMQALFVSSDYYNENDWNCQQTLNTVLTEISQGAFSNPNAAAQVLPALMGKTFLDINKDSSCVSASGNFNISADEPITVTPPDSQSYISVNYSVRINETYFTNVTVLNGSVFLSVMEKAQKMNDTIFGFTMEERSWGPYITCIQGLCANNNDRTYWELLSGGEPLSQGAGSYVVRNGENLEVRWSKY

SEQ ID NO: 7854 - protein, 427 aa, unidentified
MRHLGAFLFLLGVLGALTEMCEIPEMDSHLVEKLGQHLLPWMDRLSLEHLNPSIYVGLRLSSLQAGTKEDLYLHSLKLGYQQCLLGSAFSEDDGDCQGKPSMGQLALYLLALRANCEFVRGHKGDRLVSQLKWFLEDEKRAIGHDHKGHPHTSYYQYGLGILALCLHQKRVHDSVVDKLLYAVEPFHQGHHSVDTAAMAGLAFTCLKRSNFNPGRRQRITMAIRTVREEILKAQTPEGHFGNVYSTPLALQFLMTSPMRGAELGTACLKARVALLASLQDGAFQNALMISQLLPVLNHKTYIDLIFPDCLAPRVMLEPAAETIPQTQEIISVTLQVLSLLPPYRQSISVLAGSTVEDVLKKAHELGGFTYETQASLSGPYLTSVMGKAAGEREFWQLLRDPNTPLLQGIADYRPKDGETIELRLVSW

SEQ ID NO: 7855 - protein, 587 aa, unidentified
MRPRGLPPLLVVLLGCWASVSAQTDATPAVTTEGLNSTEAALATFGTFPSTRPPGTPRAPGPSSGPRPTPVTDVAVLCVCDLSPAQCDINCCCDPDCSSVDFSVFSACSVPVVTGDSQFCSQKAVIYSLNFTANPPQRVFELVDQINPSIFCIHITNYKPALSFINPEVPDENNFDTLMKTSDGFTLNAESYVSFTTKLDIPTAAKYEYGVPLQTSDSFLRFPSSLTSSLCTDNNPAAFLVNQAVKCTRKINLEQCEEIEALSMAFYSSPEILRVPDSRKKVPITVQSIVIQSLNKTLTRREDTDVLQPTLVNAGHFSLCVNVVLEVKYSLTYTDAGEVTKADLSFVLGTVSSVVVPLQQKFEIHFLQENTQPVPLSGNPGYVVGLPLAAGFQPHKGSGIIQTTNRYGQLTILHSTTEQDCLALEGVRTPVLFGYTMQSGCKLRLTGALPCQLVAQKVKSLLWGQGFPDYVAPFGNSQAQDMLDWVPIHFITQSFNRKDSCQLPGALVIEVKWTKYGSLLNPQAKIVNVTANLISSSFPEANSGNERTILISTAVTFVDVSAPAEAGFRAPPAINARLPFNFFFPFV

SEQ ID NO: 7856 - protein, 607 aa, unidentified; identical to SEQ ID NO: 4631

SEQ ID NO: 7857 - protein, 362 aa, unidentified
MELGSCLEGGREAAEEEGEPEVKKRRLLCVEFASVASCDAAVAQCFLAENDWEMERALNSYFEPPVEESALERRPETISEPKTYVDLTNEETTDSTTSKISPSEDTQQENGSMFSLITWNIDGLDLNNLSERARGVCSYLALYSPDVIFLQEVIPPYYSYLKKRSSNYEIITGHEEGYFTAIMLKKSRVKLKSQEIIPFPSTKMMRNLLCVHVNVSGNELCLMTSHLESTRGHAAERMNQLKMVLKKMQEAPESATVIFAGDTNLRDREVTRCGGLPNNIVDVWEFLGKPKHCQYTWDTQMNSNLGITAACKLRFDRIFFRAAAEEGHIIPRSLDLLGLEKLDCGRFPSDHWGLLCNLDIIL

SEQ ID NO: 7858 - protein, 1124 aa, unidentified; identical to SEQ ID NO: 4638

SEQ ID NO: 7859 - protein, 271 aa, unidentified
MGIVCAQCSFILLLSIIRARPPPFLFCPLSSQRTESPYKPVHLGLGPTDKVAAIAMARIIDLVPWDDGSTHVYASPAILLPMERQRNQLAGVKQQLYHPALPTLRHMDRDTVKACLPDEHCQSTTYCRKDEFDNAHFTLLGVPNKPLQCLDITATGQKLRNRYHEGKLAPIAPGINRVDWPCFTRAIEDWSHFVSSAGEFKLPCLRKRAEGLSGYAVRYLKPDVTQTWRYCLSQNPSLDRYGQKPLPFDSLNTFRSFGSSYSRVNYLTPWH

SEQ ID NO: 7860 - protein, 249 aa, unidentified; identical to SEQ ID NO: 4646

SEQ ID NO: 7861 - protein, 313 aa, unidentified; identical to SEQ ID NO: 4649

SEQ ID NO: 7862 - protein, 698 aa, unidentified
MRLAVGALLVCAVLGLCLAVPDKTVRWCAVSEHEATKCQSFRDHMKSVIPSDGPSVACVKKASYLDCIRAIAANEADAVTLDAGLVYDAYLAPNNLKPVVAEFYGSKEDPQTFYYAVAVVKKDSGFQMNQLRGKKSCHTGLGRSAGWNIPIGLLYCDLPEPRKPLEKAVANFFSGSCAPCADGTDFPQLCQLCPGCGCSTLNQYFGYSGAFKCLKDGAGDVAFVKHSTIFENLANKADRDQYELLCLDNTRKPVDEYKDCHLAQVPSHTVVARSMGGKEDLIWELLNQAQEHFGKDKSKEFQLFSSPHGKDLLFKDSAHGFLKVPPRMDAKMYLGYEYVTAIRNLREGTCPEAPTDECKPVKWCALSHHERLKCDEWSVNSVGKIECVSAETTEDCIAKIMNGEADAMSLDGGFVYIAGKCGLVPVLAENYNKSDNCEDTPEAGYFAIAVVKKSASDLTWDNLKGKKSCHTAVGRTAGWNIPMGLLYNKINHCRFDEFFSEGCAPGSKKDSSLCKLCMGSGLNLCEPNNKEGYYGYTGAFRCLVEKGDVAFVKHQTVPQNTGGKNPDPWAKNLNEKDYELLCLDGTRKPVEEYANCHLARAPNHAVVTRKDKEACVHKILRQQQHLFGSNVTDCSGNFCLFRSETKDLLFRDDTVCLAKLHDRNTYEKYLGEEYVKAVGNLRKCSTSSLLEACTFRRP

SEQ ID NO: 7863 - protein, 246 aa, unidentified
MAFLRSMWGVLSALGRSGAELCTGCGSRLRSPFSFVYLPRWFSSVLASCPKKPVSSYLRFSKEQLPIFKAQNPDAKTTELIRRIAQRWRELPDSKKKIYQDAYRAEWQVYKEEISRFKEQLTPSQIMSLEKEIMDKHLKRKAMTKKKELTLLGKPKRPRSAYNVYVAERFQEAKGDSPQEKLKTVKENWKNLSDSEKELYIQHAKEDETRYHNEMKSWEEQMIEVGRKDLLRRTIKKQRKYGAEEC

SEQ ID NO: 7864 - protein, 84 aa, unidentified
MATMENKVICALVLVSMLALGTLAEAQTETCTVAPRERQNCGFPGVTPSQCANKGCCFDDTVRGVPWCFYPNTIDVPPEEECEF

SEQ ID NO: 7865 - protein, 129 aa, unidentified
MGRRDAQLLAALLVLGLCALAGSEKPSPCQCSRLSPHNRTNCGFPGITSDQCFDNGCCFDSSVTGVPWCFHPLPKQESDQCVMEVSDRRNCGYPGISPEECASRKCCFSNFIFEVPWCFFPKSVEDCHY

SEQ ID NO: 7866 - protein, 94 aa, unidentified
MKRVLSCVPEPTVVMAARALCMLGLVLALLSSSSAEEYVGLSANQCAVPAKDRVDCGYPHVTPKECNNRGCCFDSRIPGVPWCFKPLQEAECTF

SEQ ID NO: 7867 - protein, 304 aa, unidentified
MIYTMKKVHALWASVCLLLNLAPAPLNADSEEDEEHTIITDTELPPLKLMHSFCAFKADDGPCKAIMKRFFFNIFTRQCEEFIYGGCEGNQNRFESLEECKKMCTRDNANRIIKTTLQQEKPDFCFLEEDPGICRGYITRYFYNNQTKQCERFKYGGCLGNMNNFETLEECKNICEDGPNGFQVDNYGTQLNAVNNSLTPQSTKVPSLFEFHGPSWCLTPADRGLCRANENRFYYNSVIGKCRPFKYSGCGGNENNFTSKQECLRACKKGFIQRISKGGLIKTKRKRKKQRVKIAYEEIFVKNM

SEQ ID NO: 7868 - protein, 235 aa, unidentified
MDPARPLGLSILLLFLTEAALGDAAQEPTGNNAEICLLPLDYGPCRALLLRYYYDRYTQSCRQFLYGGCEGNANNFYTWEACDDACWRIEKVPKVCRLQVSVDDQCEGSTEKYFFNLSSMTCEKFFSGGCHRNRIENRFPDEATCMGFCAPKKIPSFCYSPKDEGLCSANVTRYYFNPRYRTCDAFTYTGCGGNDNNFVSREDCKRACAKALKKKKKMPKLRFASRIRKIRKKQF

SEQ ID NO: 7869 - protein, 2768 aa, unidentified
MALVLEIFTLLASICWVSANIFEYQVDAQPLRPCELQRETAFLKQADYVPQCAEDGSFQTVQCQNDGRSCWCVGANGSEVLGSRQPGRPVACLSFCQLQKQQILLSGYINSTDTSYLPQCQDSGDYAPVQCDVQQVQCWCVDAEGMEVYGTRQLGRPKRCPRSCEIRNRRLLHGVGDKSPPQCSAEGEFMPVQCKFVNTTDMMIFDLVHSYNRFPDAFVTFSSFQRRFPEVSGYCHCADSQGRELAETGLELLLDEIYDTIFAGLDLPSTFTETTLYRILQRRFLAVQSVISGRFRCPTKCEVERFTATSFGHPYVPSCRRNGDYQAVQCQTEGPCWCVDAQGKEMHGTRQQGEPPSCAEGQSCASERQQALSRLYFGTSGYFSQHDLFSSPEKRWASPRVARFATSCPPTIKELFVDSGLLRPMVEGQSQQFSVSENLLKEAIRAIFPSRGLARLALQFTTNPKRLQQNLFGGKFLVNVGQFNLSGALGTRGTFNFSQFFQQLGLASFLNGGRQEDLAKPLSVGLDSNSSTGTPEAAKKDGTMNKPTVGSFGFEINLQENQNALKFLASLLELPEFLLFLQHAISVPEDVARDLGDVMETVLSSQTCEQTPERLFVPSCTTEGSYEDVQCFSGECWCVNSWGKELPGSRVRGGQPRCPTDCEKQRARMQSLMGSQPAGSTLFVPACTSEGHFLPVQCFNSECYCVDAEGQAIPGTRSAIGKPKKCPTPCQLQSEQAFLRTVQALLSNSSMLPTLSDTYIPQCSTDGQWRQVQCNGPPEQVFELYQRWEAQNKGQDLTPAKLLVKIMSYREAASGNFSLFIQSLYEAGQQDVFPVLSQYPSLQDVPLAALEGKRPQPRENILLEPYLFWQILNGQLSQYPGSYSDFSTPLAHFDLRNCWCVDEAGQELEGMRSEPSKLPTCPGSCEEAKLRVLQFIRETEEIVSASNSSRFPLGESFLVAKGIRLRNEDLGLPPLFPPREAFAEQFLRGSDYAIRLAAQSTLSFYQRRRFSPDDSAGASALLRSGPYMPQCDAFGSWEPVQCHAGTGHCWCVDEKGGFIPGSLTARSLQIPQCPTTCEKSRTSGLLSSWKQARSQENPSPKDLFVPACLETGEYARLQASGAGTWCVDPASGEELRPGSSSSAQCPSLCNVLKSGVLSRRVSPGYVPACRAEDGGFSPVQCDQAQGSCWCVMDSGEEVPGTRVTGGQPACESPRCPLPFNASEVVGGTILCETISGPTGSAMQQCQLLCRQGSWSVFPPGPLICSLESGRWESQLPQPRACQRPQLWQTIQTQGHFQLQLPPGKMCSADYADLLQTFQVFILDELTARGFCQIQVKTFGTLVSIPVCNNSSVQVGCLTRERLGVNVTWKSRLEDIPVASLPDLHDIERALVGKDLLGRFTDLIQSGSFQLHLDSKTFPAETIRFLQGDHFGTSPRTWFGCSEGFYQVLTSEASQDGLGCVKCPEGSYSQDEECIPCPVGFYQEQAGSLACVPCPVGRTTISAGAFSQTHCVTDCQRNEAGLQCDQNGQYRASQKDRGSGKAFCVDGEGRRLPWWETEAPLEDSQCLMMQKFEKVPESKVIFDANAPVAVRSKVPDSEFPVMQCLTDCTEDEACSFFTVSTTEPEISCDFYAWTSDNVACMTSDQKRDALGNSKATSFGSLRCQVKVRSHGQDSPAVYLKKGQGSTTTLQKRFEPTGFQNMLSGLYNPIVFSASGANLTDAHLFCLLACDRDLCCDGFVLTQVQGGAIICGLLSSPSVLLCNVKDWMDPSEAWANATCPGVTYDQESHQVILRLGDQEFIKSLTPLEGTQDTFTNFQQVYLWKDSDMGSRPESMGCRKDTVPRPASPTEAGLTTELFSPVDLNQVIVNGNQSLSSQKHWLFKHLFSAQQANLWCLSRCVQEHSFCQLAEITESASLYFTCTLYPEAQVCDDIMESNAQGCRLILPQMPKALFRKKVILEDKVKNFYTRLPFQKLMGISIRNKVPMSEKSISNGFFECERRCDADPCCTGFGFLNVSQLKGGEVTCLTLNSLGIQMCSEENGGAWRILDCGSPDIEVHTYPFGWYQKPIAQNNAPSFCPLVVLPSLTEKVSLDSWQSLALSSVVVDPSIRHFDVAHVSTAATSNFSAVRDLCLSECSQHEACLITTLQTQPGAVRCMFYADTQSCTHSLQGQNCRLLLREEATHIYRKPGISLLSYEASVPSVPISTHGRLLGRSQAIQVGTSWKQVDQFLGVPYAAPPLAERRFQAPEPLNWTGSWDASKPRASCWQPGTRTSTSPGVSEDCLYLNVFIPQNVAPNASVLVFFHNTMDREESEGWPAIDGSFLAAVGNLIVVTASYRVGVFGFLSSGSGEVSGNWGLLDQVAALTWVQTHIRGFGGDPRRVSLAADRGGADVASIHLLTARATNSQLFRRAVLMGGSALSPAAVISHERAQQQAIALAKEVSCPMSSSQEVVSCLRQKPANVLNDAQTKLLAVSGPFHYWGPVIDGHFLREPPARALKRSLWVEVDLLIGSSQDDGLINRAKAVKQFEESRGRTSSKTAFYQALQNSLGGEDSDARVEAAATWYYSLEHSTDDYASFSRALENATRDYFIICPIIDMASAWAKRARGNVFMYHAPENYGHGSLELLADVQFALGLPFYPAYEGQFSLEEKSLSLKIMQYFSHFIRSGNPNYPYEFSRKVPTFATPWPDFVPRAGGENYKEFSELLPNRQGLKKADCSFWSKYISSLKTSADGAKGGQSAESEEEELTAGSGLREDLLSLQEPGSKTYSK

SEQ ID NO: 7870 - protein, 390 aa, unidentified
MPPSGLRLLLLLLPLLWLLVLTPGRPAAGLSTCKTIDMELVKRKRIEAIRGQILSKLRLASPPSQGEVPPGPLPEAVLALYNSTRDRVAGESAEPEPEPEADYYAKEVTRVLMVETHNEIYDKFKQSTHSIYMFFNTSELREAVPEPVLLSRAELRLLRLKLKVEQHVELYQKYSNNSWRYLSNRLLAPSDSPEWLSFDVTGVVRQWLSRGGEIEGFRLSAHCSCDSRDNTLQVDINGFTTGRRGDLATIHGMNRPFLLLMATPLERAQHLQSSRHRRALDTNYCFSSTEKNCCVRQLYIDFRKDLGWKWIHEPKGYHANFCLGPCPYIWSLDTQYSKVLALYNQHNPGASAAPCCVPQALEPLPIVYYVGRKPKVEQLSNMIVRSCKCS

SEQ ID NO: 7871 - protein, 414 aa, unidentified
MHYCVLSAFLILHLVTVALSLSTCSTLDMDQFMRKRIEAIRGQILSKLKLTSPPEDYPEPEEVPPEVISIYNSTRDLLQEKASRRAAACERERSDEEYYAKEVYKIDMPPFFPSENAIPPTFYRPYFRIVRFDVSAMEKNASNLVKAEFRVFRLQNPKARVPEQRIELYQILKSKDLTSPTQRYIDSKVVKTRAEGEWLSFDVTDAVHEWLHHKDRNLGFKISLHCPCCTFVPSNNYIIPNKSEELEARFAGIDGTSTYTSGDQKTIKSTRKKNSGKTPHLLLMLLPSYRLESQQTNRRKKRALDAAYCFRNVQDNCCLRPLYIDFKRDLGWKWIHEPKGYNANFCAGACPYLWSSDTQHSRVLSLYNTINPEASASPCCVSQDLEPLTILYYIGKTPKIEQLSNMIVKSCKCS

SEQ ID NO: 7872 - protein, 412 aa, unidentified
MKMHLQRALVVLALLNFATVSLSLSTCTTLDFGHIKKKRVEAIRGQILSKLRLTSPPEPTVMTHVPYQVLALYNSTRELLEEMHGEREEGCTQENTESEYYAKEIHKFDMIQGLAEHNELAVCPKGITSKVFRFNVSSVEKNRTNLFRAEFRVLRVPNPSSKRNEQRIELFQILRPDEHIAKQRYIGGKNLPTRGTAEWLSFDVTDTVREWLLRRESNLGLEISIHCPCHTFQPNGDILENIHEVMEIKFKGVDNEDDHGRGDLGRLKKQKDHHNPHLILMMIPPHRLDNPGQGGQRKKRALDTNYCFRNLEENCCVRPLYIDFRQDLGWKWVHEPKGYYANFCSGPCPYLRSADTTHSTVLGLYNTLNPEASASPCCVPQDLEPLTILYYVGRTPKVEQLSNMVVKSCKCS

SEQ ID NO: 7873 - protein, 683 aa, unidentified
MALFVRLLALALALALGPAATLAGPAKSPYQLVLQHSRLRGRQHGPNVCAVQKVIGTNRKYFTNCKQWYQRKICGKSTVISYECCPGYEKVPGEKGCPAALPLSNLYETLGVVGSTTTQLYTDRTEKLRPEMEGPGSFTIFAPSNEAWASLPAEVLDSLVSNVNIELLNALRYHMVGRRVLTDELKHGMTLTSMYQNSNIQIHHYPNGIVTVNCARLLKADHHATNGVVHLIDKVISTITNNIQQIIEIEDTFETLRAAVAASGLNTMLEGNGQYTLLAPTNEAFEKIPSETLNRILGDPEALRDLLNNHILKSAMCAEAIVAGLSVETLEGTTLEVGCSGDMLTINGKAIISNKDILATNGVIHYIDELLIPDSAKTLFELAAESDVSTAIDLFRQAGLGNHLSGSERLTLLAPLNSVFKDGTPPIDAHTRNLLRNHIIKDQLASKYLYHGQTLETLGGKKLRVFVYRNSLCIENSCIAAHDKRGRYGTLFTMDRVLTPPMGTVMDVLKGDNRFSMLVAAIQSAGLTETLNREGVYTVFAPTNEAFRALPPRERSRLLGDAKELANILKYHIGDEILVSGGIGALVRLKSLQGDKLEVSLKNNVVSVNKEPVAEPDIMATNGVVHVITNVLQPPANRPQERGDELADSALEIFKQASAFSRASQRSVRLAPVYQKLLERMKH

SEQ ID NO: 7874 - protein, 503 aa, unidentified; identical to SEQ ID NO: 4655

SEQ ID NO: 7875 - protein, 851 aa, unidentified; identical to SEQ ID NO: 4657

SEQ ID NO: 7876 - protein, 1170 aa, unidentified
MGLAWGLGVLFLMHVCGTNRIPESGGDNSVFDIFELTGAARKGSGRRLVKGPDPSSPAFRIEDANLIPPVPDDKFQDLVDAVRAEKGFLLLASLRQMKKTRGTLLALERKDHSGQVFSVVSNGKAGTLDLSLTVQGKQHVVSVEEALLATGQWKSITLFVQEDRAQLYIDCEKMENAELDVPIQSVFTRDLASIARLRIAKGGVNDNFQGVLQNVRFVFGTTPEDILRNKGCSSSTSVLLTLDNNVVNGSSPAIRTNYIGHKTKDLQAICGISCDELSSMVLELRGLRTIVTTLQDSIRKVTEENKELANELRRPPLCYHNGVQYRNNEEWTVDSCTECHCQNSVTICKKVSCPIMPCSNATVPDGECCPRCWPSDSADDGWSPWSEWTSCSTSCGNGIQQRGRSCDSLNNRCEGSSVQTRTCHIQECDKRFKQDGGWSHWSPWSSCSVTCGDGVITRIRLCNSPSPQMNGKPCEGEARETKACKKDACPINGGWGPWSPWDICSVTCGGGVQKRSRLCNNPTPQFGGKDCVGDVTENQICNKQDCPIDGCLSNPCFAGVKCTSYPDGSWKCGACPPGYSGNGIQCTDVDECKEVPDACFNHNGEHRCENTDPGYNCLPCPPRFTGSQPFGQGVEHATANKQVCKPRNPCTDGTHDCNKNAKCNYLGHYSDPMYRCECKPGYAGNGIICGEDTDLDGWPNENLVCVANATYHCKKDNCPNLPNSGQEDYDKDGIGDACDDDDDNDKIPDDRDNCPFHYNPAQYDYDRDDVGDRCDNCPYNHNPDQADTDNNGEGDACAADIDGDGILNERDNCQYVYNVDQRDTDMDGVGDQCDNCPLEHNPDQLDSDSDRIGDTCDNNQDIDEDGHQNNLDNCPYVPNANQADHDKDGKGDACDHDDDNDGIPDDKDNCRLVPNPDQKDSDGDGRGDACKDDFDHDSVPDIDDICPENVDISETDFRRFQMIPLDPKGTSQNDPNWVVRHQGKELVQTVNCDPGLAVGYDEFNAVDFSGTFFINTERDDDYAGFVFGYQSSSRFYVVMWKQVTQSYWDTNPTRAQGYSGLSVKVVNSTTGPGEHLRNALWHTGNTPGQVRTLWHDPRHIGWKDFTAYRWRLSHRPKTGFIRVVMYEGKKIMADSGPIYDKTYAGGRLGLFVFSQEMVFFSDLKYECRDP

SEQ ID NO: 7877 - protein, 1172 aa, unidentified
MVWRLVLLALWVWPSTQAGHQDKDTTFDLFSISNINRKTIGAKQFRGPDPGVPAYRFVRFDYIPPVNADDLSKITKIMRQKEGFFLTAQLKQDGKSRGTLLALEGPGLSQRQFEIVSNGPADTLDLTYWIDGTRHVVSLEDVGLADSQWKNVTVQVAGETYSLHVGCDLIDSFALDEPFYEHLQAEKSRMYVAKGSARESHFRGLLQNVHLVFENSVEDILSKKGCQQGQGAEINAISENTETLRLGPHVTTEYVGPSSERRPEVCERSCEELGNMVQELSGLHVLVNQLSENLKRVSNDNQFLWELIGGPPKTRNMSACWQDGRFFAENETWVVDSCTTCTCKKFKTICHQITCPPATCASPSFVEGECCPSCLHSVDGEEGWSPWAEWTQCSVTCGSGTQQRGRSCDVTSNTCLGPSIQTRACSLSKCDTRIRQDGGWSHWSPWSSCSVTCGVGNITRIRLCNSPVPQMGGKNCKGSGRETKACQGAPCPIDGRWSPWSPWSACTVTCAGGIRERTRVCNSPEPQYGGKACVGDVQERQMCNKRSCPVDGCLSNPCFPGAQCSSFPDGSWSCGSCPVGFLGNGTHCEDLDECALVPDICFSTSKVPRCVNTQPGFHCLPCPPRYRGNQPVGVGLEAAKTEKQVCEPENPCKDKTHNCHKHAECIYLGHFSDPMYKCECQTGYAGDGLICGEDSDLDGWPNLNLVCATNATYHCIKDNCPHLPNSGQEDFDKDGIGDACDDDDDNDGVTDEKDNCQLLFNPRQADYDKDEVGDRCDNCPYVHNPAQIDTDNNGEGDACSVDIDGDDVFNERDNCPYVYNTDQRDTDGDGVGDHCDNCPLVHNPDQTDVDNDLVGDQCDNNEDIDDDGHQNNQDNCPYISNANQADHDRDGQGDACDPDDDNDGVPDDRDNCRLVFNPDQEDLDGDGRGDICKDDFDNDNIPDIDDVCPENNAISETDFRNFQMVPLDPKGTTQIDPNWVIRHQGKELVQTANSDPGIAVGFDEFGSVDFSGTFYVNTDRDDDYAGFVFGYQSSSRFYVVMWKQVTQTYWEDQPTRAYGYSGVSLKVVNSTTGTGEHLRNALWHTGNTPGQVRTLWHDPRNIGWKDYTAYRWHLTHRPKTGYIRVLVHEGKQVMADSGPIYDQTYAGGRLGLFVFSQEMVYFSDLKYECRDI

SEQ ID NO: 7878 - protein, 956 aa, unidentified
METQELRGALALLLLCFFTSASQDLQVIDLLTVGESRQMVAVAEKIRTALLTAGDIYLLSTFRLPPKQGGVLFGLYSRQDNTRWLEASVVGKINKVLVRYQREDGKVHAVNLQQAGLADGRTHTVLLRLRGPSRPSPALHLYVDCKLGDQHAGLPALAPIPPAEVDGLEIRTGQKAYLRMQGFVESMKIILGGSMARVGALSECPFQGDESIHSAVTNALHSILGEQTKALVTQLTLFNQILVELRDDIRDQVKEMSLIRNTIMECQVCGFHEQRSHCSPNPCFRGVDCMEVYEYPGYRCGPCPPGLQGNGTHCSDINECAHADPCFPGSSCINTMPGFHCEACPRGYKGTQVSGVGIDYARASKQVCNDIDECNDGNNGGCDPNSICTNTVGSFKCGPCRLGFLGNQSQGCLPARTCHSPAHSPCHIHAHCLFERNGAVSCQCNVGWAGNGNVCGTDTDIDGYPDQALPCMDNNKHCKQDNCLLTPNSGQEDADNDGVGDQCDDDADGDGIKNVEDNCRLFPNKDQQNSDTDSFGDACDNCPNVPNNDQKDTDGNGEGDACDNDVDGDGIPNGLDNCPKVPNPLQTDRDEDGVGDACDSCPEMSNPTQTDADSDLVGDVCDTNEDSDGDGHQDTKDNCPQLPNSSQLDSDNDGLGDECDGDDDNDGIPDYVPPGPDNCRLVPNPNQKDSDGNGVGDVCEDDFDNDAVVDPLDVCPESAEVTLTDFRAYQTVVLDPEGDAQIDPNWVVLNQGMEIVQTMNSDPGLAVGYTAFNGVDFEGTFHVNTVTDDDYAGFLFSYQDSGRFYVVMWKQTEQTYWQATPFRAVAQPGLQLKAVTSVSGPGEHLRNALWHTGHTPDQVRLLWTDPRNVGWRDKTSYRWQLLHRPQVGYIRVKLYEGPQLVADSGVIIDTSMRGGRLGVFCFSQENIIWSNLQYRCNDTVPEDFEPFRRQLLQGRV

SEQ ID NO: 7879 - protein, 961 aa, unidentified
MLAPRGAAVLLLHLVLQRWLAAGAQATPQVFDLLPSSSQRLNPGALLPVLTDPALNDLYVISTFKLQTKSSATIFGLYSSTDNSKYFEFTVMGRLNKAILRYLKNDGKVHLVVFNNLQLADGRRHRILLRLSNLQRGAGSLELYLDCIQVDSVHNLPRAFAGPSQKPETIELRTFQRKPQDFLEELKLVVRGSLFQVASLQDCFLQQSEPLAATGTGDFNRQFLGQMTQLNQLLGEVKDLLRQQVKETSFLRNTIAECQACGPLKFQSPTPSTVVPPAPPAPPTRPPRRCDSNPCFRGVQCTDSRDGFQCGPCPEGYTGNGITCIDVDECKYHPCYPGVHCINLSPGFRCDACPVGFTGPMVQGVGISFAKSNKQVCTDIDECRNGACVPNSICVNTLGSYRCGPCKPGYTGDQIRGCKAERNCRNPELNPCSVNAQCIEERQGDVTCVCGVGWAGDGYICGKDVDIDSYPDEELPCSARNCKKDNCKYVPNSGQEDADRDGIGDACDEDADGDGILNEQDNCVLIHNVDQRNSDKDIFGDACDNCLSVLNNDQKDTDGDGRGDACDDDMDGDGIKNILDNCPKFPNRDQRDKDGDGVGDACDSCPDVSNPNQSDVDNDLVGDSCDTNQDSDGDGHQDSTDNCPTVINSAQLDTDKDGIGDECDDDDDNDGIPDLVPPGPDNCRLVPNPAQEDSNSDGVGDICESDFDQDQVIDRIDVCPENAEVTLTDFRAYQTVVLDPEGDAQIDPNWVVLNQGMEIVQTMNSDPGLAVGYTAFNGVDFEGTFHVNTQTDDDYAGFIFGYQDSSSFYVVMWKQTEQTYWQATPFRAVAEPGIQLKAVKSKTGPGEHLRNSLWHTGDTSDQVRLLWKDSRNVGWKDKVSYRWFLQHRPQVGYIRVRFYEGSELVADSGVTIDTTMRGGRLGVFCFSQENIIWSNLKYRCNDTIPEDFQEFQTQNFDRFDN

SEQ ID NO: 7880 - protein, 351 aa, unidentified
MAVPAAAMGPSALGQSGPGSMAPWCSVSSGPSRYVLGMQELFRGHSKTREFLAHSAKVHSVAWSCDGRRLASGSFDKTASVFLLEKDRLVKENNYRGHGDSVDQLCWHPSNPDLFVTASGDKTIRIWDVRTTKCIATVNTKGENINICWSPDGQTIAVGNKDDVVTFIDAKTHRSKAEEQFKFEVNEISWNNDNNMFFLTNGNGCINILSYPELKPVQSINAHPSNCICIKFDPMGKYFATGSADALVSLWDVDELVCVRCFSRLDWPVRTLSFSHDGKMLASASEDHFIDIAEVETGDKLWEVQCESPTFTVAWHPKRPLLAFACDDKDGKYDSSREAGTVKLFGLPNDS

SEQ ID NO: 7881 - protein, 353 aa, unidentified
MELTELLLVVMLLLTARLTLSSPAPPACDLRVLSKLLRDSHVLHSRLSQCPEVHPLPTPVLLPAVDFSLGEWKTQMEETKAQDILGAVTLLLEGVMAARGQLGPTCLSSLLGQLSGQVRLLLGALQSLLGTQLPPQGRTTAHKDPNAIFLSFQHLLRGKVRFLMLVGGSTLCVRRAPPTTAVPSRTSLVLTLNELPNRTSGLLETNFTASARTTGSGLLKWQQGFRAKIPGLLNQTSRSLDQIPGYLNRIHELLNGTRGLFPGPSRRTLGAPDISSGTSDTGSLPPNLQPGYSPSPTHPPTGQYTLFPLPPTLPTPVVQLHPLLPDPSAPTPTPTSPLLNTSYTHSQNLSQEG

SEQ ID NO: 7882 - protein, 1018 aa, unidentified; identical to SEQ ID NO: 4665

SEQ ID NO: 7883 - protein, 161 aa, unidentified; identical to SEQ ID NO: 4667

SEQ ID NO: 7884 - protein, 1138 aa, unidentified; identical to SEQ ID NO: 4668

SEQ ID NO: 7885 - protein, 285 aa, unidentified; identical to SEQ ID NO: 4676

SEQ ID NO: 7886 - protein, 207 aa, unidentified
MAPFEPLASGILLLLWLIAPSRACTCVPPHPQTAFCNSDLVIRAKFVGTPEVNQTTLYQRYEIKMTKMYKGFQALGDAADIRFVYTPAMESVCGYFHRSHNRSEEFLIAGKLQDGLLHITTCSFVAPWNSLSLAQRRGFTKTYTVGCEECTVFPCLSIPCKLQSGTHCLWTDQLLQGSEKGFQSRHLACLPREPGLCTWQSLRSQIA

SEQ ID NO: 7887 - protein, 220 aa, unidentified
MGAAARTLRLALGLLLLATLLRPADACSCSPVHPQQAFCNADVVIRAKAVSEKEVDSGNDIYGNPIKRIQYEIKQIKMFKGPEKDIEFIYTAPSSAVCGVSLDVGGKKEYLIAGKAEGDGKMHITLCDFIVPWDTLSTTQKKSLNHRYQMGCECKITRCPMIPCYISSPDECLWMDWVTEKNINGHQAKFFACIKRSDGSCAWYRGAAPPKQEFLDIEDP

SEQ ID NO: 7888 - protein, 211 aa, unidentified
MTPWLGLIVLLGSWSLGDWGAEACTCSPSHPQDAFCNSDIVIRAKVVGKKLVKEGPFGTLVYTIKQMKMYRGFTKMPHVQYIHTEASESLCGLKLEVNKYQYLLTGRVYDGKMYTGLCNFVERWDQLTLSQRKGLNYRYHLGCNCKIKSCYYLPCFVTSKNECLWTDMLSNFGYPGYQSKHYACIRQKGGYCSWYRGWAPPDKSIINATDP

SEQ ID NO: 7889 - protein, 224 aa, unidentified
MPGSPRPAPSWVLLLRLLALLRPPGLGEACSCAPAHPQQHICHSALVIRAKISSEKVVPASADPADTEKMLRYEIKQIKMFKGFEKVKDVQYIYTPFDSSLCGVKLEANSQKQYLLTGQVLSDGKVFIHLCNYIEPWEDLSLVQRESLNHHYHLNCGCQITTCYTVPCTISAPNECLWTDWLLERKLYGYQAQHYVCMKHVDGTCSWYRGHLPLRKEFVDIVQP

SEQ ID NO: 7890 - protein, 467 aa, unidentified
MWRCPLGLLLLLPLAGHLALGAQQGRGRRELAPGLHLRGIRDAGGRYCQEQDLCCRGRADDCALPYLGAICYCDLFCNRTVSDCCPDFWDFCLGVPPPFPPIQGCMHGGRIYPVLGTYWDNCNRCTCQENRQWQCDQEPCLVDPDMIKAINQGNYGWQAGNHSAFWGMTLDEGIRYRLGTIRPSSSVMNMHEIYTVLNPGEVLPTAFEASEKWPNLIHEPLDQGNCAGSWAFSTAAVASDRVSIHSLGHMTPVLSPQNLLSCDTHQQQGCRGGRLDGAWWFLRRRGVVSDHCYPFSGRERDEAGPAPPCMMHSRAMGRGKRQATAHCPNSYVNNNDIYQVTPVYRLGSNDKEIMKELMENGPVQALMEVHEDFFLYKGGIYSHTPVSLGRPERYRRHGTHSVKITGWGEETLPDGRTLKYWTAANSWGPAWGERGHFRIVRGVNECDIESFVLGVWGRVGMEDMGHH

SEQ ID NO: 7891 - protein, 451 aa, unidentified
MATPLVAGPAALRFAAAASWQVVRGRCVEHFPRVLEFLRSLRAVAPGLVRYRHHERLCMGLKAKVVVELILQGRPWAQVLKALNHHFPESGPIVRDPKATKQDLRKILEAQETFYQQVKQLSEAPVDLASKLQELEQEYGEPFLAAMEKLLFEYLCQLEKALPTPQAQQLQDVLSWMQPGVSITSSLAWRQYGVDMGWLLPECSVTDSVNLAEPMEQNPPQQQRLALHNPLPKAKPGTHLPQGPSSRTHPEPLAGRHFNLAPLGRRRVQSQWASTRGGHKERPTVMLFPFRNLGSPTQVISKPESKEEHAIYTADLAMGTRAASTGKSKSPCQTLGGRALKENPVDLPATEQKENCLDCYMDPLRLSLLPPRARKPVCPPSLCSSVITIGDLVLDSDEEENGQGEGKESLENYQKTKFDTLIPTLCEYLPPSGHGAIPVSSCDCRDSSRPL

SEQ ID NO: 7892 - protein, 1015 aa, unidentified
MPRATALGALVSLLLLLPLPRGAGGLGERPDATADYSELDGEEGTEQQLEHYHDPCKAAVFWGDIALDEDDLKLFHIDKARDWTKQTVGATGHSTGGLEEQASESSPDTTAMDTGTKEAGKDGRENTTLLHSPGTLHAAAKTFSPRVRRATTSRTERIWPGGVIPYVIGGNFTGSQRAIFKQAMRHWEKHTCVTFIERTDEESFIVFSYRTCGCCSYVGRRGGGPQAISIGKNCDKFGIVAHELGHVVGFWHEHTRPDRDQHVTIIRENIQPGQEYNFLKMEAGEVSSLGETYDFDSIMHYARNTFSRGVFLDTILPRQDDNGVRPTIGQRVRLSQGDIAQARKLYKCPACGETLQDTTGNFSAPGFPNGYPSYSHCVWRISVTPGEKIVLNFTSMDLFKSRLCWYDYVEVRDGYWRKAPLLGRFCGDKIPEPLVSTDSRLWVEFRSSSNILGKGFFAAYEATCGGDMNKDAGQIQSPNYPDDYRPSKECVWRITVSEGFHVGLTFQAFEIERHDSCAYDYLEVRDGPTEESALIGHFCGYEKPEDVKSSSNRLWMKFVSDGSINKAGFAANFFKEVDECSWPDHGGCEHRCVNTLGSYKCACDPGYELAADKKMCEVACGGFITKLNGTITSPGWPKEYPTNKNCVWQVVAPAQYRISLQFEVFELEGNDVCKYDFVEVRSGLSPDAKLHGRFCGSETPEVITSQSNNMRVEFKSDNTVSKRGFRAHFFSDKDECAKDNGGCQHECVNTFGSYLCRCRNGYWLHENGHDCKEAGCAHKISSVEGTLASPNWPDKYPSRRECTWNISSTAGHRVKLTFNEFEIEQHQECAYDHLEMYDGPDSLAPILGRFCGSKKPDPTVASGSSMFLRFYSDASVQRKGFQAVHSTECGGRLKAEVQTKELYSHAQFGDNNYPSEARCDWVIVAEDGYGVELTFRTFEVEEEADCGYDYMEAYDGYDSSAPRLGRFCGSGPLEEIYSAGDSLMIRFRTDDTINKKGFHARYTSTKFQDALHMKK

SEQ ID NO: 7893 - protein, 786 aa, unidentified; identical to SEQ ID NO: 4678

SEQ ID NO: 7894 - protein, 904 aa, unidentified; identical to SEQ ID NO: 4681

SEQ ID NO: 7895 - protein, 214 aa, unidentified; identical to SEQ ID NO: 4689

SEQ ID NO: 7896 - protein, 247 aa, unidentified; identical to SEQ ID NO: 4690

SEQ ID NO: 7897 - protein, 570 aa, unidentified; identical to SEQ ID NO: 4700

SEQ ID NO: 7898 - protein, 606 aa, unidentified; identical to SEQ ID NO: 4701

SEQ ID NO: 7899 - protein, 493 aa, unidentified
MWSRRQGRLRPTVCGVEELRRRRREREAALRKARREQQLVSKRLLRNDAPEEAGEGCVAAILGETEVQQFLRQAQRGTEEKEREGALVSLRRGLQHPETQQTFIRLEGSMRTLVGLLTSNQALLQLEAARCLHELSHSEQSTVAEACLPATSYLLTYLSSHSSDFIELCLYTLGNLIVESEAVRRQLLPQGIVPALAACIQSPHVAVLEALGYALSQLLQAEEAPEKIIPSILASTLPQHMLQMLQPGPKLNPGVAVEFAWCLHYIICSQVSNPLLIGHGALSTLGLLLLDLAGAVQKTEDAGLELLACPVLRCLSNLLTEAAVETVGGQMQLRDERVVAALFILLQFFFQKQPSLLPEGLWLLNNLTANSPSFCTSLLSLDLIEPLLQLLPVSNVVSVMVLTVLCNVAEKGPAYCQRLWPGPLLPALLHTLAFSDTEVVGQSLELLHLLFLYQPEAVQVFLQQSGLQALERHQEEAQLQDRVYALQQTALQG

SEQ ID NO: 7900 - protein, 227 aa, unidentified; identical to SEQ ID NO: 4724

SEQ ID NO: 7901 - protein, 201 aa, unidentified; identical to SEQ ID NO: 4726

SEQ ID NO: 7902 - protein, 217 aa, unidentified; identical to SEQ ID NO: 4727

SEQ ID NO: 7903 - protein, 227 aa, unidentified; identical to SEQ ID NO: 4728

SEQ ID NO: 7904 - protein, 229 aa, unidentified; identical to SEQ ID NO: 4729

SEQ ID NO: 7905 - protein, 224 aa, unidentified; identical to SEQ ID NO: 4731

SEQ ID NO: 7906 - protein, 575 aa, unidentified; identical to SEQ ID NO: 4743

SEQ ID NO: 7907 - protein, 245 aa, unidentified; identical to SEQ ID NO: 4749

SEQ ID NO: 7908 - protein, 283 aa, unidentified; identical to SEQ ID NO: 4751

SEQ ID NO: 7909 - protein, 130 aa, unidentified
MASDLIRTILAVALISKLGTAVDAELMPSGAILQNKRENLPRVCHALAFLGMARCQDLFLVRLQGWKLGTRFQDGPRSTPQEEGGSPQRKRGMPVQIHFLLKSFLSSPITFAFISLARTVSLATAICKIV

SEQ ID NO: 7910 - protein, 297 aa, unidentified; identical to SEQ ID NO: 4808

SEQ ID NO: 7911 - protein, 233 aa, unidentified; identical to SEQ ID NO: 4810

SEQ ID NO: 7912 - protein, 178 aa, unidentified; identical to SEQ ID NO: 4826

SEQ ID NO: 7913 - protein, 208 aa, unidentified; identical to SEQ ID NO: 4828

SEQ ID NO: 7914 - protein, 189 aa, unidentified; identical to SEQ ID NO: 4837

SEQ ID NO: 7915 - protein, 107 aa, unidentified; identical to SEQ ID NO: 4845

SEQ ID NO: 7916 - protein, 366 aa, unidentified; identical to SEQ ID NO: 4878

SEQ ID NO: 7917 - protein, 291 aa, unidentified; identical to SEQ ID NO: 4904

SEQ ID NO: 7918 - protein, 475 aa, unidentified; identical to SEQ ID NO: 4910

SEQ ID NO: 7919 - protein, 209 aa, unidentified; identical to SEQ ID NO: 4917

SEQ ID NO: 7920 - protein, 183 aa, unidentified
MGVRVHVVAASALLYFILLSGTRCEENCGNPEHCLTTDWVHLWYIWLLVVIGALLLLCGLTSLCFRCCCLSRQQNGEDGGPPPCEVTVIAFDHDSTLQSTITSLQSVFGPAARRILAVAHSHSSLGQLPSSLDTLPGYEEALHMSRFTVAMCGQKAPDLPPVPEEKQLPPTEKESTRIVDSWN

SEQ ID NO: 7921 - protein, 323 aa, unidentified; identical to SEQ ID NO: 4925

SEQ ID NO: 7922 - protein, 995 aa, unidentified; identical to SEQ ID NO: 4935

SEQ ID NO: 7923 - protein, 260 aa, unidentified; identical to SEQ ID NO: 4938

SEQ ID NO: 7924 - protein, 555 aa, unidentified; identical to SEQ ID NO: 4949

SEQ ID NO: 7925 - protein, 1356 aa, unidentified; identical to SEQ ID NO: 4960

SEQ ID NO: 7926 - protein, 176 aa, unidentified; identical to SEQ ID NO: 4961

SEQ ID NO: 7927 - protein, 262 aa, unidentified; identical to SEQ ID NO: 4967

SEQ ID NO: 7928 - protein, 348 aa, unidentified; identical to SEQ ID NO: 4976

SEQ ID NO: 7929 - protein, 457 aa, unidentified; identical to SEQ ID NO: 4981

SEQ ID NO: 7930 - protein, 246 aa, unidentified; identical to SEQ ID NO: 4989

SEQ ID NO: 7931 - protein, 296 aa, unidentified; identical to SEQ ID NO: 4992

SEQ ID NO: 7932 - protein, 454 aa, unidentified; identical to SEQ ID NO: 4993

SEQ ID NO: 7933 - protein, 2201 aa, unidentified
MGAMTQLLAGVFLAFLALATEGGVLKKVIRHKRQSGVNATLPEENQPVVFNHVYNIKLPVGSQCSVDLESASGEKDLAPPSEPSESFQEHTVDGENQIVFTHRINIPRRACGCAAAPDVKELLSRLEELENLVSSLREQCTAGAGCCLQPATGRLDTRPFCSGRGNFSTEGCGCVCEPGWKGPNCSEPECPGNCHLRGRCIDGQCICDDGFTGEDCSQLACPSDCNDQGKCVNGVCICFEGYAGADCSREICPVPCSEEHGTCVDGLCVCHDGFAGDDCNKPLCLNNCYNRGRCVENECVCDEGFTGEDCSELICPNDCFDRGRCINGTCYCEEGFTGEDCGKPTCPHACHTQGRCEEGQCVCDEGFAGVDCSEKRCPADCHNRGRCVDGRCECDDGFTGADCGELKCPNGCSGHGRCVNGQCVCDEGYTGEDCSQLRCPNDCHSRGRCVEGKCVCEQGFKGYDCSDMSCPNDCHQHGRCVNGMCVCDDGYTGEDCRDRQCPRDCSNRGLCVDGQCVCEDGFTGPDCAELSCPNDCHGQGRCVNGQCVCHEGFMGKDCKEQRCPSDCHGQGRCVDGQCICHEGFTGLDCGQHSCPSDCNNLGQCVSGRCICNEGYSGEDCSEVSPPKDLVVTEVTEETVNLAWDNEMRVTEYLVVYTPTHEGGLEMQFRVPGDQTSTIIQELEPGVEYFIRVFAILENKKSIPVSARVATYLPAPEGLKFKSIKETSVEVEWDPLDIAFETWEIIFRNMNKEDEGEITKSLRRPETSYRQTGLAPGQEYEISLHIVKNNTRGPGLKRVTTTRLDAPSQIEVKDVTDTTALITWFKPLAEIDGIELTYGIKDVPGDRTTIDLTEDENQYSIGNLKPDTEYEVSLISRRGDMSSNPAKETFTTGLDAPRNLRRVSQTDNSITLEWRNGKAAIDSYRIKYAPISGGDHAEVDVPKSQQATTKTTLTGLRPGTEYGIGVSAVKEDKESNPATINAATELDTPKDLQVSETAETSLTLLWKTPLAKFDRYRLNYSLPTGQWVGVQLPRNTTSYVLRGLEPGQEYNVLLTAEKGRHKSKPARVKASTEQAPELENLTVTEVGWDGLRLNWTAADQAYEHFIIQVQEANKVEAARNLTVPGSLRAVDIPGLKAATPYTVSIYGVIQGYRTPVLSAEASTGETPNLGEVVVAEVGWDALKLNWTAPEGAYEYFFIQVQEADTVEAAQNLTVPGGLRSTDLPGLKAATHYTITIRGVTQDFSTTPLSVEVLTEEVPDMGNLTVTEVSWDALRLNWTTPDGTYDQFTIQVQEADQVEEAHNLTVPGSLRSMEIPGLRAGTPYTVTLHGEVRGHSTRPLAVEVVTEDLPQLGDLAVSEVGWDGLRLNWTAADNAYEHFVIQVQEVNKVEAAQNLTLPGSLRAVDIPGLEAATPYRVSIYGVIRGYRTPVLSAEASTAKEPEIGNLNVSDITPESFNLSWMATDGIFETFTIEIIDSNRLLETVEYNISGAERTAHISGLPPSTDFIVYLSGLAPSIRTKTISATATTEALPLLENLTISDINPYGFTVSWMASENAFDSFLVTVVDSGKLLDPQEFTLSGTQRKLELRGLITGIGYEVMVSGFTQGHQTKPLRAEIVTEAEPEVDNLLVSDATPDGFRLSWTADEGVFDNFVLKIRDTKKQSEPLEITLLAPERTRDITGLREATEYEIELYGISKGRRSQTVSAIATTAMGSPKEVIFSDITENSATVSWRAPTAQVESFRITYVPITGGTPSMVTVDGTKTQTRLVKLIPGVEYLVSIIAMKGFEESEPVSGSFTTALDGPSGLVTANITDSEALARWQPAIATVDSYVISYTGEKVPEITRTVSGNTVEYALTDLEPATEYTLRIFAEKGPQKSSTITAKFTTDLDSPRDLTATEVQSETALLTWRPPRASVTGYLLVYESVDGTVKEVIVGPDTTSYSLADLSPSTHYTAKIQALNGPLRSNMIQTIFTTIGLLYPFPKDCSQAMLNGDTTSGLYTIYLNGDKAEALEVFCDMTSDGGGWIVFLRRKNGRENFYQNWKAYAAGFGDRREEFWLGLDNLNKITAQGQYELRVDLRDHGETAFAVYDKFSVGDAKTRYKLKVEGYSGTAGDSMAYHNGRSFSTFDKDTDSAITNCALSYKGAFWYRNCHRVNLMGRYGDNNHSQGVNWFHWKGHEHSIQFAEMKLRPSNFRNLEGRRKRA

SEQ ID NO: 7934 - protein, 277 aa, unidentified
MIILIYLFLLLWEDTQGWGFKDGIFHNSIWLERAAGVYHREARSGKYKLTYAEAKAVCEFEGGHLATYKQLEAARKIGFHVCAAGWMAKGRVGYPIVKPGPNCGFGKTGIIDYGIRLNRSERWDAYCYNPHAKECGGVFTDPKQIFKSPGFPNEYEDNQICYWHIRLKYGQRIHLSFLDFDLEDDPGCLADYVEIYDSYDDVHGFVGRYCGDELPDDIISTGNVMTLKFLSDASVTAGGFQIKYVAMDPVSKSSQGKNTSTTSTGNKNFLAGRFSHL

SEQ ID NO: 7935 - protein, 616 aa, unidentified; identical to SEQ ID NO: 4999

SEQ ID NO: 7936 - protein, 401 aa, unidentified
MNNLLCCALVFLDISIKWTTQETFPPKYLHYDEETSHQLLCDKCPPGTYLKQHCTAKWKTVCAPCPDHYYTDSWHTSDECLYCSPVCKELQYVKQECNRTHNRVCECKEGRYLEIEFCLKHRSCPPGFGVVQAGTPERNTVCKRCPDGFFSNETSSKAPCRKHTNCSVFGLLLTQKGNATHDNICSGNSESTQKCGIDVTLCEEAFFRFAVPTKFTPNWLSVLVDNLPGTKVNAESVERIKRQHSSQEQTFQLLKLWKHQNKDQDIVKKIIQDIDLCENSVQRHIGHANLTFEQLRSLMESLPGKKVGAEDIEKTIKACKPSDQILKLLSLWRIKNGDQDTLKGLMHALKHSKTYHFPKTVTQSLKKTIRFLHSFTMYKLYQKLFLEMIGNQVQSVKISCL

SEQ ID NO: 7937 - protein, 129 aa, unidentified; identical to SEQ ID NO: 5000

SEQ ID NO: 7938 - protein, 283 aa, unidentified; identical to SEQ ID NO: 5003

SEQ ID NO: 7939 - protein, 241 aa, unidentified; identical to SEQ ID NO: 5005

SEQ ID NO: 7940 - protein, 455 aa, unidentified; identical to SEQ ID NO: 5007

SEQ ID NO: 7941 - protein, 461 aa, unidentified; identical to SEQ ID NO: 5008

SEQ ID NO: 7942 - protein, 417 aa, unidentified; identical to SEQ ID NO: 5010

SEQ ID NO: 7943 - protein, 300 aa, unidentified
MRALEGPGLSLLCLVLALPALLPVPAVRGVAETPTYPWRDAETGERLVCAQCPPGTFVQRPCRRDSPTTCGPCPPRHYTQFWNYLERCRYCNVLCGEREEEARACHATHNRACRCRTGFFAHAGFCLEHASCPPGAGVIAPGTPSQNTQCQPCPPGTFSASSSSSEQCQPHRNCTALGLALNVPGSSSHDTLCTSCTGFPLSTRVPGAEECERAVIDFVAFQDISIKRLQRLLQALEAPEGWGPTPRAGRAALQLKLRRRLTELLGAQDGALLVRLLQALRVARMPGLERSVRERFLPVH

SEQ ID NO: 7944 - protein, 317 aa, unidentified; identical to SEQ ID NO: 5015

SEQ ID NO: 7945 - protein, 249 aa, unidentified
MAARRSQRRRGRRGEPGTALLVPLALGLGLALACLGLLLAVVSLGSRASLSAQEPAQEELVAEEDQDPSELNPQTEESQDPAPFLNRLVRPRRSAPKGRKTRARRAIAAHYEVHPRPGQDGAQAGVDGTVSGWEEARINSSSPLRYNRQIGEFIVTRAGLYYLYCQVHFDEGKAVYLKLDLLVDGVLALRCLEEFSATAASSLGPQLRLCQVSGLLALRPGSSLRIRTLPWAHLKAAPFLTYFGLFQVH

SEQ ID NO: 7946 - protein, 251 aa, unidentified
MAEDLGLSFGETASVEMLPEHGSCRPKARSSSARWALTCCLVLLPFLAGLTTYLLVSQLRAQGEACVQFQALKGQEFAPSHQQVYAPLRADGDKPRAHLTVVRQTPTQHFKNQFPALHWEHELGLAFTKNRMNYTNKFLLIPESGDYFIYSQVTFRGMTSECSEIRQAGRPNKPDSITVVITKVTDSYPEPTQLLMGTKSVCEVGSNWFQPIYLGAMFSLQEGDKLMVNVSDISLVDYTKEDKTFFGAFLL

SEQ ID NO: 7947 - protein, 1299 aa, unidentified
MSLQEMFRFPMGLLLGSVLLVASAPATLEPPGCSNKEQQVTVSHTYKIDVPKSALVQVDADPQPLSDDGASLLALGEAREEQNIIFRHNIRLQTPQKDCELAGSVQDLLARVKKLEEEMVEMKEQCSAQRCCQGVTDLSRHCSGHGTFSLETCSCHCEEGREGPACERLACPGACSGHGRCVDGRCLCHEPYVGADCGYPACPENCSGHGECVRGVCQCHEDFMSEDCSEKRCPGDCSGHGFCDTGECYCEEGFTGLDCAQVVTPQGLQLLKNTEDSLLVSWEPSSQVDHYLLSYYPLGKELSGKQIQVPKEQHSYEILGLLPGTKYIVTLRNVKNEVSSSPQHLLATTDLAVLGTAWVTDETENSLDVEWENPSTEVDYYKLRYGPMTGQEVAEVTVPKSSDPKSRYDITGLHPGTEYKITVVPMRGELEGKPILLNGRTEIDSPTNVVTDRVTEDTATVSWDPVQAVIDKYVVRYTSADGDTKEMAVHKDESSTVLTGLKPGEAYKVYVWAERGNQGSKKADTNALTEIDSPANLVTDRVTENTATISWDPVQATIDKYVVRYTSADDQETREVLVGKEQSSTVLTGLRPGVEYTVHVWAQKGDRESKKADTNAPTDIDSPKNLVTDRVTENMATVSWDPVQAAIDKYVVRYTSAGGETREVPVGKEQSSTVLTGLRPGMEYMVHVWAQKGDQESKKADTKAQTDIDSPQNLVTDRVTENMATVSWDPVRATIDRYVVRYTSAKDGETREVPVGKEQSSTVLTGLRPGVEYTVHVWAQKGAQESKKADTKAQTDIDSPQNLVTDWVTENTATVSWDPVQATIDRYVVHYTSANGETREVPVGKEQSSTVLTGLRPGMEYTVHVWAQKGNQESKKADTKAQTEIDGPKNLVTDWVTENMATVSWDPVQATIDKYMVRYTSADGETREVPVGKEHSSTVLTGLRPGMEYMVHVWAQKGAQESKKADTKAQTELDPPRNLRPSAVTQSGGILTWTPPSAQIHGYILTYQFPDGTVKEMQLGREDQRFALQGLEQGATYPVSLVAFKGGRRSRNVSTTLSTVGARFPHPSDCSQVQQNSNAASGLYTIYLHGDASRPLQVYCDMETDGGGWIVFQRRNTGQLDFFKRWRSYVEGFGDPMKEFWLGLDKLHNLTTGTPARYEVRVDLQTANESAYAIYDFFQVASSKERYKLTVGKYRGTAGDALTYHNGWKFTTFDRDNDIALSNCALTHHGGWWYKNCHLANPNGRYGETKHSEGVNWEPWKGHEFSIPYVELKIRPHGYSREPVLGRKKRTLRGRLRTF

SEQ ID NO: 7948 - protein, 1358 aa, unidentified
MGADGETVVLKNMLIGINLILLGSMIKPSECQLEVTTERVQRQSVEEEGGIANYNTSSKEQPVVFNHVYNINVPLDNLCSSGLEASAEQEVSAEDETLAEYMGQTSDHESQVTFTHRINFPKKACPCASSAQVLQELLSRIEMLEREVSVLRDQCNANCCQESAATGQLDYIPHCSGHGNFSFESCGCICNEGWFGKNCSEPYCPLGCSSRGVCVDGQCICDSEYSGDDCSELRCPTDCSSRGLCVDGECVCEEPYTGEDCRELRCPGDCSGKGRCANGTCLCEEGYVGEDCGQRQCLNACSGRGQCEEGLCVCEEGYQGPDCSAVAPPEDLRVAGISDRSIELEWDGPMAVTEYVISYQPTALGGLQLQQRVPGDWSGVTITELEPGLTYNISVYAVISNILSLPITAKVATHLSTPQGLQFKTITETTVEVQWEPFSFSFDGWEISFIPKNNEGGVIAQVPSDVTSFNQTGLKPGEEYIVNVVALKEQARSPPTSASVSTVIDGPTQILVRDVSDTVAFVEWIPPRAKVDFILLKYGLVGGEGGRTTFRLQPPLSQYSVQALRPGSRYEVSVSAVRGTNESDSATTQFTTEIDAPKNLRVGSRTATSLDLEWDNSEAEVQEYKVVYSTLAGEQYHEVLVPRGIGPTTRATLTDLVPGTEYGVGISAVMNSQQSVPATMNARTELDSPRDLMVTASSETSISLIWTKASGPIDHYRITFTPSSGIASEVTVPKDRTSYTLTDLEPGAEYIISVTAERGRQQSLESTVDAFTGFRPISHLHFSHVTSSSVNITWSDPSPPADRLILNYSPRDEEEEMMEVSLDATKRHAVLMGLQPATEYIVNLVAVHGTVTSEPIVGSITTGIDPPKDITISNVTKDSVMVSWSPPVASFDYYRVSYRPTQVGRLDSSVVPNTVTEFTITRLNPATEYEISLNSVRGREESERICTLVHTAMDNPVDLIATNITPTEALLQWKAPVGEVENYVIVLTHFAVAGETILVDGVSEEFRLVDLLPSTHYTATMYATNGPLTSGTISTNFSTLLDPPANLTASEVTRQSALISWQPPRAEIENYVLTYKSTDGSRKELIVDAEDTWIRLEGLLENTDYTVLLQAAQDTTWSSITSTAFTTGGRVFPHPQDCAQHLMNGDTLSGVYPIFLNGELSQKLQVYCDMTTDGGGWIVFQRRQNGQTDFFRKWADYRVGFGNVEDEFWLGLDNIHRITSQGRYELRVDMRDGQEAAFASYDRFSVEDSRNLYKLRIGSYNGTAGDSLSYHQGRPFSTEDRDNDVAVTNCAMSYKGAWWYKNCHRTNLNGKYGESRHSQGINWYHWKGHEFSIPFVEMKMRPYNHRLMAGRKRQSLQF

SEQ ID NO: 7949 - protein, 4244 aa, unidentified
MMPAQYALTSSLVLLVLLSTARAGPFSSRSNVTLPAPRPPPQPGGHTVGAGVGSPSSQLYEHTVEGGEKQVVFTHRINLPPSTGCGCPPGTEPPVLASEVQALRVRLEILEELVKGLKEQCTGGCCPASAQAGTGQTDVRTLCSLHGVFDLSRCTCSCEPGWGGPTCSDPTDAEIPPSSPPSASGSCPDDCNDQGRCVRGRCVCFPGYTGPSCGWPSCPGDCQGRGRCVQGVCVCRAGFSGPDCSQRSCPRGCSQRGRCEGGRCVCDPGYTGDDCGMRSCPRGCSQRGRCENGRCVCNPGYTGEDCGVRSCPRGCSQRGRCKDGRCVCDPGYTGEDCGTRSCPWDCGEGGRCVDGRCVCWPGYTGEDCSTRTCPRDCRGRGRCEDGECICDTGYSGDDCGVRSCPGDCNQRGRCEDGRCVCWPGYTGTDCGSRACPRDCRGRGRCENGVCVCNAGYSGEDCGVRSCPGDCRGRGRCESGRCMCWPGYTGRDCGTRACPGDCRGRGRCVDGRCVCNPGFTGEDCGSRRCPGDCRGHGLCEDGVCVCDAGYSGEDCSTRSCPGGCRGRGQCLDGRCVCEDGYSGEDCGVRQCPNDCSQHGVCQDGVCICWEGYVSEDCSIRTCPSNCHGRGRCEEGRCLCDPGYTGPTCATRMCPADCRGRGRCVQGVCLCHVGYGGEDCGQEEPPASACPGGCGPRELCRAGQCVCVEGFRGPDCAIQTCPGDCRGRGECHDGSCVCKDGYAGEDCGEEVPTIEGMRMHLLEETTVRTEWTPAPGPVDAYEIQFIPTTEGASPPFTARVPSSASAYDQRGLAPGQEYQVTVRALRGTSWGLPASKTITTMIDGPQDLRVVAVTPTTLELGWLRPQAEVDRFVVSYVSAGNQRVRLEVPPEADGTLLTDLMPGVEYVVTVTAERGRAVSYPASVRANTGSSPLGLLGTTDEPPPSGPSTTQGAQAPLLQQRPQELGELRVLGRDETGRLRVVWTAQPDTFAYFQLRMRVPEGPGAHEEVLPGDVRQALVPPPPPGTPYELSLHGVPPGGKPSDPIIYQGIMDKDEEKPGKSSGPPRLGELTVTDRTSDSLLLRWTVPEGEFDSFVIQYKDRDGQPQVVPVEGPQRSAVITSLDPGRKYKFVLYGFVGKKRHGPLVAEAKILPQSDPSPGTPPHLGNLWVTDPTPDSLHLSWTVPEGQFDTFMVQYRDRDGRPQVVPVEGPERSFVVSSLDPDHKYRFTLFGIANKKRYGPLTADGTTAPERKEEPPRPEFLEQPLLGELTVTGVTPDSLRLSWTVAQGPFDSFMVQYKDAQGQPQAVPVAGDENEVTVPGLDPDRKYKMNLYGLRGRQRVGPESVVAKTAPQEDVDETPSPTELGTEAPESPEEPLLGELTVTGSSPDSLSLFWTVPQGSFDSFTVQYKDRDGRPRAVRVGGKESEVTVGGLEPGHKYKMHLYGLHEGQRVGPVSAVGVTAPQQEETPPATESPLEPRLGELTVTDVTPNSVGLSWTVPEGQFDSFIVQYKDKDGQPQVVPVAADQREVTVYNLEPERKYKMNMYGLHDGQRMGPLSVVIVTAPLPPAPATEASKPPLEPRLGELTVTDITPDSVGLSWTVPEGEFDSFVVQYKDRDGQPQVVPVAADQREVTIPDLEPSRKYKFLLFGIQDGKRRSPVSVEAKTVARGDASPGAPPRLGELWVTDPTPDSLRLSWTVPEGQFDSFVVQFKDKDGPQVVPVEGHERSVTVTPLDAGRKYRFLLYGLLGKKRHGPLTADGTTEARSAMDDTGTKRPPKPRLGEELQVTTVTQNSVGLSWTVPEGQFDSFVVQYKDRDGQPQVVPVEGSLREVSVPGLDPAHRYKLLLYGLHHGKRVGPISAVAITAGREETETETTAPTPPAPEPHLGELTVEEATSHTLHLSWMVTEGEFDSFEIQYTDRDGQLQMVRIGGDRNDITLSGLESDHRYLVTLYGFSDGKHVGPVHVEALTVPEEEKPSEPPTATPEPPIKPRLGELTVTDATPDSLSLSWTVPEGQFDHFLVQYRNGDGQPKAVRVPGHEEGVTISGLEPDHKYKMNLYGFHGGQRMGPVSVVGVTAAEEETPSPTEPSMEAPEPAEEPLLGELTVTGSSPDSLSLSWTVPQGRFDSFTVQYKDRDGRPQVVRVGGEESEVTVGGLEPGRKYKMHLYGLHEGRRVGPVSAVGVTAPEEESPDAPLAKLRLGQMTVRDITSDSLSLSWTVPEGQFDHFLVQFKNGDGQPKAVRVPGHEDGVTISGLEPDHKYKMNLYGFHGGQRVGPVSAVGLTAPGKDEEMAPASTEPPTPEPPIKPRLEELTVTDATPDSLSLSWTVPEGQFDHFLVQYKNGDGQPKATRVPGHEDRVTISGLEPDNKYKMNLYGFHGGQRVGPVSAIGVTAAEEETPSPTEPSMEAPEPPEEPLLGELTVTGSSPDSLSLSWTVPQGRFDSFTVQYKDRDGRPQVVRVGGEESEVTVGGLEPGRKYKMHLYGLHEGRRVGPVSTVGVTAPQEDVDETPSPTEPGTEAPGPPEEPLLGELTVTGSSPDSLSLSWTVPQGRFDSFTVQYKDRDGRPQAVRVGGQESKVTVRGLEPGRKYKMHLYGLHEGRRLGPVSAVGVTEDEAETTQAVPTMTPEPPIKPRLGELTMTDATPDSLSLSWTVPEGQFDHFLVQYRNGDGQPKAVRVPGHEDGVTISGLEPDHKYKMNLYGFHGGQRVGPISVIGVTAAEEETPSPTELSTEAPEPPEEPLLGELTVTGSSPDSLSLSWTIPQGHFDSFTVQYKDRDGRPQVMRVRGEESEVTVGGLEPGRKYKMHLYGLHEGRRVGPVSTVGVTAPEDEAETTQAVPTTTPEPPNKPRLGELTVTDATPDSLSLSWMVPEGQFDHFLVQYRNGDGQPKVVRVPGHEDGVTISGLEPDHKYKMNLYGFHGGQRVGPISVIGVTAAEEETPAPTEPSTEAPEPPEEPLLGELTVTGSSPDSLSLSWTIPQGRFDSFTVQYKDRDGRPQVVRVRGEESEVTVGGLEPGCKYKMHLYGLHEGQRVGPVSAVGVTAPKDEAETTQAVPTMTPEPPIKPRLGELTVTDATPDSLSLSWMVPEGQFDHFLVQYRNGDGQPKAVRVPGHEDGVTISGLEPDHKYKMNLYGFHGGQRVGPVSAIGVTEEETPSPTEPSTEAPEAPEEPLLGELTVTGSSPDSLSLSWTVPQGRFDSFTVQYKDRDGQPQVVRVRGEESEVTVGGLEPGRKYKMHLYGLHEGQRVGPVSTVGITAPLPTPLPVEPRLGELAVAAVTSDSVGLSWTVAQGPFDSFLVQYRDAQGQPQAVPVSGDLRAVAVSGLDPARKYKFLLFGLQNGKRHGPVPVEARTAPDTKPSPRLGELTVTDATPDSVGLSWTVPEGEFDSFVVQYKDKDGRLQVVPVAANQREVTVQGLEPSRKYRFLLYGLSGRKRLGPISADSTTAPLEKELPPHLGELTVAEETSSSLRLSWTVAQGPFDSFVVQYRDTDGQPRAVPVAADQRTVTVEDLEPGKKYKFLLYGLLGGKRLGPVSALGMTAPEEDTPAPELAPEAPEPPEEPRLGVLTVTDTTPDSMRLSWSVAQGPFDSFVVQYEDTNGQPQALLVDGDQSKILISGLEPSTPYRFLLYGLHEGKRLGPLSAEGTTGLAPAGQTSEESRPRLSQLSVTDVTTSSLRLNWEAPPGAFDSFLLRFGVPSPSTLEPHPRPLLQRELMVPGTRHSAVLRDLRSGTLYSLTLYGLRGPHKADSIQGTARTLSPVLESPRDLQFSEIRETSAKVNWMPPPSRADSFKVSYQLADGGEPQSVQVDGQARTQKLQGLIPGARYEVTVVSVRGFEESEPLTGFLTTVPDGPTQLRALNLTEGFAVLHWKPPQNPVDTYDVQVTAPGAPPLQAETPGSAVDYPLHDLVLHTNYTATVRGLRGPNLTSPASITFTTGLEAPRDLEAKEVTPRTALLTWTEPPVRPAGYLLSFHTPGGQNQEILLPGGITSHQLLGLFPSTSYNARLQAMWGQSLLPPVSTSFTTGGLRIPFPRDCGEEMQNGAGASRTSTIFLNGNRERPLNVFCDMETDGGGWLVFQRRMDGQTDFWRDWEDYAHGFGNISGEFWLGNEALHSLTQAGDYSMRVDLRAGDEAVFAQYDSFHVDSAAEYYRLHLEGYHGTAGDSMSYHSGSVFSARDRDPNSLLISCAVSYRGAWWYRNCHYANLNGLYGSTVDHQGVSWYHWKGFEFSVPFTEMKLRPRNFRSPAGGG

SEQ ID NO: 7950 - protein, 1720 aa, unidentified
MAAAPSALLLLPPFPVLSTYRLQSRSRPSAPETDDSRVGGIMRGEKNYYFRGAAGDHGSCPTTTSPLASALLMPSEAVSSSWSESGGGLSGGDEEDTRLLQLLRTARDPSEAFQALQAALPRRGGRLGFPRRKEALYRALGRVLVEGGSDEKRLCLQLLSDVLRGQGEAGQLEEAFSLALLPQLVVSLREENPALRKDALQILHICLKRSPGEVLRTLIQQGLESTDARLRASTALLLPILLTTEDLLLGLDLTEVIISLARKLGDQETEEESETAFSALQQIGERLGQDRFQSYISRLPSALRRHYNRRLESQFGSQVPYYLELEASGFPEDPLPCAVTLSNSNLKFGIIPQELHSRLLDQEDYKNRTQAVEELKQVLGKFNPSSTPHSSLVGFISLLYNLLDDSNFKVVHGTLEVLHLLVIRLGEQVQQFLGPVIAASVKVLADNKLVIKQEYMKIFLKLMKEVGPQQVLCLLLEHLKHKHSRVREEVVNICICSLLTYPSEDFDLPKLSFDLAPALVDSKRRVRQAALEAFAVLASSMGSGKTSILFKAVDTVELQDNGDGVMNAVQARLARKTLPRLTEQGFVEYAVLMPSSAGGRSNHLAHGADTDWLLAGNRTQSAHCHCGDHVRDSMHIYGSYSPTICTRRVLSAGKGKNKLPWENEQPGIMGENQTSTSKDIEQFSTYDFIPSAKLKLSQGMPVNDDLCFSRKRVSRNLFQNSRDFNPDCLPLCAAGTTGTHQTNLSGKCAQLGFSQICGKTGSVGSDLQFLGTTSSHQEKVYASLNFGSKTQQTFGSQTECTSSNGQNPSPGAYILPSYPVSSPRTSPKHTSPLIISPKKSQDNSVNFSNSWPLKSFEGLSKPSPQKKLVSQKSSDPTGRNHGENSQEKPPVQLTPALVRSPSSRRGLNGTKPVPPIPRGISLLPDKADLSTVGHKKKEPDDIWKCEKDSLPIDLSELNFKDKDLDQEEMHSSLRSLRNSAAKKRAKLSGSTSDLESPDSAMKLDLTMDSPSLSSSPNINSYSESGVYSQESLTSSLSTTPQGKRIMSDIFPTFGSKPCPTRLSSAKKKISHIAEQSPSAGSSSNPQQISSFDFTTTKALSEDSVVVVGKGVFGSLSSAPATCSQSVISSVENGDTFSIKQSIEPPSGIYGRSVQQNISSYLDVENEKDAKVSISKSTYNKMRQKRKEEKELFHNKDCEKKEKNSWERMRHTGTEKMASESETPTGAISQYKERMPSVTHSPEIMDLSELRPFSKPEIALTEALRLLADEDWEKKIEGLNFIRCLAAFHSEILNTKLHETNFAVVQEVKNLRSGVSRAAVVCLSDLFTYLKKSMDQELDTTVKVLLHKAGESNTFIREDVDKALRAMVNNVTPARAVVSLINGGQRYYGRKMLFFMMCHPNFEKMLEKYVPSKDLPYIKDSVRNLQQKGLGEIPLDTPSAKGRRSHTGSVGNTRSSSVSRDAFNSAERAVTEVREVTRKSVPRNSLESAEYLKLITGLLNAKDFRDRINGIKQLLSDTENNQDLVVGNIVKIFDAFKSRLHDSNSKVNLVALETMHKMIPLLRDHLSPIINMLIPAIVDNNLNSKNPGIYAAATNVVQALSQHVDNYLLLQPFCTKAQFLNGKAKQDMTEKLADIVTELYQRKPHATEQKVLVVLWHLLGNMTNSGSLPGAGGNIRTATAKLSKALFAQMGQNLLNQAASQPPHIKKSLEELLDMTILNEL

SEQ ID NO: 7951 - protein, 55 aa, unidentified; identical to SEQ ID NO: 5025

SEQ ID NO: 7952 - protein, 332 aa, unidentified
MKLGRAVLGLLLLAPSVVQAVEPISLGLALAGVLTGYIYPRLYCLFAECCGQKRSLSREALQKDLDDNLFGQHLAKKIILNAVFGFINNPKPKKPLTLSLHGWTGTGKNFVSKIIAENIYEGGLNSDYVHLFVATLHFPHASNITLYKDQLQLWIRGNVSACARSIFIFDEMDKMHAGLIDAIKPFLDYYDLVDGVSYQKAMFIFLSNAGAERITDVALDFWRSGKQREDIKLKDIEHALSVSVFNNKNSGFWHSSLIDRNLIDYFVPFLPLEYKHLKMCIRVEMQSRGYEIDEDIVSRVAEEMTFFPKEERVFSDKGCKTVFTKLDYYYDD

SEQ ID NO: 7953 - protein, 336 aa, unidentified
MLRAGWLRGAAALALLLAARVVAAFEPITVGLAIGAASAITGYLSYNDIYCRFAECCREERPLNASALKLDLEEKLFGQHLATEVIFKALTGFRNNKNPKKPLTLSLHGWAGTGKNFVSQIVAENLHPKGLKSNFVHLFVSTLHFPHEQKIKLYQDQLQKWIRGNVSACANSVFIFDEMDKLHPGIIDAIKPFLDYYEQVDGVSYRKAIFIFLSNAGGDLITKTALDFWRAGRKREDIQLKDLEPVLSVGVFNNKHSGLWHSGLIDKNLIDYFIPFLPLEYRHVKMCVRAEMRARGSAIDEDIVTRVAEEMTFFPRDEKIYSDKGCKTVQSRLDFH

SEQ ID NO: 7954 - protein, 321 aa, unidentified
MAAATRGCRPWGSLLGLLGLVSAAAAAWDLASLRCTLGAFCECDFRPDLPGLECDLAQHLAGQHLAKALVVKALKAFVRDPAPTKPLVLSLHGWTGTGKSYVSSLLAHYLFQGGLRSPRVHHFSPVLHFPHPSHIERYKKDLKSWVQGNLTACGRSLFLFDEMDKMPPGLMEVLRPFLGSSWVVYGTNYRKAIFIFISNTGGKQINQVALEAWRSRRDREEILLQELEPVISRAVLDNPHHGFSNSGIMEERLLDAVVPFLPLQRHHVRHCVLNELAQLGLEPRDEVVQAVLDSTTFFPEDEQLFSSNGCKTVASRIAFFL

SEQ ID NO: 7955 - protein, 397 aa, unidentified
MLRGPWRQLWLFFLLLLPGAPEPRGASRPWEGTDEPGSAWAWPGFQRLQEQLRAAGALSKRYWTLFSCQVWPDDCDEDEEAATGPLGWRLPLLGQRYLDLLTTWYCSFKDCCPRGDCRISNNFTGLEWDLNVRLHGQHLVQQLVLRTVRGYLETPQPEKALALSFHGWSGTGKNFVARMLVENLYRDGLMSDCVRMFIATFHFPHPKYVDLYKEQLMSQIRETQQLCHQTLFIFDEAEKLHPGLLEVLGPHLERRAPEGHRAESPWTIFLFLSNLRGDIINEVVLKLLKAGWSREEITMEHLEPHLQAEIVETIDNGFGHSRLVKENLIDYFIPFLPLEYRHVRLCARDAFLSQELLYKEETLDEIAQMMVYVPKEEQLFSSQGCKSISQRINYFLS

SEQ ID NO: 7956 - protein, 224 aa, unidentified
MDCREMDLYEDYQSPFDFDAGVNKSYLYLSPSGNSSPPGSPTLQKFGLLRTDPVPEEGEDVAATISATETLSEEEQEELRRELAKVEEEIQTLSQVLAAKEKHLAEIKRKLGINSLQELKQNIAKGWQDVTATSAYKKTSETLSQAGQKASAAFSSVGSVITKKLEDVKNSPTFKSFEEKVENLKSKVGGTKPAGGDFGEVLNSAANASATTTEPLPEKTQESL

SEQ ID NO: 7957 - protein, 933 aa, unidentified; identical to SEQ ID NO: 5036

SEQ ID NO: 7958 - protein, 563 aa, unidentified
MGLQACLLGLFALILSGKCSYSPEPDQRRTLPPGWVSLGRADPEEELSLTFALRQQNVERLSELVQAVSDPSSPQYGKYLTLENVADLVRPSPLTLHTVQKWLLAAGAQKCHSVITQDFLTCWLSIRQAELLLPGAEFHHYVGGPTETHVVRSPHPYQLPQALAPHVDFVGGLHRFPPTSSLRQRPEPQVTGTVGLHLGVTPSVIRKRYNLTSQDVGSGTSNNSQACAQFLEQYFHDSDLAQFMRLFGGNFAHQASVARVVGQQGRGRAGIEASLDVQYLMSAGANISTWVYSSPGRHEGQEPFLQWLMLLSNESALPHVHTVSYGDDEDSLSSAYIQRVNTELMKAAARGLTLLFASGDSGAGCWSVSGRHQFRPTFPASSPYVTTVGGTSFQEPFLITNEIVDYISGGGFSNVFPRPSYQEEAVTKFLSSSPHLPPSSYFNASGRAYPDVAALSDGYWVVSNRVPIPWVSGTSASTPVFGGILSLINEHRILSGRPPLGFLNPRLYQQHGAGLFDVTRGCHESCLDEEVEGQGFCSGPGWDPVTGWGTPNFPALLKTLLNP

SEQ ID NO: 7959 - protein, 275 aa, unidentified
MLNLLLLALPVLASRAYAAPAPGQALQRVGIVGGQEAPRSKWPWQVSLRVHGPYWMHFCGGSLIHPQWVLTAAHCVGPDVKDLAALRVQLREQHLYYQDQLLPVSRIIVHPQFYTAQIGADIALLELEEPVNVSSHVHTVTLPPASETFPPGMPCWVTGWGDVDNDERLPPPFPLKQVKVPIMENHICDAKYHLGAYTGDDVRIVRDDMLCAGNTRRDSCQGDSGGPLVCKVNGTWLQAGVVSWGEGCAQPNRPGIYTRVTYYLDWIHHYVPKKP

SEQ ID NO: 7960 - protein, 242 aa, unidentified
MLLLAPQMLSLLLLALPVLASPAYVAPAPGQALQQTGIVGGQEAPRSKWPWQVSLRVRGPYWMHFCGGSLIHPQWVLTAAHCVEPDIKDLAALRVQLREQHLYYQDQLLPVSRIIVHPQFYIIQTGADIALLELEEPVNISSHIHTVTLPPASETFPPGMPCWVTGWGDVDNNVHLPPPYPLKEVEVPVVENHLCNAEYHTGLHTGHSFQIVRDDMLCAGSENHDSCQGDSGGPLVCKVNGT

SEQ ID NO: 7961 - protein, 370 aa, unidentified
MVGKLKQNLLLACLVISSVTVFYLGQHAMECHHRIEERSQPVKLESTRTTVRTGLDLKANKTFAYHKDMPLIFIGGVPRSGTTLMRAMLDAHPDIRCGEETRVIPRILALKQMWSRSSKEKIRLDEAGVTDEVLDSAMQAFLLEIIVKHGEPAPYLCNKDPFALKSLTYLSRLFPNAKFLLMVRDGRASVHSMISRKVTIAGFDLNSYRDCLTKWNRAIETMYNQCMEVGYKKCMLVHYEQLVLHPERWMRTLLKFLQIPWNHSVLHHEEMIGKAGGVSLSKVERSTDQVIKPVNVGALSKWVGKIPPDVLQDMAVIAPMLAKLGYDPYANPPNYGKPDPKIIENTRRVYKGEFQLPDFLKEKPQTEQVE

SEQ ID NO: 7962 - protein, 377 aa, unidentified
MRLSVRRVLLAAGCALVLVLAVQLGQQVLECRAVLAGLRSPRGAMRPEQEELVMVGTNHVEYRYGKAMPLIFVGGVPRSGTTLMRAMLDAHPEVRCGEETRIIPRVLAMRQAWSKSGREKLRLDEAGVTDEVLDAAMQAFILEVIAKHGEPARVLCNKDPFTLKSSVYLSRLFPNSKFLLMVRDGRASVHSMITRKVTIAGFDLSSYRDCLTKWNKAIEVMYAQCMEVGKEKCLPVYYEQLVLHPRRSLKLILDFLGIAWSDAVLHHEDLIGKPGGVSLSKIERSTDQVIKPVNLEALSKWTGHIPGDVVRDMAQIAPMLAQLGYDPYANPPNYGNPDPFVINNTQRVLKGDYKTPANLKGYFQVNQNSTSSHLGSS

SEQ ID NO: 7963 - protein, 505 aa, unidentified; identical to SEQ ID NO: 5041

SEQ ID NO: 7964 - protein, 517 aa, unidentified
MHAALAGPLLAALLATARARPQPPDGGQCRPPGSQRDLNSFLWTIRRDPPAYLFGTIHVPYTRVWDFIPDNSKAAFQASTRVYFELDLTDPYTISALASCQLLPHGENLQDVLPHELYWRLKRHLDYVKLMMPSWMTPAQRGKGLYADYLFNAIAGNWERKRPVWVMLMVNSLTERDVRFRGVPVLDLYLAQQAEKMKKTTGAVEQVEEQCHPLNNGLNFSQVLFALNQTLLQQESVRAGSLQASYTTEDLIKHYNCGDLSAVIFNHDTSQLPNFINTTLPPHEQVTAQEIDSYFRQELIYKRNERMGKRVMALLRENEDKICFFAFGAGHFLGNNTVIDILRQAGLEVDHTPAGQAIHSPAPQSPAPSPEGTSTSPAPVTPAAAVPEAPSVTPTAPPEDEDPALSPHLLLPDSLSQLEEFGRQRKWHKRQSTHQRPRQFNDLWVRIEDSTTASPPPLPLQPTHSSGTAKPPFQLSDQLQQQDPPGPASSSAPTLGLLPAIATTIAVCFLLHSLGPS

SEQ ID NO: 7965 - protein, 583 aa, unidentified
MPGRTWELCLLLLLGLGLGSQEALPPPCESEIYCHGELLNQVQMAKLYQDDKQFVDMPLSIAPEQVLQTFTELSRDHNHSIPREQLQAFVHEHFQAKGQELQPWTPADWKDSPQFLQKISDAKLRAWAGQLHQLWKKLGKKMKPEVLSHPERFSLIYSEHPFIVPGGRFVEFYYWDSYWVMEGLLLSEMAETVKGMLQNFLDLVKTYGHVPNGGRVYYLQRSQPPLLTLMMDCYLTHTNDTAFLQENIETLALELDFWTKNRTVSVSLEGKNYLLNRYYVPYGGPRPESYSKDVELADTLPEGDREALWAELKAGAESGWDFSSRWLIGGPNPNSLSGIRTSKLVPVDLNAFLCQAEELMSNFYSRLGNDSQATKYRILRSQRLAALNTVLWDEQTGAWFDYDLEKKKKNREFYPSNLTPLWAGCFSDPGVADKALKYLEDNRILTYQYGIPTSLQKTGQQWDFPNAWAPLQDLVIRGLAKAPLRRAQEVAFQLAQNWIRTNFDVYSQKSAMYEKYDVSNGGQPGGGGEYEVQEGFGWTNGVVLMLLDRYGDRLTSGAKLAFLEPHCLAATLLPSLLLSLLPW

SEQ ID NO: 7966 - protein, 234 aa, unidentified; identical to SEQ ID NO: 5048

SEQ ID NO: 7967 - protein, 230 aa, unidentified; identical to SEQ ID NO: 5049

SEQ ID NO: 7968 - protein, 242 aa, unidentified
MPGPWLLLALALTLNLTGVPGGRAQPEAAQQEAVTAAEHPGLDDFLRQVERLLFLRENIQRLQGDQGEHSASQIFQSDWLSKRQHPGKREEEEEEGVEEEEEEEGGAVGPHKRQHPGRREDEASWSVDVTQHKRQHPGRRSPWLAYAVPKRQHPGRRLADPKAQRSWEEEEEEEEREEDLMPEKRQHPGKRALGGPCGPQGAYGQAGLLLGLLDDLSRSQGAEEKRQHPGRRAAWVREPLEE

SEQ ID NO: 7969 - protein, 1050 aa, unidentified
MEVAVEKAVAAAAAASAAASGGPSAAPSGENEAESRQGPDSERGGEAARLNLLDTCAVCHQNIQSRAPKLLPCLHSFCQRCLPAPQRYLMLPAPMLGSAETPPPVPAPGSPVSGSSPFATQVGVIRCPVCSQECAERHIIDNFFVKDTTEVPSSTVEKSNQVCTSCEDNAEANGFCVECVEWLCKTCIRAHQRVKFTKDHTVRQKEEVSPEAVGVTSQRPVFCPFHKKEQLKLYCETCDKLTCRDCQLLEHKEHRYQFIEEAFQNQKVIIDTLITKLMEKTKYIKFTGNQIQNRIIEVNQNQKQVEQDIKVAIFTLMVEINKKGKALLHQLESLAKDHRMKLMQQQQEVAGLSKQLEHVMHFSKWAVSSGSSTALLYSKRLITYRLRHLLRARCDASPVTNNTIQFHCDPSFWAQNIINLGSLVIEDKESQPQMPKQNPVVEQNSQPPSGLSSNQLSKFPTQISLAQLRLQHMQQQVMAQRQQVQRRPAPVGLPNPRMQGPIQQPSISHQQPPPRLINFQNHSPKPNGPVLPPHPQQLRYPPNQNIPRQAIKPNPLQMAFLAQQAIKQWQISSGQGTPSTTNSTSSTPSSPTITSAAGYDGKAFGSPMIDLSSPVGGSYNLPSLPDIDCSSTIMLDNIVRKDTNIDHGQPRPPSNRTVQSPNSSVPSPGLAGPVTMTSVHPPIRSPSASSVGSRGSSGSSSKPAGADSTHKVPVVMLEPIRIKQENSGPPENYDFPVVIVKQESDEESRPQNANYPRSILTSLLLNSSQSSTSEETVLRSDAPDSTGDQPGLHQDNSSNGKSEWLDPSQKSPLHVGETRKEDDPNEDWCAVCQNGGELLCCEKCPKVFHLSCHVPTLTNFPSGEWICTFCRDLSKPEVEYDCDAPSHNSEKKKTEGLVKLTPIDKRKCERLLLFLYCHEMSLAFQDPVPLTVPDYYKIIKNPMDLSTIKKRLQEDYSMYSKPEDFVADFRLIFQNCAEFNEPDSEVANAGIKLENYFEELLKNLYPEKRFPKPEFRNESEDNKFSDDSDDDFVQPRKKRLKSIEERQLLK

SEQ ID NO: 7970 - protein, 835 aa, unidentified
MAASAAAASAAAASAASGSPGPGEGSAGGEKRSTAPSAAASASASAAASSPAGGGAEALELLEHCGVCRERLRPEREPRLLPCLHSACSACLGPAAPAAANSSGDGGAAGDGTVVDCPVCKQQCFSKDIVENYFMRDSGSKAATDAQDANQCCTSCEDNAPATSYCVECSEPLCETCVEAHQRVKYTKDHTVRSTGPAKSRDGERTVYCNVHKHEPLVLFCESCDTLTCRDCQLNAHKDHQYQFLEDAVRNQRKLLASLVKRLGDKHATLQKSTKEVRSSIRQVSDVQKRVQVDVKMAILQIMKELNKRGRVLVNDAQKVTEGQQERLERQHWTMTKIQKHQEHILRFASWALESDNNTALLLSKKLIYFQLHRALKMIVDPVEPHGEMKFQWDLNAWTKSAEAFGKIVAERPGTNSTGPAPMAPPRAPGPLSKQGSGSSQPMEVQEGYGFGSGDDPYSSAEPHVSGVKRSRSGEGEVSGLMRKVPRVSLERLDLDLTADSQPPVFKVFPGSTTEDYNLIVIERGAAAAATGQPGTAPAGTPGAPPLAGMAIVKEEETEAAIGAPPTATEGPETKPVLMALAEGPGAEGPRLASPSGSTSSGLEVVAPEGTSAPGGGPGTLDDSATICRVCQKPGDLVMCNQCEFCFHLDCHLPALQDVPGEEWSCSLCHVLPDLKEEDGSLSLDGADSTGVVAKLSPANQRKCERVLLALFCHEPCRPLHQLATDSTFSLDQPGGTLDLTLIRARLQEKLSPPYSSPQEFAQDVGRMFKQFNKLTEDKADVQSIIGLQRFFETRMNEAFGDTKFSAVLVEPPPMSLPGAGLSSQELSGGPGDGP

SEQ ID NO: 7971 - protein, 3097 aa, unidentified
MSGSSGGAAAPAASSGPAAAASAAGSGCGGGAGEGAEEAAKDLADIAAFFRSGFRKNDEMKAMDVLPILKEKVAYLSGGRDKRGGPILTFPARSNHDRIRQEDLRRLISYLACIPSEEVCKRGFTVIVDMRGSKWDSIKPLLKILQESFPCCIHVALIIKPDNFWQKQRTNFGSSKFEFETNMVSLEGLTKVVDPSQLTPEFDGCLEYNHEEWIEIRVAFEDYISNATHMLSRLEELQDILAKKELPQDLEGARNMIEEHSQLKKKVIKAPIEDLDLEGQKLLQRIQSSESFPKKNSGSGNADLQNLLPKVSTMLDRLHSTRQHLHQMWHVRKLKLDQCFQLRLFEQDAEKMFDWITHNKGLFLNSYTEIGTSHPHAMELQTQHNHFAMNCMNVYVNINRIMSVANRLVESGHYASQQIRQIASQLEQEWKAFAAALDERSTLLDMSSIFHQKAEKYMSNVDSWCKACGEVDLPSELQDLEDAIHHHQGIYEHITLAYSEVSQDGKSLLDKLQRPLTPGSSDSLTASANYSKAVHHVLDVIHEVLHHQRQLENIWQHRKVRLHQRLQLCVFQQDVQQVLDWIENHGEAFLSKHTGVGKSLHRARALQKRHEDFEEVAQNTYTNADKLLEAAEQLAQTGECDPEEIYQAAHQLEDRIQDFVRRVEQRKILLDMSVSFHTHVKELWTWLEELQKELLDDVYAESVEAVQDLIKRFGQQQQTTLQVTVNVIKEGEDLIQQLRDSAISSNKTPHNSSINHIETVLQQLDEAQSQMEELFQERKIKLELFLQLRIFERDAIDIISDLESWNDELSQQMNDFDTEDLTIAEQRLQHHADKALTMNNLTFDVIHQGQDLLQYVNEVQASGVELLCDRDVDMATRVQDLLEFLHEKQQELDLAAEQHRKHLEQCVQLRHLQAEVKQVLGWIRNGESMLNAGLITASSLQEAEQLQREHEQFQHAIEKTHQSALQVQQKAEAMLQANHYDMDMIRDCAEKVASHWQQLMLKMEDRLKLVNASVAFYKTSEQVCSVLESLEQEYKREEDWCGGADKLGPNSETDHVTPMISKHLEQKEAFLKACTLARRNADVFLKYLHRNSVNMPGMVTHIKAPEQQVKNILNELFQRENRVLHYWTMRKRRLDQCQQYVVFERSAKQALEWIHDNGEFYLSTHTSTGSSIQHTQELLKEHEEFQITAKQTKERVKLLIQLADGFCEKGHAHAAEIKKCVTAVDKRYRDFSLRMEKYRTSLEKALGISSDSNKSSKSLQLDIIPASIPGSEVKLRDAAHELNEEKRKSARRKEFIMAELIQTEKAYVRDLRECMDTYLWEMTSGVEEIPPGIVNKELIIFGNMQEIYEFHNNIFLKELEKYEQLPEDVGHCFVTWADKFQMYVTYCKNKPDSTQLILEHAGSYFDEIQQRHGLANSISSYLIKPVQRITKYQLLLKELLTCCEEGKGEIKDGLEVMLSVPKRANDAMHLSMLEGFDENIESQGELILQESFQVWDPKTLIRKGRERHLFLFEMSLVFSKEVKDSSGRSKYLYKSKLFTSELGVTEHVEGDPCKFALWVGRTPTSDNKIVLKASSIENKQDWIKHIREVIQERTIHLKGALKEPIHIPKTAPATRQKGRRDGEDLDSQGDGSSQPDTISIASRTSQNTLDSDKLSGGCELTVVIHDFTACNSNELTIRRGQTVEVLERPHDKPDWCLVRTTDRSPAAEGLVPCGSLCIAHSRSSMEMEGIFNHKDSLSVSSNDASPPASVASLQPHMIGAQSSPGPKRPGNTLRKWLTSPVRRLSSGKADGHVKKLAHKHKKSREVRKSADAGSQKDSDDSAATPQDETVEERGRNEGLSSGTLSKSSSSGMQSCGEEEGEEGADAVPLPPPMAIQQHSLLQPDSQDDKASSRLLVRPTSSETPSAAELVSAIEELVKSKMALEDRPSSLLVDQGDSSSPSFNPSDNSLLSSSSPIDEMEERKSSSLKRRHYVLQELVETERDYVRDLGYVVEGYMALMKEDGVPDDMKGKDKIVFGNIHQIYDWHRDFFLGELEKCLEDPEKLGSLFVKHERRLHMYIAYCQNKPKSEHIVSEYIDTFFEDLKQRLGHRLQLTDLLIKPVQRIMKYQLLLKDFLKYSKKASLDTSELERAVEVMCIVPRRCNDMMNVGRLQGFDGKIVAQGKLLLQDTFLVTDQDAGLLPRCRERRIFLFEQIVIFSEPLDKKKGFSMPGFLFKNSIKVSCLCLEENVENDPCKFALTSRTGDVVETFILHSSSPSVRQTWIHEINQILENQRNFLNALTSPIEYQRNHSGGGGGGGSGGSGGGGGSGGGGAPSGGSGHSGGPSSCGGAPSTSRSRPSRIPQPVRHHPPVLVSSAASSQAEADKMSGTSTPGPSLPPPGAAPEAGPSAPSRRPPGADAEGSEREAEPIPKMKVLESPRKGAANASGSSPDAPAKDARASLGTLPLGKPRAGAASPLNSPLSSAVPSLGKEPFPPSSPLQKGGSFWSSIPASPASRPGSFTFPGDSDSLQRQTPRHAAPGKDTDRMSTCSSASEQSVQSTQSNGSESSSSSNISTMLVTHDYTAVKEDEINVYQGEVVQILASNQQNMFLVFRAATDQCPAAEGWIPGFVLGHTSAVIVENPDGTLKKSTSWHTALRLRKKSEKKDKDGKREGKLENGYRKSREGLSNKVSVKLLNPNYIYDVPPEFVIPLSEVTCETGETVVLRCRVCGRPKASITWKGPEHNTLNNDGHYSISYSDLGEATLKIVGVTTEDDGIYTCIAVNDMGSASSSASLRVLGPGMDGIMVTWKDNFDSFYSEVAELGRGRFSVVKKCDQKGTKRAVATKFVNKKLMKRDQVTHELGILQSLQHPLLVGLLDTFETPTSYILVLEMADQGRLLDCVVRWGSLTEGKIRAHLGEVLEAVRYLHNCRIAHLDLKPENILVDESLAKPTIKLADFGDAVQLNTTYYIHQLLGNPEFAAPEIILGNPVSLTSDTWSVGVLTYVLLSGVSPFLDDSVEETCLNICRLDFSFPDDYFKGVSQKAKEFVCFLLQEDPAKRPSAALALQEQWLQAGNGRSTGVLDTSRLTSFIERRKHQNDVRPIRSIKNFLQSRLLPRV

SEQ ID NO: 7972 - protein, 227 aa, unidentified
MPGCRISACGPGAQEGTAEQRSPPPPWDPMPSSQPPPPTPTLTPTPTPGQSPPLPDAAGASAGAAEDQELQRWRQGASGIAGLAGPGGGSGAAAGAGGRALELAEARRRLLEVEGRRRLVSELESRVLQLHRVFLAAELRLAHRAESLSRLSGGVAQAELYLAAHGSRLKKGPRRGRRGRPPALLASALGLGGCVPWGAGRLRRGHGPEPDSPFRRSPPRGPASPQR

SEQ ID NO: 7973 - protein, 395 aa, unidentified
MSGGKKKSSFQITSVTTDYEGPGSPGASDPPTPQPPTGPPPRLPNGEPSPDPGGKGTPRNGSPPPGAPSSRFRVVKLPHGLGEPYRRGRWTCVDVYERDLEPHSFGGLLEGIRGASGGAGGRSLDSRLELASLGLGAPTPPSGLSQGPTSWLRPPPTSPGPQARSFTGGLGQLVVPSKAKAEKPPLSASSPQQRPPEPETGESAGTSRAATPLPSLRVEAEAGGSGARTPPLSRRKAVDMRLRMELGAPEEMGQVPPLDSRPSSPALYFTHDASLVHKSPDPFGAVAAQKFSLAHSMLAISGHLDSDDDSGSGSLVGIDNKIEQAMDLVKSHLMFAVREEVEVLKEQIRELAERNAALEQENGLLRALASPEQLAQLPSSGVPRLGPPAPNGPSV

SEQ ID NO: 7974 - protein, 138 aa, unidentified
MTALFLMSMLFGLTCGQAMSFCIPTEYTMHIERRECAYCLTINTTICAGYCMTRDINGKLFLPKYALSQDVCTYRDFIYRTVEIPGCPLHVAPYFSYPVALSCKCGKCNTDYSDCIHEAIKTNYCTKPQKSYLVGFSV

SEQ ID NO: 7975 - protein, 764 aa, unidentified; identical to SEQ ID NO: 5085

SEQ ID NO: 7976 - protein, 353 aa, unidentified
MPWPLLLLLAVSGAQTTRPCFPGCQCEVETFGLFDSFSLTRVDCSGLGPHIMPVPIPLDTAHLDLSSNRLEMVNESVLAGPGYTTLAGLDLSHNLLTSISPTAFSRLRYLESLDLSHNGLTALPAESFTSSPLSDVNLSHNQLREVSVSAFTTHSQGRALHVDLSHNLIHRLVPHPTRAGLPAPTIQSLNLAWNRLHAVPNLRDLPLRYLSLDGNPLAVIGPGAFAGLGGLTHLSLASLQRLPELAPSGFRELPGLQVLDLSGNPKLNWAGAEVFSGLSSLQELDLSGTNLVPLPEALLLHLPALQSVSVGQDVRCRRLVREGTYPRRPGSSPKVALHCVDTRDSAARGPTIL

SEQ ID NO: 7977 - protein, 253 aa, unidentified; identical to SEQ ID NO: 5100

SEQ ID NO: 7978 - protein, 210 aa, unidentified; identical to SEQ ID NO: 5101

SEQ ID NO: 7979 - protein, 669 aa, unidentified
MSALLSLCFVLPLAAPGHGTQGWEPCTDLRPLDILAEVVPSDGATSGIRIVQVHGARGLQLSVAAPRTMSFPASRIFSQCDLFPEEFSIVVTLRVPNLPPKRNEYLLTVVAEESDLLLLGLRLSPAQLHFLFLREDTAGAWQTRVSFRSPALVDGRWHTLVLAVSAGVFSLTTDCGLPVDIMADVPFPATLSVKGARFFVGSRRRAKGLFMGLVRQLVLLPGSDATPRLCPSRNAPLAVLSIPRVLQALTGKPEDNEVLKYPYETNIRVTLGPQPPCTEVEDAQFWFDASRKGLYLCVGNEWVSVLAAKERLDYVEEHQNLSTNSETLGIEVFRIPQVGLFVATANRKATSAVYKWTEEKFVSYQNIPTHQAQAWRHFTIGKKIFLAVANFEPDEKGQEFSVIYKWSHRKLKFTPYQSIATHSARDWEAFEVDGEHFLAVANHREGDNHNIDSVIYKWNPATRLFEANQTIATSGAYDWEFFSVGPYSFLVVANTFNGTSTKVHSHLYIRLLGSFQLFQSFPTFGAADWEVFQIGERIFLAVANSHSYDVEMQVQNDSYVINSVIYELNVTAQAFVKFQDILTCSALDWEFFSVGEDYFLVVANSFDGRTFSVNSIIYRWQGYEGFVAVHSLPTVGCRDWEAFSTTAGAYLIYSSAKEPLSRVLRLRTR

SEQ ID NO: 7980 - protein, 860 aa, unidentified; identical to SEQ ID NO: 5115

SEQ ID NO: 7981 - protein, 380 aa, unidentified
MFRLLSWSLGRGFLRAAGRRCRGCSARLLPGLAGGPGPEVQVPPSRVAPHGRGPGLLPLLAALAWFSRPAAAEEEEQQGADGAAAEDGADEAEAEIIQLLKRAKLSIMKDEPEEAELILHDALRLAYQTDNKKAITYTYDLMANLAFIRGQLENAEQLFKATMSYLLGGGMKQEDNAIIEISLKLASIYAAQNRQEFAVAGYEFCISTLEEKIEREKELAEDIMSVEEKANTHLLLGMCLDACARYLLFSKQPSQAQRMYEKALQISEEIQGERHPQTIVLMSDLATTLDAQGRFDEAYIYMQRASDLARQINHPELHMVLSNLAAVLMHRERYTQAKEIYQEALKQAKLKKDEISVQHIREELAELSKKSRPLTNSVKL

SEQ ID NO: 7982 - protein, 239 aa, unidentified
MQRGALSPVLMLSAAPEPPPRPPPALSPPGSGPGSGSRHGSARPGPTPEPSGSLGAALDSSLRAAVAFKAEGQRCYREKKFREAIGKYHRALLQLKAAQGARPSGLPAPAPGPTSSPGPARLSEEQRRLVESTEVECYDSLTACLLQSELVNYERVREYCLKVLEKQQGNFKATYRAGIAFYHLGDYARALRYLQEARSREPTDTNVLRYIQLTQLKMNRCSLQREDSGAGSQTRDVIG

SEQ ID NO: 7983 - protein, 800 aa, unidentified
MAAAASVTGRVTWAASPMRSLGLGRRLSLPGPRLDAVTAAVNPSLSDHGNGLGRGTRGSGCSGGSLVADWGGGAAAAAAVALALAPALSTMRRGSSESELAARWEAEAVAAAKAAAKAEAEATAETVAEQVRVDAGAAGEPECKAGEEQPKVLAPAPAQPSAAEEGNTQVLQRPPPTLPPSKPKPVQGLCPHGKPRDKGRSCKRSSGHGSGENGSQRPVTVDSSKARTSLDALKISIRQLKWKEFPFGRRLPCDIYWHGVSFHDNDIFSGQVNKFPGMTEMVRKITLSRAVRTMQNLFPEEYNFYPRSWILPDEFQLFVAQVQMVKDDDPSWKPTFIVKPDGGCQGDGIYLIKDPSDIRLAGTLQSRPAVVQEYICKPLLIDKLKFDIRLYVLLKSLDPLEIYIAKDGLSRFCTEPYQEPTPKNLHRIFMHLTNYSLNIHSGNFIHSDSASTGSKRTFSSILCRLSSKGVDIKKVWSDIISVVIKTVIALTPELKVFYQSDIPTGRPGPTCFQILGFDILLMKNLKPILLEVNANPSMRIEHEHELSPGVFENVPSLVDEEVKVAVIRDTLRLMDPLKKKRENQSQQLEKPFAGKEDALDGELTSAPDCNANPEAHLPSICLKQVFPKYAKQFNYLRLVDRMANLFIRFLGIKGTMKLGPTGFRTFIRSCKLSSSSLSMAAVDILYIDITRRWNSMTLDQRDSGMCLQAFVEAFFFLAQRKFKMLPLHEQVASLIDLCEYHLSLLDEKRLVCGRGVPSGGRPPHRGPPQEPSPSAQPAGDNPPPRTSCANKLSHPRHTLS

SEQ ID NO: 7984 - protein, 147 aa, unidentified
MASHRLLLLCLAGLVFVSEAGPTGTGESKCPLMVKVLDAVRGSPAINVAVHVFRKAADDTWEPFASGKTSESGELHGLTTEEEFVEGIYKVEIDTKSYWKALGISPFHEHAEVVFTANDSGPRRYTIAALLSPYSYSTTAVVTNPKE

SEQ ID NO: 7985 - protein, 223 aa, unidentified
MKLHYVAVLTLAILMFLTWLPESLSCNKALCASDVSKCLIQELCQCRPGEGNCSCCKECMLCLGALWDECCDCVGMCNPRNYSDTPPTSKSTVEELHEPIPSLFRALTEGDTQLNWNIVSFPVAEELSHHENLVSFLETVNQPHHQNVSVPSNNVHAPYSSDKEHMCTVVYFDDCMSIHQCKISCESMGASKYRWFHNACCECIGPECIDYGSKTVKCMNCMF

SEQ ID NO: 7986 - protein, 172 aa, unidentified
METRPRLGATCLLGFSFLLLVISSDGHNGLGKGFGDHIHWRTLEDGKKEAAASGLPLMVIIHKSWCGACKALKPKFAESTEISELSHNFVMVNLEDEEEPKDEDFSPDGGYIPRILFLDPSGKVHPEIINENGNPSYKYFYVSAEQVVQGMKEAQERLTGDAFRKKHLEDEL

SEQ ID NO: 7987 - protein, 360 aa, unidentified; identical to SEQ ID NO: 5136

SEQ ID NO: 7988 - protein, 432 aa, unidentified
MPARPGRLLPLLARPAALTALLLLLLGHGGGGRWGARAQEAAAAAADGPPAADGEDGQDPHSKHLYTADMFTHGIQSAAHFVMFFAPWCGHCQRLQPTWNDLGDKYNSMEDAKVYVAKVDCTAHSDVCSAQGVRGYPTLKLFKPGQEAVKYQGPRDFQTLENWMLQTLNEEPVTPEPEVEPPSAPELKQGLYELSASNFELHVAQGDHFIKFFAPWCGHCKALAPTWEQLALGLEHSETVKIGKVDCTQHYELCSGNQVRGYPTLLWFRDGKKVDQYKGKRDLESLREYVESQLQRTETGATETVTPSEAPVLAAEPEADKGTVLALTENNFDDTIAEGITFIKFYAPWCGHCKTLAPTWEELSKKEFPGLAGVKIAEVDCTAERNICSKYSVRGYPTLLLFRGGKKVSEHSGGRDLDSLHRFVLSQAKDEL

SEQ ID NO: 7989 - protein, 524 aa, unidentified
MAAMAVALRGLGGRFRWRTQAVAGGVRGAARGAAAGQRDYDLLVVGGGSGGLACAKEAAQLGRKVAVVDYVEPSPQGTRWGLGGTCVNVGCIPKKLMHQAALLGGLIQDAPNYGWEVAQPVPHDWRKMAEAVQNHVKSLNWGHRVQLQDRKVKYFNIKASFVDEHTVCGVAKGGKEILLSADHIIIATGGRPRYPTHIEGALEYGITSDDIFWLKESPGKTLVVGASYVALECAGFLTGIGLDTTIMMRSIPLRGFDQQMSSMVIEHMASHGTRFLRGCAPSRVRRLPDGQLQVTWEDSTTGKEDTGTFDTVLWAIGRVPDTRSLNLEKAGVDTSPDTQKILVDSREATSVPHIYAIGDVVEGRPELTPIAIMAGRLLVQRLFGGSSDLMDYDNVPTTVFTPLEYGCVGLSEEEAVARHGQEHVEVYHAHYKPLEFTVAGRDASQCYVKMVCLREPPQLVLGLHFLGPNAGEVTQGFALGIKCGASYAQVMRTVGIHPTCSEEVVKLRISKRSGLDPTVTGCUG

SEQ ID NO: 7990 - protein, 537 aa, unidentified; identical to SEQ ID NO: 5141

SEQ ID NO: 7991 - protein, 344 aa, unidentified; identical to SEQ ID NO: 5147

SEQ ID NO: 7992 - protein, 177 aa, unidentified
MSVNMDELKHQVMINQFVLTAGCAADQAKQLLQAAHWQFETALSAFFQETNIPYSHHHHQMMCTPANTPATPPNFPDALTMFSRLKASESFHSGGSGSPMAATATSPPPHFPHAATSSSAASSWPTAASPPGGPQHHQPQPPLWTPTPPSPASDWPPLAPQQATSEPRAHPAMEAER

SEQ ID NO: 7993 - protein, 1119 aa, unidentified
MMTSVSSDHCRGAREKPQISAAQSTQPQKQVVQATAEQMRLAQVIFDKNDSDFEAKVKQLMEVTGKNQDECIVALHDCNGDVNKAINILLEGNSDTTSWETVGCKKKNFAKENSENKENREKKSEKESSRGRGNNNRKGRGGNRGREFRGEENGIDCNQVDKPSDRGKRARGRGFGRGRGRGAGRFSTQGMGTFNPADYSDSTSTDVCGTKLVVWEAAQNGADEGTELASNTHNIAQDLSNKSSYGLKGAWKNSVEEWTTEDWTEDLSETKVFTASSAPAENHILPGQSIDLVALLQKPVPHSQASEANSFETSQQQGFGQALVFTNSQHNNQMAPGTGSSTAVNSCSPQSLSSVLGSGFGELAPPKMANITSSQILDQLKAPSLGQFTTTPSTQQNSTSHPTTTTSWDLKPPTSQSSVLSHLDFKSQPEPSPVLSQLSQRQQHQSQAVTVPPPGLESFPSQAKLRESTPGDSPSTVNKLLQLPSTTIENISVSVHQPQPKHIKLAKRRIPPASKIPASAVEMPGSADVTGLNVQFGALEFGSEPSLSEFGSAPSSENSNQIPISLYSKSLSEPLNTSLSMTSAVQNSTYTTSVITSCSLTSSSLNSASPVAMSSSYDQSSVHNRIPYQSPVSSSESAPGTIMNGHGGGRSQQTLDTPKTTGPPSALPSVSSLPSTTSCTALLPSTSQHTGDLTSSPLSQLSSSLSSHQSSLSAHAALSSSTSHTHASVESASSHQSSATFSTAATSVSSSASSGASLSSSMNTANSLCLGGTPASASSSSSRAAPLVTSGKAPPNLPQGVPPLLHNQYLVGPGGLLPAYPIYGYDELQMLQSRLPVDYYGIPFAAPTALASRDGSLANNPYPGDVTKFGRGDSASPAPATTPAQPQQSQSQTHHTAQQPFVNPALPPGYSYTGLPYYTGMPSAFQYGPTMFVPPASAKQHGVNLSTPTPPFQQASGYGQHGYSTGYDDLTQGTAAGDYSKGGYAGSSQAPNKSAGSGPGKGVSVSSSTTGLPDMTGSVYNKTQTFDKQGFHAGTPPPFSLPSVLGSTGPLASGAAPGYAPPPFLHILPAHQQPHSQLLHHHLPQDAQSGSGQRSQPSSLQPKSQASKPAYGNSPYWTN

SEQ ID NO: 7994 - protein, 1888 aa, unidentified; identical to SEQ ID NO: 5154

SEQ ID NO: 7995 - protein, 138 aa, unidentified
MTWRQAVLLSCFSAVVLLSMLREGTSVSVGTMQMAGEEASEDAKQKIFMQESDASNFLKRRGKRSPKSRDEVNVENRQKLRVDELRREYYEEQRNEFENFVEEQNDEQEERSREAVEQWRQWHYDGLHPSYLYNRHHT

SEQ ID NO: 7996 - protein, 124 aa, unidentified
MRQAGRAALLAALLLLVQLCPGSSQRSPEAAGVQDPSLRWSPGARNQGGGARALLLLLAERFPRRAGPGRLGLGTAGERPRRDNPSLSIDLTFHLLRTLLELARTQSQRERAEQNRIIFDSVGK

SEQ ID NO: 7997 - protein, 112 aa, unidentified
MTRCALLLLMVLMLGRVLVVPVTPIPTFQLRPQNSPQTTPRPAASESPSAAPTWPWAAQSHCSPTRHPGSRIVLSLDVPIGLLQILLEQARARAAREQATTNARILARVGHC

SEQ ID NO: 7998 - protein, 161 aa, unidentified
MLMPVHFLLLLLLLLGGPRTGLPHKFYKAKPIFSCLNTALSEAEKGQWEDASLLSKRSFHYLRSRDASSGEEEEGKEKKTFPISGARGGARGTRYRYVSQAQPRGKPRQDTAKSPHRTKFTLSLDVPTNIMNLLFNIAKAKNLRAQAAANAHLMAQIGRKK

SEQ ID NO: 7999 - protein, 1516 aa, unidentified
MAPAKATNVVRLLLGSTALWLSQLGSGTVAASKSVTAHLAAKWPETPLLLEASEFMAEESNEKFWQFLETVQELAIYKQTESDYSYYNLILKKAGQFLDNLHINLLKFAFSIRAYSPAIQMFQQIAADEPPPDGCNAFVVIHKKHTCKINEIKKLLKKAASRTRPYLFKGDHKFPTNKENLPVVILYAEMGTRTFSAFHKVLSEKAQNEEILYVLRHYIQKPSSRKMYLSGYGVELAIKSTEYKALDDTQVKTVTNTTVEDETETNEVQGFLFGKLKEIYSDLRDNLTAFQKYLIESNKQMMPLKVWELQDLSFQAASQIMSAPVYDSIKLMKDISQNFPIKARSLTRIAVNQHMREEIKENQKDLQVRFKIQPGDARLFINGLRVDMDVYDAFSILDMLKLEGKMMNGLRNLGINGEDMSKFLKLNSHIWEYTYVLDIRHSSIMWINDLENDDLYITWPTSCQKLLKPVFPGSVPSIRRNFHNLVLFIDPAQEYTLDFIKLADVFYSHEVPLRIGFVFILNTDDEVDGANDAGVALWRAFNYIAEEFDISEAFISIVHMYQKVKKDQNILTVDNVKSVLQNTFPHANIWDILGIHSKYDEERKAGASFYKMTGLGPLPQALYNGEPFKHEEMNIKELKMAVLQRMMDASVYLQREVFLGTLNDRTNAIDFLMDRNNVVPRINTLILRTNQQYLNLISTSVTADVEDFSTFFFLDSQDKSAVIAKNMYYLTQDDESIISAVTLWIIADFDKPSGRKLLFNALKHMKTSVHSRLGIIYNPTSKINEENTAISRGILAAFLTQKNMFLRSFLGQLAKEEIATAIYSGDKIKTFLIEGMDKNAFEKKYNTVGVNIFRTHQLFCQDVLKLRPGEMGIVSNGRFLGPLDEDFYAEDFYLLEKITFSNLGEKIKGIVENMGINANNMSDFIMKVDALMSSVPKRASRYDVTFLRENHSVIKTNPQENDMFFNVIAIVDPLTREAQKMAQLLVVLGKIINMKIKLFMNCRGRLSEAPLESFYRFVLEPELMSGANDVSSLGPVAKFLDIPESPLLILNMITPEGWLVETVHSNCDLDNIHLKDTEKTVTAEYELEYLLLEGQCFDKVTEQPPRGLQFTLGTKNKPAVVDTIVMAHHGYFQLKANPGAWILRLHQGKSEDIYQIVGHEGTDSQADLEDIIVVLNSFKSKILKVKVKKETDKIKEDILTDEDEKTKGLWDSIKSFTVSLHKENKKEKDVLNIFSVASGHLYERFLRIMMLSVLRNTKTPVKFWLLKNYLSPTFKEVIPHMAKEYGFRYELVQYRWPRWLRQQTERQRIIWGYKILFLDVLFPLAVDKIIFVDADQIVRHDLKELRDFDLDGAPYGYTPFCDSRREMDGYRFWKTGYWASHLLRRKYHISALYVVDLKKFRRIGAGDRLRSQYQALSQDPNSLSNLDQDLPNNMIYQVAIKSLPQDWLWCETWCDDESKQRAKTIDLCNNPKTKESKLKAAARIVPEWVEYDAEIRQLLDHLENKKQDTILTHDEL

SEQ ID NO: 8000 - protein, 530 aa, unidentified; identical to SEQ ID NO: 5160

SEQ ID NO: 8001 - protein, 527 aa, unidentified; identical to SEQ ID NO: 5168

SEQ ID NO: 8002 - protein, 529 aa, unidentified; identical to SEQ ID NO: 5175

SEQ ID NO: 8003 - protein, 528 aa, unidentified; identical to SEQ ID NO: 5176

SEQ ID NO: 8004 - protein, 529 aa, unidentified; identical to SEQ ID NO: 5177

SEQ ID NO: 8005 - protein, 523 aa, unidentified; identical to SEQ ID NO: 5178

SEQ ID NO: 8006 - protein, 523 aa, unidentified; identical to SEQ ID NO: 5179

SEQ ID NO: 8007 - protein, 541 aa, unidentified; identical to SEQ ID NO: 5180

SEQ ID NO: 8008 - protein, 244 aa, unidentified
MAAAASPAILPRLAILPYLLFDWSGTGRADAHSLWYNFTIIHLPRHGQQWCEVQSQVDQKNFLSYDCGSDKVLSMGHLEEQLYATDAWGKQLEMLREVGQRLRLELADTELEDFTPSGPLTLQVRMSCECEADGYIRGSWQFSFDGRKFLLFDSNNRKWTVVHAGARRMKEKWEKDSGLTTFFKMVSMRDCKSWLRDFLMHRKKRLEPTAPPTMAPGLAQPKAIATTLSPWSFLIILCFILPGI

SEQ ID NO: 8009 - protein, 640 aa, unidentified; identical to SEQ ID NO: 5184

SEQ ID NO: 8010 - protein, 931 aa, unidentified; identical to SEQ ID NO: 5190

SEQ ID NO: 8011 - protein, 320 aa, unidentified; identical to SEQ ID NO: 5199

SEQ ID NO: 8012 - protein, 963 aa, unidentified
MAVAPRLFGGLCFRFRDQNPEVAVEGRLPISHSCVGCRRERTAMATVAANPAAAAAAVAAAAAVTEDREPQHEELPGLDSQWRQIENGESGRERPLRAGESWFLVEKHWYKQWEAYVQGGDQDSSTFPGCINNATLFQDEINWRLKEGLVEGEDYVLLPAAAWHYLVSWYGLEHGQPPIERKVIELPNIQKVEVYPVELLLVRHNDLGKSHTVQFSHTDSIGLVLRTARERFLVEPQEDTRLWAKNSEGSLDRLYDTHITVLDAALETGQLIIMETRKKDGTWPSAQLHVMNNNMSEEDEDFKGQPGICGLTNLGNTCFMNSALQCLSNVPQLTEYFLNNCYLEELNFRNPLGMKGEIAEAYADLVKQAWSGHHRSIVPHVFKNKVGHFASQFLGYQQHDSQELLSFLLDGLHEDLNRVKKKEYVELCDAAGRPDQEVAQEAWQNHKRRNDSVIVDTFHGLFKSTLVCPDCGNVSVTFDPFCYLSVPLPISHKRVLEVFFIPMDPRRKPEQHRLVVPKKGKISDLCVALSKHTGISPERMMVADVFSHRFYKLYQLEEPLSSILDRDDIFVYEVSGRIEAIEGSREDIVVPVYLRERTPARDYNNSYYGLMLFGHPLLVSVPRDRFTWEGLYNVLMYRLSRYVTKPNSDDEDDGDEKEDDEEDKDDVPGPSTGGSLRDPEPEQAGPSSGVTNRCPFLLDNCLGTSQWPPRRRRKQLFTLQTVNSNGTSDRTTSPEEVHAQPYIAIDWEPEMKKRYYDEVEAEGYVKHDCVGYVMKKAPVRLQECIELFTTVETLEKENPWYCPSCKQHQLATKKLDLWMLPEILIIHLKRFSYTKFSREKLDTLVEFPIRDLDFSEFVIQPQNESNPELYKYDLIAVSNHYGGMRDGHYTTFACNKDSGQWHYFDDNSVSPVNENQIESKAAYVLFYQRQDVARRLLSPAGSSGAPASPACSSPPSSEFMDVN

SEQ ID NO: 8013 - protein, 494 aa, unidentified
MPLYSVTVKWGKEKFEGVELNTDEPPMVFKAQLFALTGVQPARQKVMVKGGTLKDDDWGNIKIKNGMTLLMMGSADALPEEPSAKTVFVEDMTEEQLASAMELPCGLTNLGNTCYMNATVQCIRSVPELKDALKRYAGALRASGEMASAQYITAALRDLFDSMDKTSSSIPPIILLQFLHMAFPQFAEKGEQGQYLQQDANECWIQMMRVLQQKLEAIEDDSVKETDSSSASAATPSKKKSLIDQFFGVEFETTMKCTESEEEEVTKGKENQLQLSCFINQEVKYLFTGLKLRLQEEITKQSPTLQRNALYIKSSKISRLPAYLTIQMVRFFYKEKESVNAKVLKDVKFPLMLDMYELCTPELQEKMVSFRSKFKDLEDKKVNQQPNTSDKKSSPQKEVKYEPFSFADDIGSNNCGYYDLQAVLTHQGRSSSSGHYVSWVKRKQDEWIKFDDDKVSIVTPEDILRLSGGGDWHIAYVLLYGPRRVEIMEEESEQ

SEQ ID NO: 8014 - protein, 520 aa, unidentified
MECPHLSSSVCIAPDSAKFPNGSPSSWCCSVCRSNKSPWVCLTCSSVHCGRYVNGHAKKHYEDAQVPLTNHKKSEKQDKVQHTVCMDCSSYSTYCYRCDDFVVNDTKLGLVQKVREHLQNLENSAFTADRHKKRKLLENSTLNSKLLKVNGSTTAICATGLRNLGNTCFMNAILQSLSNIEQFCCYFKELPAVELRNGKTAGRRTYHTRSQGDNNVSLVEEFRKTLCALWQGSQTAFSPESLFYVVWKIMPNFRGYQQQDAHEFMRYLLDHLHLELQGGFNGVSRSAILQENSTLSASNKCCINGASTVVTAIFGGILQNEVNCLICGTESRKFDPFLDLSLDIPSQFRSKRSKNQENGPVCSLRDCLRSFTDLEELDETELYMCHKCKKKQKSTKKFWIQKLPKVLCLHLKRFHWTAYLRNKVDTYVEFPLRGLDMKCYLLEPENSGPESCLYDLAAVVVHHGSGVGSGHYTAYATHEGRWFHFNDSTVTLTDEETVVKAKAYILFYVEHQAKAGSDKL

SEQ ID NO: 8015 - protein, 686 aa, unidentified
MGEFKVHRVRFFNYVPSGIRCVAYNNQSNRLAVSRTDGTVEIYNLSANYFQEKFFPGHESRATEALCWAEGQRLFSAGLNGEIMEYDLQALNIKYAMDAFGGPIWSMAASPSGSQLLVGCEDGSVKLFQITPDKIQFERNFDRQKSRILSLSWHPSGTHIAAGSIDYISVFDVKSGSAVHKMIVDRQYMGVSKRKCIVWGVAFLSDGTIISVDSAGKVQFWDSATGTLVKSHLIANADVQSIAVADQEDSFVVGTAEGTVFHFQLVPVTSNSSEKQWVRTKPFQHHTHDVRTVAHSPTALISGGTDTHLVFRPLMEKVEVKNYDAALRKITFPHRCLISCSKKRQLLLFQFAHHLELWRLGSTVATGKNGDTLPLSKNADHLLHLKTKGPENIICSCISPCGSWIAYSTVSRFFLYRLNYEHDNISLKRVSKMPAFLRSALQILFSEDSTKLFVASNQGALHIVQLSGGSFKHLHAFQPQSGTVEAMCLLAVSPDGNWLAASGTSAGVHVYNVKQLKLHCTVPAYNFPVTAMAIAPNTNNLVIAHSDQQVFEYSIPDKQYTDWSRTVQKQGFHHLWLQRDTPITHISFHPKRPMHILLHDAYMFCIIDKSLPLPNDKTLLYNPFPPTNESDVIRRRTAHAFKISKIYKPLLFMDLLDERTLVAVERPLDDIIAQLPPPIKKKKFGT

SEQ ID NO: 8016 - protein, 124 aa, unidentified
MYKLASCCLLFIGFLNPLLSLPLLDSREISFQLSAPHEDARLTPEELERASLLQILPEMLGAERGDILRKADSSTNIFNPRGNLRKFQDFSGQDPNILLSHLLARIWKPYKKRETPDCFWKYCV

SEQ ID NO: 8017 - protein, 119 aa, unidentified
MNKILSSTVCFGLLTLLSVLSFLQSVHGRPYLTQGNEIFPDKKYTNREELLLALLNKNFDFQRPFNTDLALPNKLEELNQLEKLKEQLVEEKDSETSYAVDGLFSSHPSKRACFWKYCV

SEQ ID NO: 8018 - protein, 1347 aa, unidentified
MKSCAVSLTTAAVAFGDEAKKMAEGKASRESEEESVSLTVEEREALGGMDSRLFGFVRLHEDGARTKTLLGKAVRCYESLILKAEGKVESDFFCQLGHFNLLLEDYSKALSAYQRYYSLQADYWKNAAFLYGLGLVYFYYNAFHWAIKAFQDVLYVDPSFCRAKEIHLRLGLMFKVNTDYKSSLKHFQLALIDCNPCTLSNAEIQFHIAHLYETQRKYHSAKEAYEQLLQTENLPAQVKATVLQQLGWMHHNMDLVGDKATKESYAIQYLQKSLEADPNSGQSWYFLGRCYSSIGKVQDAFISYRQSIDKSEASADTWCSIGVLYQQQNQPMDALQAYICAVQLDHGHAAAWMDLGTLYESCNQPQDAIKCYLNAARSKRCSNTSTLAARIKFLQNGSDNWNGGQSLSHHPVQQVYSLCLTPQKLQHLEQLRANRDNLNPAQKHQLEQLESQFVLMQQMRHKEVAQVRTTGIHNGAITDSSLPTNSVSNRQPHGALTRVSSVSQPGVRPACVEKLLSSGAFSAGCIPCGTSKILGSTDTILLGSNCIAGSESNGNVPYLQQNTHTLPHNHTDLNSSTEEPWRKQLSNSAQGLHKSQSSCLSGPNEEQPLFSTGSAQYHQATSTGIKKANEHLTLPSNSVPQGDADSHLSCHTATSGGQQGIMFTKESKPSKNRSLVPETSRHTGDTSNGCADVKGLSNHVHQLIADAVSSPNHGDSPNLLIADNPQLSALLIGKANGNVGTGTCDKVNNIHPAVHTKTDHSVASSPSSAISTATPSPKSTEQRSINSVTSLNSPHSGLHTVNGEGLGKSQSSTKVDLPLASHRSTSQILPSMSVSICPSSTEVLKACRNPGKNGLSNSCILLDKCPPPRPPTSPYPPLPKDKLNPPTPSIYLENKRDAFFPPLHQFCTNPKNPVTVIRGLAGALKLDLGLFSTKTLVEANNEHMVEVRTQLLQPADENWDPTGTKKIWRCESNRSHTTIAKYAQYQASSFQESLREENEKRTQHKDHSDNESTSSENSGRRRKGPFKTIKFGTNIDLSDNKKWKLQLHELTKLPAFARVVSAGNLLTHVGHTILGMNTVQLYMKVPGSRTPGHQENNNFCSVNINIGPGDCEWFVVPEDYWGVLNDFCEKNNLNFLMSSWWPNLEDLYEANVPVYRFIQRPGDLVWINAGTVHWVQAVGWCNNIAWNVGPLTACQYKLAVERYEWNKLKSVKSPVPMVHLSWNMARNIKVSDPKLFEMIKYCLLKILKQYQTLREALVAAGKEVIWHGRTNDEPAHYCSICEVEVFNLLFVTNESNTQKTYIVHCHDCARKTSKSLENFVVLEQYKMEDLIQVYDQFTLALSLSSSS

SEQ ID NO: 8019 - protein, 420 aa, unidentified
MVSKALLRLVSAVNRRRMKLLLGIALLAYVASVWGNFVNMRSIQENGELKIESKIEEMVEPLREKIRDLEKSFTQKYPPVKFLSEKDRKRILITGGAGFVGSHLTDKLMMDGHEVTVVDNFFTGRKRNVEHWIGHENFELINHDVVEPLYIEVDQIYHLASPASPPNYMYNPIKTLKTNTIGTLNMLGLAKRVGARLLLASTSEVYGDPEVHPQSEDYWGHVNPIGPRACYDEGKRVAETMCYAYMKQEGVEVRVARIFNTFGPRMHMNDGRVVSNFILQALQGEPLTVYGSGSQTRAFQYVSDLVNGLVALMNSNVSSPVNLGNPEEHTILEFAQLIKNLVGSGSEIQFLSEAQDDPQKRKPDIKKAKLMLGWEPVVPLEEGLNKAIHYFRKELEYQANNQYIPKPKPARIKKGRTRHS

SEQ ID NO: 8020 - protein, 365 aa, unidentified
MPGGKKVAGGGSSGATPTSAAATAPSGVRRLETSEGTSAQRDEEPEEEGEEDLRDGGVPFFVNRGGLPVDEATWERMWKHVAKIHPDGEKVAQRIRGATDLPKIPIPSVPTFQPSTPVPERLEAVQRYIRELQYNHTGTQFFEIKKSRPLTGLMDLAKEMTKEALPIKCLEAVILGIYLTNSMPTLERFPISFKTYFSGNYFRHIVLGVNFAGRYGALGMSRREDLMYKPPAFRTLSELVLDFEAAYGRCWHVLKKVKLGQSVSHDPHSVEQIEWKHSVLDVERLGRDDFRKELERHARDMRLKIGKGTGPPSPTKDRKKDVSSPQRAQSSPHRRNSRSERRPSGDKKTSEPKAMPDLNGYQIRV

SEQ ID NO: 8021 - protein, 3396 aa, unidentified
MFINIKSILWMCSTLIVTHALHKVKVGKSPPVRGSLSGKVSLPCHFSTMPTLPPSYNTSEFLRIKWSKIEVDKNGKDLKETTVLVAQNGNIKIGQDYKGRVSVPTHPEAVGDASLTVVKLLASDAGLYRCDVMYGIEDTQDTVSLTVDGVVFHYRAATSRYTLNFEAAQKACLDVGAVIATPEQLFAAYEDGFEQCDAGWLADQTVRYPIRAPRVGCYGDKMGKAGVRTYGFRSPQETYDVYCYVDHLDGDVFHLTVPSKFTFEEAAKECENQDARLATVGELQAAWRNGFDQCDYGWLSDASVRHPVTVARAQCGGGLLGVRTLYRFENQTGFPPPDSRFDAYCFKPKEATTIDLSILAETASPSLSKEPQMVSDRTTPIIPLVDELPVIPTEFPPVGNIVSFEQKATVQPQAITDSLATKLPTPTGSTKKPWDMDDYSPSASGPLGKLDISEIKEEVLQSTTGVSHYATDSWDGVVEDKQTQESVTQIEQIEVGPLVTSMEILKHIPSKEFPVTETPLVTARMILESKTEKKMVSTVSELVTTGHYGFTLGEEDDEDRTLTVGSDESTLIFDQIPEVITVSKTSEDTIHTHLEDLESVSASTTVSPLIMPDNNGSSMDDWEERQTSGRITEEFLGKYLSTTPFPSQHRTEIELFPYSGDKILVEGISTVIYPSLQTEMTHRRERTETLIPEMRTDTYTDEIQEEITKSPFMGKTEEEVFSGMKLSTSLSEPIHVTESSVEMTKSFDFPTLITKLSAEPTEVRDMEEDFTATPGTTKYDENITTVLLAHGTLSVEAATVSKWSWDEDNTTSKPLESTEPSASSKLPPALLTTVGMNGKDKDIPSFTEDGADEFTLIPDSTQKQLEEVTDEDIAAHGKFTIRFQPTTSTGIAEKSTLRDSTTEEKVPPITSTEGQVYATMEGSALGEVEDVDLSKPVSTVPQFAHTSEVEGLAFVSYSSTQEPTTYVDSSHTIPLSVIPKTDWGVLVPSVPSEDEVLGEPSQDILVIDQTRLEATISPETMRTTKITEGTTQEEFPWKEQTAEKPVPALSSTAWTPKEAVTPLDEQEGDGSAYTVSEDELLTGSERVPVLETTPVGKIDHSVSYPPGAVTEHKVKTDEVVTLTPRIGPKVSLSPGPEQKYETEGSSTTGFTSSLSPFSTHITQLMEETTTEKTSLEDIDLGSGLFEKPKATELIEFSTIKVTVPSDITTAFSSVDRLHTTSAFKPSSAITKKPPLIDREPGEETTSDMVIIGESTSHVPPTTLEDIVAKETETDIDREYFTTSSPPATQPTRPPTVEDKEAFGPQALSTPQPPASTKFHPDINVYIIEVRENKTGRMSDLSVIGHPIDSESKEDEPCSEETDPVHDLMAEILPEFPDIIEIDLYHSEENEEEEEECANATDVTTTPSVQYINGKHLVTTVPKDPEAAEARRGQFESVAPSQNFSDSSESDTHPFVIAKTELSTAVQPNESTETTESLEVTWKPETYPETSEHFSGGEPDVFPTVPFHEEFESGTAKKGAESVTERDTEVGHQAHEHTEPVSLFPEESSGEIAIDQESQKIAFARATEVTFGEEVEKSTSVTYTPTIVPSSASAYVSEEEAVTLIGNPWPDDLLSTKESWVEATPRQVVELSGSSSIPITEGSGEAEEDEDTMFTMVTDLSQRNTTDTLITLDTSRIITESFFEVPATTIYPVSEQPSAKVVPTKFVSETDTSEWISSTTVEEKKRKEEEGTTGTASTFEVYSSTQRSDQLILPFELESPNVATSSDSGTRKSFMSLTTPTQSEREMTDSTPVFTETNTLENLGAQTTEHSSIHQPGVQEGLTTLPRSPASVFMEQGSGEAAADPETTTVSSFSLNVEYAIQAEKEVAGTLSPHVETTFSTEPTGLVLSTVMDRVVAENITQTSREIVISERLGEPNYGAEIRGFSTGFPLEEDFSGDFREYSTVSHPIAKEETVMMEGSGDAAFRDTQTSPSTVPTSVHISHISDSEGPSSTMVSTSAFPWEEFTSSAEGSGEQLVTVSSSVVPVLPSAVQKFSGTASSIIDEGLGEVGTVNEIDRRSTILPTAEVEGTKAPVEKEEVKVSGTVSTNFPQTIEPAKLWSRQEVNPVRQEIESETTSEEQIQEEKSFESPQNSPATEQTIFDSQTFTETELKTTDYSVLTTKKTYSDDKEMKEEDTSLVNMSTPDPDANGLESYTTLPEATEKSHFFLATALVTESIPAEHVVTDSPIKKEESTKHFPKGMRPTIQESDTELLFSGLGSGEEVLPTLPTESVNFTEVEQINNTLYPHTSQVESTSSDKIEDFNRMENVAKEVGPLVSQTDIFEGSGSVTSTTLIEILSDTGAEGPTVAPLPFSTDIGHPQNQTVRWAEEIQTSRPQTITEQDSNKNSSTAEINETTTSSTDFLARAYGFEMAKEFVTSAPKPSDLYYEPSGEGSGEVDIVDSFHTSATTQATRQESSTTFVSDGSLEKHPEVPSAKAVTADGFPTVSVMLPLHSEQNKSSPDPTSTLSNTVSYERSTDGSFQDRFREFEDSTLKPNRKKPTENIIIDLDKEDKDLILTITESTILEILPELTSDKNTIIDIDHTKPVYEDILGMQTDIDTEVPSEPHDSNDESNDDSTQVQEIYEAAVNLSLTEETFEGSADVLASYTQATHDESMTYEDRSQLDHMGFHFTTGIPAPSTETELDVLLPTATSLPIPRKSATVIPEIEGIKAEAKALDDMFESSTLSDGQAIADQSEIIPTLGQFERTQEEYEDKKHAGPSFQPEFSSGAEEALVDHTPYLSIATTHLMDQSVTEVPDVMEGSNPPYYTDTTLAVSTFAKLSSQTPSSPLTIYSGSEASGHTEIPQPSALPGIDVGSSVMSPQDSFKEIHVNIEATFKPSSEEYLHITEPPSLSPDTKLEPSEDDGKPELLEEMEASPTELIAVEGTEILQDFQNKTDGQVSGEAIKMFPTIKTPEAGTVITTADEIELEGATQWPHSTSASATYGVEAGVVPWLSPQTSERPTLSSSPEINPETQAALIRGQDSTIAASEQQVAARILDSNDQATVNPVEFNTEVATPPFSLLETSNETDFLIGINEESVEGTAIYLPGPDRCKMNPCLNGGTCYPTETSYVCTCVPGYSGDQCELDFDECHSNPCRNGATCVDGFNTFRCLCLPSYVGALCEQDTETCDYGWHKFQGQCYKYFAHRRTWDAAERECRLQGAHLTSILSHEEQMFVNRVGHDYQWIGLNDKMFEHDFRWTDGSTLQYENWRPNQPDSFFSAGEDCVVIIWHENGQWNDVPCNYHLTYTCKKGTVACGQPPVVENAKTFGKMKPRYEINSLIRYHCKDGFIQRHLPTIRCLGNGRWAIPKITCMNPSAYQRTYSMKYFKNSSSAKDNSINTSKHDHRWSRRWQESRR

SEQ ID NO: 8022 - protein, 232 aa, unidentified
MNFLLSWVHWSLALLLYLHHAKWSQAAPMAEGGGQNHHEVVKFMDVYQRSYCHPIETLVDIFQEYPDEIEYIFKPSCVPLMRCGGCCNDEGLECVPTEESNITMQIMRIKPHQGQHIGEMSFLQHNKCECRPKKDRARQEKKSVRGKGKGQKRKRKKSRYKSWSVYVGARCCLMPWSLPGPHPCGPCSERRKHLFVQDPQTCKCSCKNTDSRCKARQLELNERTCRCDKPRR

SEQ ID NO: 8023 - protein, 207 aa, unidentified
MSPLLRRLLLAALLQLAPAQAPVSQPDAPGHQRKVVSWIDVYTRATCQPREVVVPLTVELMGTVAKQLVPSCVTVQRCGGCCPDDGLECVPTGQHQVRMQILMIRYPSSQLGEMSLEEHSQCECRPKKKDSAVKPDRAATPHHRPQPRSVPGWDSAPGAPSPADITHPTPAPGPSAHAAPSTTSALTPGPAAAAADAAASSVAKGGA

SEQ ID NO: 8024 - protein, 419 aa, unidentified
MHLLGFFSVACSLLAAALLPGPREAPAAAAAFESGLDLSDAEPDAGEATAYASKDLEEQLRSVSSVDELMTVLYPEYWKMYKCQLRKGGWQHNREQANLNSRTEETIKFAAAHYNTEILKSIDNEWRKTQCMPREVCIDVGKEFGVATNTFFKPPCVSVYRCGGCCNSEGLQCMNTSTSYLSKTLFEITVPLSQGPKPVTISFANHTSCRCMSKLDVYRQVHSIIRRSLPATLPQCQAANKTCPTNYMWNNHICRCLAQEDFMFSSDAGDDSTDGFHDICGPNKELDEETCQCVCRAGLRPASCGPHKELDRNSCQCVCKNKLFPSQCGANREFDENTCQCVCKRTCPRNQPLNPGKCACECTESPQKCLLKGKKFHHQTCSCYRRPCTNRQKACEPGFSYSEEVCRCVPSYWKRPQMS

SEQ ID NO: 8025 - protein, 354 aa, unidentified
MYREWVVVNVFMMLYVQLVQGSSNEHGPVKRSSQSTLERSEQQIRAASSLEELLRITHSEDWKLWRCRLRLKSFTSMDSRSASHRSTRFAATFYDIETLKVIDEEWQRTQCSPRETCVEVASELGKSTNTFFKPPCVNVFRCGGCCNEESLICMNTSTSYISKQLFEISVPLTSVPELVPVKVANHTGCKCLPTAPRHPYSIIRRSIQIPEEDRCSHSKKLCPIDMLWDSNKCKCVLQEENPLAGTEDHSHLQEPALCGPHMMFDEDRCECVCKTPCPKDLIQHPKNCSCFECKESLETCCQKHKLFHPDTCSCEDRCPFHTRPCASGKTACAKHCRFPKEKRAAQGPHSRKNP

SEQ ID NO: 8026 - protein, 615 aa, unidentified
MKALRLSASALFCLLLINGLGAAPPGRPEAQPPPLSSEHKEPVAGDAVPGPKDGSAPEVRGARNSEPQDEGELFQGVDPRALAAVLLQALDRPASPPAPSGSQQGPEEEAAEALLTETVRSQTHSLPAPESPEPAAPPRPQTPENGPEASDPSEELEALASLLQELRDFSPSSAKRQQETAAAETETRTHTLTRVNLESPGPERVWRASWGEFQARVPERAPLPPPAPSQFQARMPDSGPLPETHKFGEGVSSPKTHLGEALAPLSKAYQGVAAPFPKARRPESALLGGSEAGERLLQQGLAQVEAGRRQAEATRQAAAQEERLADLASDLLLQYLLQGGARQRGLGGRGLQEAAEERESAREEEEAEQERRGGEERVGEEDEEAAEAEAEAEEAERARQNALLFAEEEDGEAGAEDKRSQEETPGHRRKEAEGTEEGGEEEDDEEMDPQTIDSLIELSTKLHLPADDVVSIIEEVEEKRKRKKNAPPEPVPPPRAAPAPTHVRSPQPPPPAPAPARDELPDWNEVLPPWDREEDEVYPPGPYHPFPNYIRPRTLQPPSALRRRHYHHALPPSRHYPGREAQARRAQEEAEAEERRLQEQEELENYIEHVLLRRP

SEQ ID NO: 8027 - protein, 170 aa, unidentified
MDTRNKAQLLVLLTLLSVLFSQTSAWPLYRAPSALRLGDRIPFEGANEPDQVSLKEDIDMLQNALAENDTPYYDVSRNARHADGVFTSDFSKLLGQLSAKKYLESLMGKRVSSNISEDPVPVKRHSDAVFTDNYTRLRKQMAVKKYLNSILNGKRSSEGESPDFPEELEK

SEQ ID NO: 8028 - protein, 438 aa, unidentified; identical to SEQ ID NO: 5228

SEQ ID NO: 8029 - protein, 678 aa, unidentified
MRTVVLTMKASVIEMFLVLLVTGVHSNKETAKKIKRPKFTVPQINCDVKAGKIIDPEFIVKCPAGCQDPKYHVYGTDVYASYSSVCGAAVHSGVLDNSGGKILVRKVAGQSGYKGSYSNGVQSLSLPRWRESFIVLESKPKKGVTYPSALTYSSSKSPAAQAGETTKAYQRPPIPGTTAQPVTLMQLLAVTVAVATPTTLPRPSPSAASTTSIPRPQSVGHRSQEMDLWSTATYTSSQNRPRADPGIQRQDPSGAAFQKPVGADVSLGLVPKEELSTQSLEPVSLGDPNCKIDLSFLIDGSTSIGKRRFRIQKQLLADVAQALDIGPAGPLMGVVQYGDNPATHFNLKTHTNSRDLKTAIEKITQRGGLSNVGRAISFVTKNFFSKANGNRSGAPNVVVVMVDGWPTDKVEEASRLARESGINIFFITIEGAAENEKQYVVEPNFANKAVCRTNGFYSLHVQSWFGLHKTLQPLVKRVCDTDRLACSKTCLNSADIGFVIDGSSSVGTGNFRTVLQFVTNLTKEFEISDTDTRIGAVQYTYEQRLEFGFDKYSSKPDILNAIKRVGYWSGGTSTGAAINFALEQLFKKSKPNKRKLMILITDGRSYDDVRIPAMAAHLKGVITYAIGVAWAAQEELEVIATHPARDHSFFVDEFDNLHQYVPRIIQNICTEFNSQPRN

SEQ ID NO: 8030 - protein, 163 aa, unidentified; identical to SEQ ID NO: 5229

SEQ ID NO: 8031 - protein, 873 aa, unidentified; identical to SEQ ID NO: 5231

SEQ ID NO: 8032 - protein, 202 aa, unidentified
MERGAGAKLLPLLLLLRATGFTCAQTDGRNGYTAVIEVTSGGPWGDWAWPEMCPDGFFASGFSLKVEPPQGIPGDDTALNGIRLHCARGNVLGNTHVVESQSGSWGEWSEPLWCRGGAYLVAFSLRVEAPTTLGDNTAANNVRFRCSDGEELQGPGLSWGDFGDWSDHCPKGACGLQTKIQGPRGLGDDTALNDARLFCCRS

SEQ ID NO: 8033 - protein, 513 aa, unidentified
MTTQLPAYVAILLFYVSRASCQDTFTAAVYEHAAILPNATLTPVSREEALALMNRNLDILEGAITSAADQGAHIIVTPEDAIYGWNFNRDSLYPYLEDIPDPEVNWIPCNNRNRFGQTPVQERLSCLAKNNSIYVVANIGDKKPCDTSDPQCPPDGRYQYNTDVVFDSQGKLVARYHKQNLFMGENQFNVPKEPEIVTFNTTFGSFGIFTCFDILFHDPAVTLVKDFHVDTIVFPTAWMNVLPHLSAVEFHSAWAMGMRVNFLASNIHYPSKKMTGSGIYAPNSSRAFHYDMKTEEGKLLLSQLDSHPSHSAVVNWTSYASSIEALSSGNKEFKGTVFFDEFTFVKLTGVAGNYTVCQKDLCCHLSYKMSENIPNEVYALGAFDGLHTVEGRYYLQICTLLKCKTTNLNTCGDSAETASTRFEMFSLSGTFGTQYVFPEVLLSENQLAPGEFQVSTDGRLFSLKPTSGPVLTVTLFGRLYEKDWASNASSGLTAQARIIMLIVIAPIVCSLSW

SEQ ID NO: 8034 - protein, 520 aa, unidentified; identical to SEQ ID NO: 5237

SEQ ID NO: 8035 - protein, 172 aa, unidentified; identical to SEQ ID NO: 5238

SEQ ID NO: 8036 - protein, 145 aa, unidentified
MSWAPVLLMLFVYCTGCGPQPVLHQPPAMSSALGTTIRLTCTLRNDHDIGVYSVYWYQQRPGHPPRFLLRYFSQSDKSQGPQVPPRFSGSKDVARNRGYLSISELQPEDEAMYYCAMGARSSEKEEREREWEEEMEPTAARTRVP

SEQ ID NO: 8037 - protein, 123 aa, unidentified
MACRCLSFLLMGTFLSVSQTVLAQLDALLVFPGQVAQLSCTLSPQHVTIRDYGVSWYQQRAGSAPRYLLYYRSEEDHHRPADIPDRFSAAKDEAHNACVLTISPVQPEDDADYYCSVGYGFSP

SEQ ID NO: 8038 - protein, 285 aa, unidentified
MAGAGSEARFAGLSLVQLNELLEDEGQLTEMVQKMEETQNVQLNKEMTLASNRSLAEGNLLYQPQLDTLKARLTQKYQELQVLFEAYQIKKTKLDRQSSSASLETLLALLQAEGAKIEEDTENMAEKFLDGELPLDSFIDVYQSKRKLAHMRRVKIEKLQEMVLKGQRLPQALAPLPPRLPELAPTAPLPYPAPEASGPPAVAPRRIPPPPPPVPAGRLATPFTAAMSSGQAVPYPGLQCPPLPPRVGLPTQQGFSSQFVSPYPPPLPQRPPPRLPPHQPGFILQ

SEQ ID NO: 8039 - protein, 782 aa, unidentified
MAAAAAAGPSPGSGPGDSPEGPEGEAPERRRKAHGMLKLYYGLSEGEAAGRPAGPDPLDPTDLNGAHFDPEVYLDKLRRECPLAQLMDSETDMVRQIRALDSDMQTLVYENYNKFISATDTIRKMKNDFRKMEDEMDRLATNMAVITDFSARISATLQDRHERITKLAGVHALLRKLQFLFELPSRLTKCVELGAYGQAVRYQGRAQAVLQQYQHLPSFRAIQDDCQVITARLAQQLRQRFREGGSGAPEQAECVELLLALGEPAEELCEEFLAHARGRLEKELRNLEAELGPSPPAPDVLEFTDHGGSGFVGGLCQVAAAYQELFAAQGPAGAEKLAAFARQLGSRYFALVERRLAQEQGGGDNSLLVRALDRFHRRLRAPGALLAAAGLADAATEIVERVARERLGHHLQGLRAAFLGCLTDVRQALAAPRVAGKEGPGLAELLANVASSILSHIKASLAAVHLFTAKEVSFSNKPYFRGEFCSQGVREGLIVGFVHSMCQTAQSFCDSPGEKGGATPPALLLLLSRLCLDYETATISYILTLTDEQFLVQDQFPVTPVSTLCAEARETARRLLTHYVKVQGLVISQMLRKSVETRDWLSTLEPRNVRAVMKRVVEDTTAIDVQVGLLYEEGVRKAQSSDSSKRTFSVYSSSRQQGRYAPSYTPSAPMDTNLLSNIQKLFSERIDVFSPVEFNKVSVLTGIIKISLKTLLECVRLRTFGRFGLQQVQVDCHFLQLYLWRFVADEELVHLLLDEVVASAALRCPDPVPMEPSVVEVICERG

SEQ ID NO: 8040 - protein, 387 aa, unidentified; identical to SEQ ID NO: 5241

SEQ ID NO: 8041 - protein, 540 aa, unidentified; identical to SEQ ID NO: 5242

SEQ ID NO: 8042 - protein, 236 aa, unidentified; identical to SEQ ID NO: 5247

SEQ ID NO: 8043 - protein, 236 aa, unidentified
MMGIFLVYVGFVFFSVLYVQQGLSSQAKFTEFPRNVTATEGQNVEMSCAFQSGSASVYLEIQWWFLRGPEDLDPGAEGAGAQVELLPDRDPDSDGTKISTVKVQGNDISHKLQISKVRKKDEGLYECRVTDANYGELQEHKAQAYLKVNANSHARRMQAFEASPMWLQDMKPRKNVSAAIPSSIHGSANQRTHSTSSPQVVAKIPKQSPQSGARIATSHGLSVLLLVCGFVKGALL

SEQ ID NO: 8044 - protein, 285 aa, unidentified
MEQRNRLGALGYLPPLLLHALLLFVADAAFTEVPKDVTVREGDDIEMPCAFRASGATSYSLEIQWWYLKEPPRELLHELALSVPGARSKVTNKDATKISTVRVQGNDISHRLRLSAVRLQDEGVYECRVSDYSDDDTQEHKAQAMLRVLSRFAPPNMQAAEAVSHIQSSGPRRHGPASAANANNAGAASRTTSEPGRGDKSPPPGSPPAAIDPAVPEAAAASAAHTPTTTVAAAAAASSASPPSGQAVLLRQRHGSGTGRSYTTDPLLSLLLLALHKFLRLLLGH

SEQ ID NO: 8045 - protein, 204 aa, unidentified
MGAPLAVALGALHYLALFLQLGGATRPAGHAPWDNHVSGHALFTETPHDMTARTGEDVEMACSFRGSGSPSYSLEIQWWYVRSHRDWTDKQAWASNQLKASQQEDAGKEATKISVVKVVGSNISHKLRLSRVKPTDEGTYECRVIDFSDGKARHHKVKAYLRVQPGENSVLHLPEAPPAAPAPPPPKPGKELRKRSVDQEACSL

SEQ ID NO: 8046 - protein, 320 aa, unidentified; identical to SEQ ID NO: 5248

SEQ ID NO: 8047 - protein, 478 aa, unidentified
MAPLRPLLILALLAWVALADQESCKGRCTEGFNVDKKCQCDELCSYYQSCCTDYTAECKPQVTRGDVFTMPEDEYTVYDDGEEKNNATVHEQVGGPSLTSDLQAQSKGNPEQTPVLKPEEEAPAPEVGASKPEGIDSRPETLHPGRPQPPAEEELCSGKPFDAFTDLKNGSLFAFRGQYCYELDEKAVRPGYPKLIRDVWGIEGPIDAAFTRINCQGKTYLFKGSQYWRFEDGVLDPDYPRNISDGFDGIPDNVDAALALPAHSYSGRERVYFFKGKQYWEYQFQHQPSQEECEGSSLSAVFEHFAMMQRDSWEDIFELLFWGRTSAGTRQPQFISRDWHGVPGQVDAAMAGRIYISGMAPRPSLAKKQRFRHRNRKGYRSQRGHSRGRNQNSRRPSRATWLSLFSSEESNLGANNYDDYRMDWLVPATCEPIQSVFFFSGDKYYRVNLRTRRVDTVDPPYPRSIAQYWLGCPAPGHL

SEQ ID NO: 8048 - protein, 445 aa, unidentified
MLPWTALGLALSLRLALARSGAERGPPASAPRGDLMFLLDSSASVSHYEFSRVREFVGQLVAPLPLGTGALRASLVHVGSRPYTEFPFGQHSSGEAAQDAVRASAQRMGDTHTGLALVYAKEQLFAEASGARPGVPKVLVWVTDGGSSDPVGPPMQELKDLGVTVFIVSTGRGNFLELSAAASAPAEKHLHFVDVDDLHIIVQELRGSILDAMRPQQLHATEITSSGFRLAWPPLLTADSGYYVLELVPSAQPGAARRQQLPGNATDWIWAGLDPDTDYDVALVPESNVRLLRPQILRVRTRPGEAGPGASGPESGAGPAPTQLAALPAPEEAGPERIVISHARPRSLRVSWAPALGSAAALGYHVQFGPLRGGEAQRVEVPAGRNCTTLQGLAPGTAYLVTVTAAFRSGRESALSAKACTPDGPRPRPRPVPRAPTPGTASREP

SEQ ID NO: 8049 - protein, 755 aa, unidentified
MPPFLLLEAVCVFLFSRVPPSLPLQEVHVSKETIGKISAASKMMWCSAAVDIMFLLDGSNSVGKGSFERSKHFAITVCDGLDISPERVRVGAFQFSSTPHLEFPLDSFSTQQEVKARIKRMVFKGGRTETELALKYLLHRGLPGGRNASVPQILIIVTDGKSQGDVALPSKQLKERGVTVFAVGVRFPRWEELHALASEPRGQHVLLAEQVEDATNGLFSTLSSSAICSSATPDCRVEAHPCEHRTLEMVREFAGNAPCWRGSRRTLAVLAAHCPFYSWKRVFLTHPATCYRTTCPGPCDSQPCQNGGTCVPEGLDGYQCLCPLAFGGEANCALKLSLECRVDLLFLLDSSAGTTLDGFLRAKVFVKRFVRAVLSEDSRARVGVATYSRELLVAVPVGEYQDVPDLVWSLDGIPFRGGPTLTGSALRQAAERGFGSATRTGQDRPRRVVVLLTESHSEDEVAGPARHARARELLLLGVGSEAVRAELEEITGSPKHVMVYSDPQDLFNQIPELQGKLCSRQRPGCRTQALDLVFMLDTSASVGPENFAQMQSFVRSCALQFEVNPDVTQVGLVVYGSQVQTAFGLDTKPTRAAMLRAISQAPYLGGVGSAGTALLHIYDKVMTVQRGARPGVPKAVVVLTGGRGAEDAAVPAQKLRNNGISVLVVGVGPVLSEGLRRLAGPRDSLIHVAAYADLRYHQDVLIEWLCGEAKQPVNLCKPSPCMNEGSCVLQNGSYRCKCRDGWEGPHCENRFLRRP

SEQ ID NO: 8050 - protein, 1242 aa, unidentified
MPGLYCPSSWTPLPLTDSWVRACANGPCLSVRARLTYRNPQPQPVDGVFVYPLAEAEVVSGFEAEAAGRRVSFQLQSRRRSQAACCRALGPGLGTPTPRRCAQGHLVLDLAQARSTLVLPTGIIAAAGTMTVTLHSSRELPSRPDGVLHVALPTVLTPLAPPGPPGPPRPPGLCDDSPTSCFGVGSLQEEGLAWEELAAPRDVFSGPARCPAPYTFSFEMLVTGPCLLAGLESPSHALRADAPPHASSAATICVTLAEGHHCDRALEILLHPSEPHQPHLMLEGGSLSSAEYEARVRARRDFQRLQRRDSDGDRQVWFLQRRFHKDILLNPVLALSFCPDLSSKPGHLGTATRELLFLLDSSSVAHKDAIVLAVKSLPPQTLINLAVFGTLVQPLFPESRPCSDDAVQLICESIETLQVPSGPPDVLAALDWAVGQPQHRAYPRQLFLLTAASPMAATTHRTLELMRWHRGTARCFSFGLGPTCHQLLQGLSALSRGQAYFLRPGQRLQPMLVQALRKALEPALSDISVDWFVPDTVEALLTPREIPALYPGDQLLGYCSLFRVDGFRSRPPGGQEPGWQSSGGSVFPSPEEAPSAASPGTEPTGTSEPLGTGTVSAELSSPWAARDSEQSTDALTDPVTDPGPNPSDTAIWRRIFQSSYIREQYVLTHCSASPEPGPGSTGSSESPGSQGPGSPEGSAPLEPPSQQGCRSLAWGEPAGSRSCPLPAPTPAPFKVGALSTEVLGRQHRAALAGRSLSSPPGRANQVPGRPRKPSLGAILDGPSPEPGQQLGQGLDDSGNLLSPAPMDWDMLMEPPFLFTAVPPSGELAPPAVPPQAPRCHVVIRGLCGEQPMCWEVGVGLETLWGPGDGSQPPSPPVREAAWDQALHRLTAASVVRDNEQLALRGGAETTADRGHARRCWLRALQTSKVSSAPSCFTCPVAVDATTREVLPGALQVCSSEPAEPPGTPPASHSHLDAAPLPTVVYSKGLQRGSPAGAWDSDQNGNSKRALGDPATPTEGPRRPPPRPPCRLSMGRRHKLCSPDPGQANNSEGSDHDYLPLVRLQEAPGSFRLDAPFCAAVRISQERLCRASPFAVHRASLSPTSASLPWALLGPGVGQGDSATASCSPSPSSGSEGPGQVDSGRGSDTEASEGAEGLGGTDLRGRTWATAVALAWLEHRCAAAFDEWELTAAKADCWLRAQHLPDGLDLAALKAAARGLFLLLRHWDQNLQLHLLCYSPANV

SEQ ID NO: 8051 - protein, 891 aa, unidentified
MLPTEVPQSHPGPSALLLLQLLLPPTSAFFPNIWSLLAAPGSITHQDLTEEAALNVTLQLFLEQPPPGRPPLRLEDFLGRTLLADDLFAAYFGPGSSRRFRAALGEVSRANAAQDFLPTSRNDPDLHFDAERLGQGRARLVGALRETVVAARALDHTLARQRLGAALHALQDFYSHSNWVELGEQQPHPHLLWPRQELQNLAQVADPTCSDCEELSCPRNWLGFTLLTSGYFGTHPPKPPGKCSHGGHFDRSSSQPPRGGINKDSTSPGFSPHHMLHLQAAKLALLASIQAFSLLRSRLGDRDFSRLLDITPASSLSFVLDTTGSMGEEINAAKIQARHLVEQRRGSPMEPVHYVLVPFHDPGFGPVFTTSDPDSFWQQLNEIHALGGGDEPEMCLSALQLALLHTPPLSDIFVFTDASPKDAFLTNQVESLTQERRCRVTFLVTEDTSRVQGRARREILSPLRFEPYKAVALASGGEVIFTKDQHIRDVAAIVGESMAALVTLPLDPPVVVPGQPLVFSVDGLLQKITVRIHGDISSFWIKNPAGVSQGQEEGGGPLGHTRRFGQFWMVTMDDPPQTGTWEIQVTAEDTPGVRVQAQTSLDFLFHFGIPMEDGPHPGLYPLTQPVAGLQTQLLVEVTGLGSRANPGDPQPHFSHVILRGVPEGAELGQVPLEPVGPPERGLLAASLSPTLLSTPRPFSLELIGQDAAGRRLHRAAPQPSTVVPVLLELSGPSGFLAPGSKVPLSLRIASFSGPQDLDLRTFVNPSFSLTSNLSRAHLELNESAWGRLWLEVPDSAAPDSVVMVTVTAGGREANPVPPTHAFLRLLVSAPAPQDRHTTPTGSSDPILTTATPAFSPFTLVTQGRAGAGLAAGSPWWGTVGGVLLLLGLASW

SEQ ID NO: 8052 - protein, 325 aa, unidentified
MPSSTAMAVGALSSSLLVTCCLMVALCSPSIPLEKLAQAPEQPGQEKREHASRDGPGRVNELGRPARDEGGSGRDWKSKSGRGLAGREPWSKLKQAWVSQGGGAKAGDLQVRPRGDTPQAEALAAAAQDAIGPELAPTPEPPEEYVYPDYRGKGCVDESGFVYAIGEKFAPGPSACPCLCTEEGPLCAQPECPRLHPRCIHVDTSQCCPQCKERKNYCEFRGKTYQTLEEFVVSPCERCRCEANGEVLCTVSACPQTECVDPVYEPDQCCPICKNGPNCFAETAVIPAGREVKTDECTICHCTYEEGTWRIERQAMCTRHECRQM

SEQ ID NO: 8053 - protein, 222 aa, unidentified
MALHIHEACILLLVIPGLVTSAAISHEDYPADEGDQISSNDNLIFDDYRGKGCVDDSGFVYKLGERFFPGHSNCPCVCALDGPVCDQPECPKIHPKCTKVEHNGCCPECKEVKNFCEYHGKNYKILEEFKPSPCEWCRCEPSNEVHCVVADCAVPECVNPVYEPEQCCPVCKNGPNCFAGTTIIPAGIEVKVDECNICHCHNGDWWKPAQCSKRECQGKQTV

SEQ ID NO: 8054 - protein, 955 aa, unidentified
MWAGLLLRAACVALLLPGAPARGYTGRKPPGHFAAERRRLGPHVCLSGFGSGCCPGWAPSMGGGHCTLPLCSFGCGSGICIAPNVCSCQDGEQGATCPETHGPCGEYGCDLTCNHGGCQEVARVCPVGFSMTETAVGIRCTDIDECVTSSCEGHCVNTEGGFVCECGPGMQLSADRHSCQDTDECLGTPCQQRCKNSIGSYKCSCRTGFHLHGNRHSCVDVNECRRPLERRVCHHSCHNTVGSFLCTCRPGFRLRADRVSCEAFPKAVLAPSAILQPRQHPSKMLLLLPEAGRPALSPGHSPPSGAPGPPAGVRTTRLPSPTPRLPTSSPSAPVWLLSTLLATPVPTASLLGNLRPPSLLQGEVMGTPSSPRGPESPRLAAGPSPCWHLGAMHESRSRWTEPGCSQCWCEDGKVTCEKVRCEAACSHPIPSRDGGCCPSCTGCFHSGVVRAEGDVFSPPNENCTVCVCLAGNVSCISPECPSGPCQTPPQTDCCTCVPVRCYFHGRWYADGAVFSGGGDECTTCVCQNGEVECSFMPCPELACPREEWRLGPGQCCFTCQEPTPSTGCSLDDNGVEFPIGQIWSPGDPCELCICQADGSVSCKRTDCVDSCPHPIRIPGQCCPDCSAGCTYTGRIFYNNETFPSVLDPCLSCICLLGSVACSPVDCPITCTYPFHPDGECCPVCRDCNYEGRKVANGQVFTLDDEPCTRCTCQLGEVSCEKVPCQRACADPALLPGDCCSSCPDSLSPLEEKQGLSPHGNVAFSKAGRSLHGDTEAPVNCSSCPGPPTASPSRPVLHLLQLLLRTNLMKTQTLPTSPAGAHGPHSLALGLTATFPGEPGASPRLSPGPSTPPGAPTLPLASPGAPQPPPVTPERSFSASGAQIVSRWPPLPGTLLTEASALSMMDPSPSKTPITLLGPRVLSPTTSRLSTALAATTHPGPQQPPVGASRGEESTM

SEQ ID NO: 8055 - protein, 1590 aa, unidentified
MPGGACVLVIALMFLAWGEAQECSPGGHQFLRSPYRSVRFDSWHLQQSAVQDLICDHSLSPGWYRFLILDRPAEMPTKCVEMNHCGTQAPIWLSLRDSETLPSPGEIKQLTACATWQFLFSTTKDCCLFQIPVSVRNCGNFSVYLLQPTQGCMGYCAEAISDARLHPCGSDETETGGDCVRQLAASLPPPPAGRPEVLVELIESRLFCRCSFDVPATKNSVGFHIAWSRLSSQEVKEELTQETTVQAFSLLELDGINLRLGDRIFCSASVFFLENPHVQSVAIESQEFFAGFKLQPELSTISEDGKEYYLRIESTVPIICSEFSELDQECKISLKLKTIGQGREHLGLNLALSSCHVDLLQTSSCANGTCSHTFVYYTAVTDFSRDGDRVSNIVVQPIVNEDFLWNNYIPDSIQIKVKDVPTAYCYTFTDPHIITFDGRVYDNFKTGTFVLYKSMSRDFEVHVRQWDCRSLHYPVSCNCGFVAQEGGDIVTFDMCNGQLRESQPYLFIKSQDVTRNIKISESYLGRKVTIWFSSGAFIRADLGEWGMSLTIRAPSVDYRNTLGLCGTFDENPENDFHDKNGMQIDQNFNNYVAFINEWRILPGKSMSDTLPVSMTSPGKPSYCSCSLDTAAYPSSEDLDSVSRSEIALGCKDLNHVSLSSLIPELDVTSEYINSDTLVREINKHTSPEEYNLNLFLQEKKHINLTKLGLNVQKHPGNEKEDSLQYLANKKYTQGRGSHSQEMRYNRQNRWKRQNFHEFPPLFAFPSLSQTDLEELTYFFPEDHAEDVQQEFFPSWPTPSGLTEYSTLTLCQETLANSSIGRLCLAFLGKRLDSVIEMCVKDVLLKDDLSWAEAGVALLENECEKRIVEEGKYNTEEYGTSIEDILSVLKCPNLCSGNGQCMEWGCACSPSFSSYDCSDSYDKAPEITELGNAGFCDVQKYNCMMVRVFGKGFKELPSIKCEVTKLQYNSSEWMPGEPIYTQTVFHNSRAVDCQLPTDVQQFDTMDLVGGKPTGKWQLKVSNDGYKFSNPKITVIYDGACQVCGLYKNDSCTIKENVCIIDGLCYVEGDKNPTSPCLICRPKISRFTWSFLENNQPPVIQALQDKLQTFYGENFEYQFVAFDPEGSDIHFTLDSGPEGASVSSAGLFMWKTDLLTTQQITVRLNDDCDAETRVTIEVTVKSCDCLNGGSCVSDRNFSPGSGVYLCVCLPGFHGSLCEVDISGCQSNPCGLGSYISGFHSYSCDCPPELKVETQFVNQFTTQTVVLTRSDKSVNKEEDDKNAQGRKRHVKPTSGNAFTICKYPCGKSRECVAPNICKCKPGYIGSNCQTALCDPDCKNHGKCIKPNICQCLPGHGGATCDEEHCNPPCQHGGTCLAGNLCTCPYGFVGPRCETMVCNRHCENGGQCLTPDICQCKPGWYGPTCSTALCDPVCLNGGSCNKPNTCLCPNGFFGEHCQNAFCHPPCKNGGHCMRNNVCVCREGYTGRRFQKSICDPTCMNGGKCVGPSTCSCPSGWSGKRCNTPICLQKCKNGGECIAPSICHCPSSWEGVRCQIPICNPKCLYGGRCIFPNVCSCRTEYSGVKCEKKIQIRRH

SEQ ID NO: 8056 - protein, 2813 aa, unidentified
MIPARFAGVLLALALILPGTLCAEGTRGRSSTARCSLFGSDFVNTFDGSMYSFAGYCSYLLAGGCQKRSFSIIGDFQNGKRVSLSVYLGEFFDIHLFVNGTVTQGDQRVSMPYASKGLYLETEAGYYKLSGEAYGFVARIDGSGNFQVLLSDRYFNKTCGLCGNFNIFAEDDFMTQEGTLTSDPYDFANSWALSSGEQWCERASPPSSSCNISSGEMQKGLWEQCQLLKSTSVFARCHPLVDPEPFVALCEKTLCECAGGLECACPALLEYARTCAQEGMVLYGWTDHSACSPVCPAGMEYRQCVSPCARTCQSLHINEMCQERCVDGCSCPEGQLLDEGLCVESTECPCVHSGKRYPPGTSLSRDCNTCICRNSQWICSNEECPGECLVTGQSHFKSFDNRYFTFSGICQYLLARDCQDHSFSIVIETVQCADDRDAVCTRSVTVRLPGLHNSLVKLKHGAGVAMDGQDVQLPLLKGDLRIQHTVTASVRLSYGEDLQMDWDGRGRLLVKLSPVYAGKTCGLCGNYNGNQGDDFLTPSGLAEPRVEDFGNAWKLHGDCQDLQKQHSDPCALNPRMTRFSEEACAVLTSPTFEACHRAVSPLPYLRNCRYDVCSCSDGRECLCGALASYAAACAGRGVRVAWREPGRCELNCPKGQVYLQCGTPCNLTCRSLSYPDEECNEACLEGCFCPPGLYMDERGDCVPKAQCPCYYDGEIFQPEDIFSDHHTMCYCEDGFMHCTMSGVPGSLLPDAVLSSPLSHRSKRSLSCRPPMVKLVCPADNLRAEGLECTKTCQNYDLECMSMGCVSGCLCPPGMVRHENRCVALERCPCFHQGKEYAPGETVKIGCNTCVCQDRKWNCTDHVCDATCSTIGMAHYLTFDGLKYLFPGECQYVLVQDYCGSNPGTFRILVGNKGCSHPSVKCKKRVTILVEGGEIELFDGEVNVKRPMKDETHFEVVESGRYIILLLGKALSVVWDRHLSISVVLKQTYQEKVCGLCGNFDGIQNNDLTSSNLQVEEDPVDFGNSWKVSSQCADTRKVPLDSSPATCHNNIMKQTMVDSSCRILTSDVFQDCNKLVDPEPYLDVCIYDTCSCESIGDCACFCDTIAAYAHVCAQHGKVVTWRTATLCPQSCEERNLRENGYECEWRYNSCAPACQVTCQHPEPLACPVQCVEGCHAHCPPGKILDELLQTCVDPEDCPVCEVAGRRFASGKKVTLNPSDPEHCQICHCDVVNLTCEACQEPGGLVVPPTDAPVSPTTLYVEDISEPPLHDFYCSRLLDLVFLLDGSSRLSEAEFEVLKAFVVDMMERLRISQKWVRVAVVEYHDGSHAYIGLKDRKRPSELRRIASQVKYAGSQVASTSEVLKYTLFQIFSKIDRPEASRITLLLMASQEPQRMSRNFVRYVQGLKKKKVIVIPVGIGPHANLKQIRLIEKQAPENKAFVLSSVDELEQQRDEIVSYLCDLAPEAPPPTLPPDMAQVTVGPGLLGVSTLGPKRNSMVLDVAFVLEGSDKIGEADFNRSKEFMEEVIQRMDVGQDSIHVTVLQYSYMVTVEYPFSEAQSKGDILQRVREIRYQGGNRTNTGLALRYLSDHSFLVSQGDREQAPNLVYMVTGNPASDEIKRLPGDIQVVPIGVGPNANVQELERIGWPNAPILIQDFETLPREAPDLVLQRCCSGEGLQIPTLSPAPDCSQPLDVILLLDGSSSFPASYFDEMKSFAKAFISKANIGPRLTQVSVLQYGSITTIDVPWNVVPEKAHLLSLVDVMQREGGPSQIGDALGFAVRYLTSEMHGARPGASKAVVILVTDVSVDSVDAAADAARSNRVTVFPIGIGDRYDAAQLRILAGPAGDSNVVKLQRIEDLPTMVTLGNSFLHKLCSGFVRICMDEDGNEKRPGDVWTLPDQCHTVTCQPDGQTLLKSHRVNCDRGLRPSCPNSQSPVKVEETCGCRWTCPCVCTGSSTRHIVTFDGQNFKLTGSCSYVLFQNKEQDLEVILHNGACSPGARQGCMKSIEVKHSALSVELHSDMEVTVNGRLVSVPYVGGNMEVNVYGAIMHEVRFNHLGHIFTFTPQNNEFQLQLSPKTFASKTYGLCGICDENGANDFMLRDGTVTTDWKTLVQEWTVQRPGQTCQPILEEQCLVPDSSHCQVLLLPLFAECHKVLAPATFYAICQQDSCHQEQVCEVIASYAHLCRTNGVCVDWRTPDFCAMSCPPSLVYNHCEHGCPRHCDGNVSSCGDHPSEGCFCPPDKVMLEGSCVPEEACTQCIGEDGVQHQFLEAWVPDHQPCQICTCLSGRKVNCTTQPCPTAKAPTCGLCEVARLRQNADQCCPEYECVCDPVSCDLPPVPHCERGLQPTLTNPGECRPNFTCACRKEECKRVSPPSCPPHRLPTLRKTQCCDEYECACNCVNSTVSCPLGYLASTATNDCGCTTTTCLPDKVCVHRSTIYPVGQFWEEGCDVCTCTDMEDAVMGLRVAQCSQKPCEDSCRSGFTYVLHEGECCGRCLPSACEVVTGSPRGDSQSSWKSVGSQWASPENPCLINECVRVKEEVFIQQRNVSCPQLEVPVCPSGFQLSCKTSACCPSCRCERMEACMLNGTVIGPGKTVMIDVCTTCRCMVQVGVISGFKLECRKTTCNPCPLGYKEENNTGECCGRCLPTACTIQLRGGQIMTLKRDETLQDGCDTHFCKVNERGEYFWEKRVTGCPPFDEHKCLAEGGKIMKIPGTCCDTCEEPECNDITARLQYVKVGSCKSEVEVDIHYCQGKCASKAMYSIDINDVQDQCSCCSPTRTEPMQVALHCTNGSVVYHEVLNAMECKCSPRKCSK

SEQ ID NO: 8057 - protein, 544 aa, unidentified
MTARTLSLMASLVAYDDSDSEAETEHAGSFNATGQQKDTSGVARPPGQDFASGTLDVPKAGAQPTKHGSCEDPGGYRLPLAQLGRSDWGSCPSQRLQWPGKEPQVTFPIKEPSCSSLWTSHVPASHMPLAAARFKQVKLSRNFPKSSFHAQSESETVGKNGSSFQKKKCEDCVVPYTPRRLRQRQALSTETGKGKDVEPQGPPAGRAPAPLYVGPGVSEFIQPYLNSHYKETTVPRKVLFHLRGHRGPVNTIQWCPVLSKSHMLLSTSMDKTFKVWNAVDSGHCLQTYSLHTEAVRAARWAPCGRRILSGGFDFALHLTDLETGTQLFSGRSDFRITTLKFHPKDHNIFLCGGFSSEMKAWDIRTGKVMRSYKATIQQTLDILFLREGSEFLSSTDASTRDSADRTIIAWDFRTSAKISNQIFHERFTCPSLALHPREPVFLAQTNGNYLALFSTVWPYRMSRRRRYEGHKVEGYSVGCECSPGGDLLVTGSADGRVLMYSFRTASRACTLQGHTQACVGTTYHPVLPSVLATCSWGGDMKIWH

SEQ ID NO: 8058 - protein, 1941 aa, unidentified
MAQGSGGREGALRTPAGGWHSPPSPDMQELLRSVERDLSIDPRQLAPAPGGTHVVALVPARWLASLRDRRLPLGPCPRAEGLGEAEVRTLLQRSVQRLPAGWTRVEVHGLRKRRLSYPLGGGLPFEDGSCGPETLTRFMQEVAAQNYRNLWRHAYHTYGQPYSHSPAPSAVPALDSVRQALQRVYGCSFLPVGETTQCPSYAREGPCPPRGSPACPSLLRAEALLESPEMLYVVHPYVQFSLHDVVTFSPAKLTNSQAKVLFILFRVLRAMDACHRQGLACGALSLYHIAVDEKLCSELRLDLSAYERPEEDENEEAPVARDEAGIVSQEEQGGQPGQPTGQEELRSLVLDWVHGRISNFHYLMQLNRLAGRRQGDPNYHPVLPWVVDFTTPHGRFRDLRKSKFRLNKGDKQLDFTYEMTRQAFVAGGAGGGEPPHVPHHISDVLSDITYYVYKARRTPRSVLCGHVRAQWEPHEYPASMERMQNWTPDECIPEFYTDPSIFRSIHPDMPDLDVPAWCSSSQEFVAAHRALLESREVSRDLHHWIDLTFGYKLQGKEAVKEKNVCLHLVDAHTHLASYGVVQLFDQPHPQRLAGAPALAPEPPLIPKLLVQTIQETTGREDFTENPGQLPNGVGRPVLEATPCEASWTRDRPVAGEDDLEQATEALDSISLAGKAGDQLGSSSQASPGLLSFSVASASRPGRRNKAAGADPGEGEEGRILLPEGFNPMQALEELEKTGNFLAKGLGGLLEVPEQPRVQPAVPLQCLLHRDMQALGVLLAEMVFATRVRTLQPDAPLWVRFQAVRGLCTRHPKEVPVSLQPVLDTLLQMSGPEVPMGAERGKLDQLFEYRPVSQGLPPPCPSQLLSPFSSVVPFPPYFPALHRFILLYQARRVEDEAQGRELVFALWQQLGAVLKDITPEGLEILLPFVLSLMSEEHTAVYTAWYLFEPVAKALGPKNANKYLLKPLIGAYESPCQLHGRFYLYTDCFVAQLMVRLGLQAFLTHLLPHVLQVLAGAEASQEESKDLAGAAEEEESGLPGAGPGSCAFGEEIPMDGEPPASSGLGLPDYTSGVSFHDQADLPETEDFQAGLYVTESPQPQEAEAVSLGRLSDKSSTSETSLGEERAPDEGGAPVDKSSLRSGDSSQDLKQSEGSEEEEEEEDSCVVLEEEEGEQEEVTGASELTLSDTVLSMETVVAGGSGGDGEEEEEALPEQSEGKEQKILLDTACKMVRWLSAKLGPTVASRHVARNLLRLLTSCYVGPTRQQFTVSSGESPPLSAGNIYQKRPVLGDIVSGPVLSCLLHIARLYGEPVLTYQYLPYISYLVAPGSASGPSRLNSRKEAGLLAAVTLTQKIIVYLSDTTLMDILPRISHEVLLPVLSFLTSLVTGFPSGAQARTILCVKTISLIALICLRIGQEMVQQHLSEPVATFFQVFSQLHELRQQDLKLDPAGRGEGQLPQVVFSDGQQRPVDPALLDELQKVFTLEMAYTIYVPFSCLLGDIIRKIIPNHELVGELAALYLESISPSSRNPASVEPTMPGTGPEWDPHGGGCPQDDGHSGTFGSVLVGNRIQIPNDSRPENPGPLGPISGVGGGGLGSGSDDNALKQELPRSVHGLSGNWLAYWQYEIGVSQQDAHFHFHQIRLQSFPGHSGAVKCVAPLSSEDFFLSGSKDRTVRLWPLYNYGDGTSETAPRLVYTQHRKSVFFVGQLEAPQHVVSCDGAVHVWDPFTGKTLRTVEPLDSRVPLTAVAVMPAPHTSITMASSDSTLRFVDCRKPGLQHEFRLGGGLNPGLVRALAISPSGRSVVAGFSSGFMVLLDTRTGLVLRGWPAHEGDILQIKAVEGSVLVSSSSDHSLTVWKELEQKPTHHYKSASDPIHTFDLYGSEVVTGTVSNKIGVCSLLEPPSQATTKLSSENFRGTLTSLALLPTKRHLLLGSDNGVIRLLA

SEQ ID NO: 8059 - protein, 1748 aa, unidentified
MARAWQHPFLNVFRHFRVDEWKRSAKQGDVAVVTDKTLKGAVYRIRGSVSAANYIQLPKSSTQSLGLTGRYLYVLFRPLPSKHFVIHLDVSSKDNQVIRVSFSNLFKEFKSTATWLQFPLVLEARTPQRDLVGLAPSGARWTCLQLDLQDVLLVYLNRCYGHLKSIRLCASLLVRNLYTSDLCFEPAISGAQWAKLPVTPMPREMAFPVPKGESWHDRYIHVRFPSESLKVPSKPIEKSCSPPEAVLLGPGPQPLPCPVASSKPVRFSVSPVVQTPSPTASGRAALAPRPFPEVSLSQERSDASNADGPGFHSLEPWAQLEASDIHTAAAGTHVLTHESAEVPVARTGSCEGFLPDPVLRLKGVIGFGGHGTRQALWTPDGAAVVYPCHAVIVVLLVDTGEQRFFLGHTDKVSALALDGSSSLLASAQARAPSVMRLWDFQTGRCLCLFRSPMHVVCSLSFSDSGALLCGVGKDHHGRTMVVAWGTGQVGLGGEVVVLAKAHTDFDVQAFRVTFFDETRMASCGQGSVRLWRLRGGVLRSCPVDLGEHHALQFTDLAFKQARDGCPEPSAAMLFVCSRSGHILEIDCQRMVVRHARRLLPTRTPGGPHPQKQTFSSGPGIAISSLSVSPAMCAVGSEDGFLRLWPLDFSSVLLEAEHEGPVSSVCVSPDGLRVLSATSSGHLGFLDTLSRVYHMLARSHTAPVLALAMEQRRGQLATVSQDRTVRIWDLATLQQLYDFTSSEDAPCAVTFHPTRPTFFCGFSSGAVRSFSLEAAEVLVEHTCHRGAVTGLTATPDGRLLFSSCSQGSLAQYSCADPQWHVLRVAADMVCPDAPASPSALAVSRDGRLLAFVGPSRCTVTVMGSASLDELLRVDIGTLDLASSRLDSAMAVCFGPAALGHLLVSTSSNRVVVLDAVSGRIIRELPGVHPEPCPSLTLSEDARFLLIAAGRTIKVWDYATQASPGPQVYIGHSEPVQAVAFSPDQQQVLSAGDAVFLWDVLAPTESDQSFPGAPPACKTGPGAGPLEDAASRASELPRQQVPKPCQASPPRLGVCARPPEGGDGARDTRNSGAPRTTYLASCKAFTPARVSCSPHSAKGTCPPPASGGWLRLKAVVGYSGNGRANMVWRPDTGFFAYTCGRLVVVEDLHSGAQQHWSGHSAEISTLALSHSAQVLASASGRSSTTAHCQIRVWDVSGGLCQHLIFPHSTTVLALAFSPDDRLLVTLGDHDGRTLALWGTATYDLVSSTRLPEPVHGVAFNPWDAGELTCVGQGTVTFWLLQQRGADISLQVRREPVPEAVGAGELTSLCYGAPPLLYCGTSSGQVCVWDTRAGRCFLSWEADDGGIGLLLFSGSRLVSGSSTGRLRLWAVGAVSELRCKGSGASSVFMEHELVLDGAVVSASFDDSVDMGVVGTTAGTLWFVSWAEGTSTRLISGHRSKVNEVVFSPGESHCATCSEDGSVRVWALASMELVIQFQVLNQSCLCLAWSPPCCGRPEQQRLAAGYGDGSLRIFSVSRTAMELKMHPHPVALTTVAFSTDGQTVLSGDKDGLVAVSHPCTGTTFRVLSDHQGAPISTICVTCKECEDLGVEGTDLWLAASGDQRVSVWASDWLRNHCELVDWLSFPMPATTETQGHLPPSLAAFCPWDGALLMYVGPGVYKEVIIYNLCQKQVVEKIPLPFFAMSLSLSPGTHLLAVGFAECMLRLVDCAMGTAQDFAGHDNAVHLCRFTPSARLLFTAARNEILVWEVPGL

SEQ ID NO: 8060 - protein, 220 aa, unidentified
MPLTGVGPGSCRRQIIRALCLLLLLLHAGSAKNIWKRALPARLAEKSRAEEAGAPGGPRQPRADRCPPPPRTLPPGACQAARCQADSECPRHRRCCYNGCAYACLEAVPPPPVLDWLVQPKPRWLGGNGWLLDGPEEVLQAEACSTTEDGAEPLLCPSGYECHILSPGDVAEGIPNRGQCVKQRRQADGRILRHKLYKEYPEGDSKNVAEPGRGQQKHFQ

SEQ ID NO: 8061 - protein, 79 aa, unidentified
MAPQTLLPVLVLCVLLLQAQGGYRDKKRMQKTQLSPEIKVCQQQPKLYLCKHLCESHRDCQANNICCSTYCGNVCMSIL

SEQ ID NO: 8062 - protein, 73 aa, unidentified
MAPQTLLLVLVLCVLLLQAQGGYRDKMRMQRIKVCEKRPSIDLCIHHCSYFQKCETNKICCSAFCGNICMSIL

SEQ ID NO: 8063 - protein, 87 aa, unidentified
MVSLMKLWIPMLMTFFCTVLLSVLGEMRKKRYDRKELLLEECWGKPNVKECTNKCSKAFRCKDKNYTCCWTYCGNICWINVETSGDY

SEQ ID NO: 8064 - protein, 111 aa, unidentified
MGSSSFLVLMVSLVLVTLVAVEGVKEGIEKAGVCPADNVRCFKSDPPQCHTDQDCLGERKCCYLHCGFKCVIPVKELEEGGNKDEDVSRPYPEPGWEAKCPGSSSTRCPQK

SEQ ID NO: 8065 - protein, 93 aa, unidentified
MKPVLPLQFLVVFCLALQLVPGSPKQRVLKYILEPPPCISAPENCTHLCTMQEDCEKGFQCCSSFCGIVCSSETFQKRNRIKHKGSEVIMPAN

SEQ ID NO: 8066 - protein, 124 aa, unidentified
MPACRLGPLAAALLLSLLLFGFTLVSGTGAEKTGVCPELQADQNCTQECVSDSECADNLKCCSAGCATFCSLPNDKEGSCPQVNINFPQLGLCRDQCQVDSQCPGQMKCCRNGCGKVSCVTPNF

SEQ ID NO: 8067 - protein, 231 aa, unidentified
MMLSCLFLLKALLALGSLESWITAGEHAKEGECPPHKNPCKELCQGDELCPAEQKCCTTGCGRICRDIPKGRKRDCPRVIRKQSCLKRCITDETCPGVKKCCTLGCNKSCVVPISKQKLAEFGGECPADPLPCEELCDGDASCPQGHKCCSTGCGRTCLGDIEGGRGGDCPKVLVGLCIVGCVMDENCQAGEKCCKSGCGRFCVPPVLPPKLTMNPNWTVRSDSELEIPVP

SEQ ID NO: 8068 - protein, 224 aa, unidentified
MRTQSLLLLGALLAVGSQLPAVFGRKKGEKSGGCPPDDGPCLLSVPDQCVEDSQCPLTRKCCYRACFRQCVPRVSVKLGSCPEDQLRCLSPMNHLCHKDSDCSGKKRCCHSACGRDCRDPARGTAPGCPGQANSDLGSVALHLSWGPTERVHDGRPGALPAGQHYLYQRWFQPSDNHWPADTSLQPIHPWFLLLGVKVHSLSSEEGLCITPVLCTTAIRASHPS

SEQ ID NO: 8069 - protein, 131 aa, unidentified
MGLSGLLPILVPFILLGDIQEPGHAEGILGKPCPKIKVECEVEEIDQCTKPRDCPENMKCCPFSRGKKCLDFRKIYAVCHRRLAPAWPPYHTGGTIKKTKICSEFIYGGSQGNNNNFQTEAICLVTCKKYH

SEQ ID NO: 8070 - protein, 241 aa, unidentified
MWTVRTEGGHFPLHSPTFSWRNVAFLLLLSLALEWTSAMLTKKIKHKPGLCPKERLTCTTELPDSCNTDFDCKEYQKCCFFACQKKCMDPFQEPCMLPVRHGNCNHEAQRWHFDFKNYRCTPFKYRGCEGNANNFLNEDACRTACMLIVKDGQCPLFPFTERKECPPSCHSDIDCPQTDKCCESRCGFVCARAWTVKKGFCPRKPLLCTKIDKPKCLQDEECPLVEKCCSHCGLKCMDPRR

SEQ ID NO: 8071 - protein, 548 aa, unidentified
MPALRPLLPLLLLLRLTSGAGLLPGLGSHPGVCPNQLSPNLWVDAQSTCERECSRDQDCAAAEKCCINVCGLHSCVAARFPGSPAAPTTAASCEGFVCPQQGSDCDIWDGQPVCRCRDRCEKEPSFTCASDGLTYYNRCYMDAEACLRGLHLHIVPCKHVLSWPPSSPGPPETTARPTPGAAPVPPALYSSPSPQAVQVGGTASLHCDVSGRPPPAVTWEKQSHQRENLIMRPDQMYGNVVVTSIGQLVLYNARPEDAGLYTCTARNAAGLLRADFPLSVVQREPARDAAPSIPAPAECLPDVQACTGPTSPHLVLWHYDPQRGGCMTFPARGCDGAARGFETYEACQQACARGPGDACVLPAVQGPCRGWEPRWAYSPLLQQCHPFVYGGCEGNGNNFHSRESCEDACPVPRTPPCRACRLRSKLALSLCRSDFAIVGRLTEVLEEPEAAGGIARVALEDVLKDDKMGLKFLGTKYLEVTLSGMDWACPCPNMTAGDGPLVIMGEVRDGVAVLDAGSYVRAASEKRVKKILELLEKQACELLNRFQD

SEQ ID NO: 8072 - protein, 576 aa, unidentified
MWAPRCRRFWSRWEQVAALLLLLLLLGVPPRSLALPPIRYSHAGICPNDMNPNLWVDAQSTCRRECETDQECETYEKCCPNVCGTKSCVAARYMDVKGKKGPVGMPKEATCDHFMCLQQGSECDIWDGQPVCKCKDRCEKEPSFTCASDGLTYYNRCYMDAEACSKGITLAVVTCRYHFTWPNTSPPPPETTMHPTTASPETPELDMAAPALLNNPVHQSVTMGETVSFLCDVVGRPRPEITWEKQLEDRENVVMRPNHVRGNVVVTNIAQLVIYNAQLQDAGIYTCTARNVAGVLRADFPLSVVRGHQAAATSESSPNGTAFPAAECLKPPDSEDCGEEQTRWHFDAQANNCLTFTFGHCHRNLNHFETYEACMLACMSGPLAACSLPALQGPCKAYAPRWAYNSQTGQCQSFVYGGCEGNGNNFESREACEESCPFPRGNQRCRACKPRQKLVTSFCRSDFVILGRVSELTEEPDSGRALVTVDEVLKDEKMGLKFLGQEPLEVTLLHVDWACPCPNVTVSEMPLIIMGEVDGGMAMLRPDSFVGASSARRVRKLREVMHKKTCDVLKEFLGLH

SEQ ID NO: 8073 - protein, 907 aa, unidentified; identical to SEQ ID NO: 5265

SEQ ID NO: 8074 - protein, 379 aa, unidentified
MARRSAFPAAALWLWSILLCLLALRAEAGPPQEESLYLWIDAHQARVLIGFEEDILIVSEGKMAPFTHDFRKAQQRMPAIPVNIHSMNFTWQAAGQAEYFYEFLSLRSLDKGIMADPTVNVPLLGTVPHKASVVQVGFPCLGKQDGVAAFEVDVIVMNSEGNTILQTPQNAIFFKTCQQAECPGGCRNGGFCNERRICECPDGFHGPHCEKALCTPRCMNGGLCVTPGFCICPPGFYGVNCDKANCSTTCFNGGTCFYPGKCICPPGLEGEQCEISKCPQPCRNGGKCIGKSKCKCSKGYQGDLCSKPVCEPGCGAHGTCHEPNKCQCQEGWHGRHCNKRYEASLIHALRPAGAQLRQHTPSLKKAEERRDPPESNYIW

SEQ ID NO: 8075 - protein, 367 aa, unidentified
MRWFLPWTLAAVTAAAASTVLATALSPAPTTMDFTPAPLEDTSSRPQFCKWPCECPPSPPRCPLGVSLITDGCECCKMCAQQLGDNCTEAAICDPHRGLYCDYSGDRPRYAIGVCAQVVGVGCVLDGVRYNNGQSFQPNCKYNCTCIDGAVGCTPLCLRVRPPRLWCPHPRRVSIPGHCCEQWVCEDDAKRPRKTAPRDTGAFDAVGEVEAWHRNCIAYTSPWSPCSTSCGLGVSTRISNVNAQCWPEQESRLCNLRPCDVDIHTLIKAGKKCLAVYQPEASMNFTLAGCISTRSYQPKYCGVCMDNRCCIPYKSKTIDVSFQCPDGLGFSRQVLWINACFCNLSCRNPNDIFADLESYPDFSEIAN

SEQ ID NO: 8076 - protein, 250 aa, unidentified
MRGTPKTHLLAFSLLCLLSKVRTQLCPTPCTCPWPPPRCPLGVPLVLDGCGCCRVCARRLGEPCDQLHVCDASQGLVCQPGAGPGGRGALCLLAEDDSSCEVNGRLYREGETFQPHCSIRCRCEDGGFTCVPLCSEDVRLPSWDCPHPRRVEVLGKCCPEWVCGQGGGLGTQPLPAQGPQFSGLVSSLPPGVPCPEWSTAWGPCSTTCGLGMATRVSNQNRFCRLETQRRLCLSRPCPPSRGRSPQNSAF

SEQ ID NO: 8077 - protein, 354 aa, unidentified
MQGLLFSTLLLAGLAQFCCRVQGTGPLDTTPEGRPGEVSDAPQRKQFCHWPCKCPQQKPRCPPGVSLVRDGCGCCKICAKQPGEICNEADLCDPHKGLYCDYSVDRPRYETGVCAYLVAVGCEFNQVHYHNGQVFQPNPLFSCLCVSGAIGCTPLFIPKLAGSHCSGAKGGKKSDQSNCSLEPLLQQLSTSYKTMPAYRNLPLIWKKKCLVQATKWTPCSRTCGMGISNRVTNENSNCEMRKEKRLCYIQPCDSNILKTIKIPKGKTCQPTFQLSKAEKFVFSGCSSTQSYKPTFCGICLDKRCCIPNKSKMITIQFDCPNEGSFKWKMLWITSCVCQRNCREPGDIFSELKIL

SEQ ID NO: 8078 - protein, 2382 aa, unidentified
MSGGAAEKQSSTPGSLFLSPPAPAPKNGSSSDSSVGEKLGAAAADAVTGRTEEYRRRRHTMDKDSRGAAATTTTTEHRFFRRSVICDSNATALELPGLPLSLPQPSIPAAVPQSAPPEPHREETVTATATSQVAQQPPAAAAPGEQAVAGPAPSTVPSSTSKDRPVSQPSLVGSKEEPPPARSGSGGGSAKEPQEERSQQQDDIEELETKAVGMSNDGRFLKFDIEIGRGSFKTVYKGLDTETTVEVAWCELQDRKLTKSERQRFKEEAEMLKGLQHPNIVRFYDSWESTVKGKKCIVLVTELMTSGTLKTYLKRFKVMKIKVLRSWCRQILKGLQFLHTRTPPIIHRDLKCDNIFITGPTGSVKIGDLGLATLKRASFAKSVIGTPEFMAPEMYEEKYDESVDVYAFGMCMLEMATSEYPYSECQNAAQIYRRVTSGVKPASFDKVAIPEVKEIIEGCIRQNKDERYSIKDLLNHAFFQEETGVRVELAEEDDGEKIAIKLWLRIEDIKKLKGKYKDNEAIEFSFDLERDVPEDVAQEMVESGYVCEGDHKTMAKAIKDRVSLIKRKREQRQLVREEQEKKKQEESSLKQQVEQSSASQTGIKQLPSASTGIPTASTTSASVSTQVEPEEPEADQHQQLQYQQPSISVLSDGTVDSGQGSSVFTESRVSSQQTVSYGSQHEQAHSTGTVPGHIPSTVQAQSQPHGVYPPSSVAQGQSQGQPSSSSLTGVSSSQPIQHPQQQQGIQQTAPPQQTVQYSLSQTSTSSEATTAQPVSQPQAPQVLPQVSAGKQLPVSQPVPTIQGEPQIPVATQPSVVPVHSGAHFLPVGQPLPTPLLPQYPVSQIPISTPHVSTAQTGFSSLPITMAAGITQPLLTLASSATTAAIPGVSTVVPSQLPTLLQPVTQLPSQVHPQLLQPAVQSMGIPANLGQAAEVPLSSGDVLYQGFPPRLPPQYPGDSNIAPSSNVASVCIHSTVLSPPMPTEVLATPGYFPTVVQPYVESNLLVPMGGVGGQVQVSQPGGSLAQAPTTSSQQAVLESTQGVSQVAPAEPVAVAQTQATQPTTLASSVDSAHSDVASGMSDGNENVPSSSGRHEGRTTKRHYRKSVRSRSRHEKTSRPKLRILNVSNKGDRVVECQLETHNRKMVTFKFDLDGDNPEEIATIMVNNDFILAIERESFVDQVREIIEKADEMLSEDVSVEPEGDQGLESLQGKDDYGFSGSQKLEGEFKQPIPASSMPQQIGIPTSSLTQVVHSAGRRFIVSPVPESRLRESKVFPSEITDTVAASTAQSPGMNLSHSASSLSLQQAFSELRRAQMTEGPNTAPPNFSHTGPTFPVVPPFLSSIAGVPTTAAATAPVPATSSPPNDISTSVIQSEVTVPTEEGIAGVATSTGVVTSGGLPIPPVSESPVLSSVVSSITIPAVVSISTTSPSLQVPTSTSEIVVSSTALYPSVTVSATSASAGGSTATPGPKPPAVVSQQAAGSTTVGATLTSVSTTTSFPSTASQLCIQLSSSTSTPTLAETVVVSAHSLDKTSHSSTTGLAFSLSAPSSSSSPGAGVSSYISQPGGLHPLVIPSVIASTPILPQAAGPTSTPLLPQVPSIPPLVQPVANVPAVQQTLIHSQPQPALLPNQPHTHCPEVDSDTQPKAPGIDDIKTLEEKLRSLFSEHSSSGAQHASVSLETSLVIESTVTPGIPTTAVAPSKLLTSTTSTCLPPTNLPLGTVALPVTPVVTPGQVSTPVSTTTSGVKPGTAPSKPPLTKAPVLPVGTELPAGTLPSEQLPPFPGPSLTQSQQPLEDLDAQLRRTLSPEMITVTSAVGPVSMAAPTAITEAGTQPQKGVSQVKEGPVLATSSGAGVFKMGRFQVSVAADGAQKEGKNKSEDAKSVHFESSTSESSVLSSSSPESTLVKPEPNGITIPGISSDVPESAHKTTASEAKSDTGQPTKVGRFQVTTTANKVGRFSVSKTEDKITDTKKEGPVASPPFMDLEQAVLPAVIPKKEKPELSEPSHLNGPSSDPEAAFLSRDVDDGSGSPHSPHQLSSKSLPSQNLSQSLSNSFNSSYMSSDNESDIEDEDLKLELRRLRDKHLKEIQDLQSRQKHEIESLYTKLGKVPPAVIIPPAAPLSGRRRRPTKSKGSKSSRSSSLGNKSPQLSGNLSGQSAASVLHPQQTLHPPGNIPESGQNQLLQPLKPSPSSDNLYSAFTSDGAISVPSLSAPGQGTSSTNTVGATVNSQAAQAQPPAMTSSRKGTFTDDLHKLVDNWARDAMNLSGRRGSKGHMNYEGPGMARKFSAPGQLCISMTSNLGGSAPISAASATSLGHFTKSMCPPQQYGFPATPFGAQWSGTGGPAPQPLGQFQPVGTASLQNFNISNLQKSISNPPGSNLRTT

SEQ ID NO: 8079 - protein, 370 aa, unidentified
MGLWALLPGWVSATLLLALAALPAALAANSSGRWWGIVNVASSTNLLTDSKSLQLVLEPSLQLLSRKQRRLIRQNPGILHSVSGGLQSAVRECKWQFRNRRWNCPTAPGPHLFGKIVNRGCRETAFIFAITSAGVTHSVARSCSEGSIESCTCDYRRRGPGGPDWHWGGCSDNIDFGRLFGREFVDSGEKGRDLRFLMNLHNNEAGRTTVFSEMRQECKCHGMSGSCTVRTCWMRLPTLRAVGDVLRDRFDGASRVLYGNRGSNRASRAELLRLEPEDPAHKPPSPHDLVYFEKSPNFCTYSGRLGTAGTAGRACNSSSPALDGCELLCCGRGHRTRTQRVTERCNCTFHWCCHVSCRNCTHTRVLHECL

SEQ ID NO: 8080 - protein, 389 aa, unidentified
MLEEPRPRPPPSGLAGLLFLALCSRALSNEILGLKLPGEPPLTANTVCLTLSGLSKRQLGLCLRNPDVTASALQGLHIAVHECQHQLRDQRWNCSALEGGGRLPHHSAILKRGFRESAFSFSMLAAGVMHAVATACSLGKLVSCGCGWKGSGEQDRLRAKLLQLQALSRGKSFPHSLPSPGPGSSPSPGPQDTWEWGGCNHDMDFGEKFSRDFLDSREAPRDIQARMRIHNNRVGRQVVTENLKRKCKCHGTSGSCQFKTCWRAAPEFRAVGAALRERLGRAIFIDTHNRNSGAFQPRLRPRRLSGELVYFEKSPDFCERDPTMGSPGTRGRACNKTSRLLDGCGSLCCGRGHNVLRQTRVERCHCRFHWCCYVLCDECKVTEWVNVCK

SEQ ID NO: 8081 - protein, 354 aa, unidentified
MRARPQVCEALLFALALQTGVCYGIKWLALSKTPSALALNQTQHCKQLEGLVSAQVQLCRSNLELMHTVVHAAREVMKACRRAFADMRWNCSSIELAPNYLLDLERGTRESAFVYALSAAAISHAIARACTSGDLPGCSCGPVPGEPPGPGNRWGGCADNLSYGLLMGAKFSDAPMKVKKTGSQANKLMRLHNSEVGRQALRASLEMKCKCHGVSGSCSIRTCWKGLQELQDVAADLKTRYLSATKVVHRPMGTRKHLVPKDLDIRPVKDSELVYLQSSPDFCMKNEKVGSHGTQDRQCNKTSNGSDSCDLMCCGRGYNPYTDRVVERCHCKYHWCCYVTCRRCERTVERYVCK

SEQ ID NO: 8082 - protein, 365 aa, unidentified
MDRAALLGLARLCALWAALLVLFPYGAQGNWMWLGIASFGVPEKLGCANLPLNSRQKELCKRKPYLLPSIREGARLGIQECGSQFRHERWNCMITAAATTAPMGASPLFGYELSSGTKETAFIYAVMAAGLVHSVTRSCSAGNMTECSCDTTLQNGGSASEGWHWGGCSDDVQYGMWFSRKFLDFPIGNTTGKENKVLLAMNLHNNEAGRQAVAKLMSVDCRCHGVSGSCAVKTCWKTMSSFEKIGHLLKDKYENSIQISDKTKRKMRRREKDQRKIPIHKDDLLYVNKSPNYCVEDKKLGIPGTQGRECNRTSEGADGCNLLCCGRGYNTHVVRHVERCECKFIWCCYVRCRRCESMTDVHTCK

SEQ ID NO: 8083 - protein, 360 aa, unidentified
MNAPLGGIWLWLPLLLTWLTPEVNSSWWYMRATGGSSRVMCDNVPGLVSSQRQLCHRHPDVMRAISQGVAEWTAECQHQFRQHRWNCNTLDRDHSLFGRVLLRSSRESAFVYAISSAGVVFAITRACSQGEVKSCSCDPKKMGSAKDSKGIFDWGGCSDNIDYGIKFARAFVDAKERKGKDARALMNLHNNRAGRKAVKRFLKQECKCHGVSGSCTLRTCWLAMADFRKTGDYLWRKYNGAIQVVMNQDGTGFTVANERFKKPTKNDLVYFENSPDYCIRDREAGSLGTAGRVCNLTSRGMDSCEVMCCGRGYDTSHVTRMTKCGCKFHWCCAVRCQDCLEALDVHTCKAPKNADWTTAT

SEQ ID NO: 8084 - protein, 355 aa, unidentified
MEPHLLGLLLGLLLGGTRVLAGYPIWWSLALGQQYTSLGSQPLLCGSIPGLVPKQLRFCRNYIEIMPSVAEGVKLGIQECQHQFRGRRWNCTTIDDSLAIFGPVLDKATRESAFVHAIASAGVAFAVTRSCAEGTSTICGCDSHHKGPPGEGWKWGGCSEDADFGVLVSREFADARENRPDARSAMNKHNNEAGRTTILDHMHLKCKCHGLSGSCEVKTCWWAQPDFRAIGDFLKDKYDSASEMVVEKHRESRGWVETLRAKYSLFKPPTERDLVYYENSPNFCEPNPETGSFGTRDRTCNVTSHGIDGCDLLCCGRGHNTRTEKRKEKCHCIFHWCCYVSCQECIRIYDVHTCK

SEQ ID NO: 8085 - protein, 352 aa, unidentified
MAPLGYFLLLCSLKQALGSYPIWWSLAVGPQYSSLGSQPILCASIPGLVPKQLRFCRNYVEIMPSVAEGIKIGIQECQHQFRGRRWNCTTVHDSLAIFGPVLDKATRESAFVHAIASAGVAFAVTRSCAEGTAAICGCSSRHQGSPGKGWKWGGCSEDIEFGGMVSREFADARENRPDARSAMNRHNNEAGRQAIASHMHLKCKCHGLSGSCEVKTCWWSQPDFRAIGDFLKDKYDSASEMVVEKHRESRGWVETLRPRYTYFKVPTERDLVYYEASPNFCEPNPETGSFGTRDRTCNVSSHGIDGCDLLCCGRGHNARAERRREKCRCVFHWCCYVSCQECTRVYDVHTCK

SEQ ID NO: 8086 - protein, 380 aa, unidentified
MKKSIGILSPGVALGMAGSAMSSKFFLVALAIFFSFAQVVIEANSWWSLGMNNPVQMSEVYIIGAQPLCSQLAGLSQGQKKLCHLYQDHMQYIGEGAKTGIKECQYQFRHRRWNCSTVDNTSVFGRVMQIGSRETAFTYAVSAAGVVNAMSRACREGELSTCGCSRAARPKDLPRDWLWGGCGDNIDYGYRFAKEFVDARERERIHAKGSYESARILMNLHNNEAGRRTVYNLADVACKCHGVSGSCSLKTCWLQLADFRKVGDALKEKYDSAAAMRLNSRGKLVQVNSRFNSPTTQDLVYIDPSPDYCVRNESTGSLGTQGRLCNKTSEGMDGCELMCCGRGYDQFKTVQTERCHCKFHWCCYVKCKKCTEIVDQFVCK

SEQ ID NO: 8087 - protein, 359 aa, unidentified
MPSLLLLFTAALLSSWAQLLTDANSWWSLALNPVQRPEMFIIGAQPVCSQLPGLSPGQRKLCQLYQEHMAYIGEGAKTGIKECQHQFRQRRWNCSTADNASVFGRVMQIGSRETAFTHAVSAAGVVNAISRACREGELSTCGCSRTARPKDLPRDWLWGGCGDNVEYGYRFAKEFVDAREREKNFAKGSEEQGRVLMNLQNNEAGRRAVYKMADVACKCHGVSGSCSLKTCWLQLAEFRKVGDRLKEKYDSAAAMRVTRKGRLELVNSRFTQPTPEDLVYVDPSPDYCLRNESTGSLGTQGRLCNKTSEGMDGCELMCCGRGYNQFKSVQVERCHCKFHWCCFVRCKKCTEIVDQYICK

SEQ ID NO: 8088 - protein, 365 aa, unidentified
MLPPLPSRLGLLLLLLLCPAHVGGLWWAVGSPLVMDPTSICRKARRLAGRQAELCQAEPEVVAELARGARLGVRECQFQFRFRRWNCSSHSKAFGRILQQDIRETAFVFAITAAGASHAVTQACSMGELLQCGCQAPRGRAPPRPSGLPGTPGPPGPAGSPEGSAAWEWGGCGDDVDFGDEKSRLFMDARHKRGRGDIRALVQLHNNEAGRLAVRSHTRTECKCHGLSGSCALRTCWQKLPPFREVGARLLERFHGASRVMGTNDGKALLPAVRTLKPPGRADLLYAADSPDFCAPNRRTGSPGTRGRACNSSAPDLSGCDLLCCGRGHRQESVQLEENCLCRFHWCCVVQCHRCRVRKELSLCL

SEQ ID NO: 8089 - protein, 349 aa, unidentified
MHRNFRKWIFYVFLCFGVLYVKLGALSSVVALGANIICNKIPGLAPRQRAICQSRPDAIIVIGEGAQMGINECQYQFRFGRWNCSALGEKTVFGQELRVGSREAAFTYAITAAGVAHAVTAACSQGNLSNCGCDREKQGYYNQAEGWKWGGCSADVRYGIDFSRRFVDAREIKKNARRLMNLHNNEAGRKVLEDRMQLECKCHGVSGSCTTKTCWTTLPKFREVGHLLKEKYNAAVQVEVVRASRLRQPTFLRIKQLRSYQKPMETDLVYIEKSPNYCEEDAATGSVGTQGRLCNRTSPGADGCDTMCCGRGYNTHQYTKVWQCNCKFHWCCFVKCNTCSERTEVFTCK

SEQ ID NO: 8090 - protein, 351 aa, unidentified
MGNLFMLWAALGICCAAFSASAWSVNNFLITGPKAYLTYTTSVALGAQSGIEECKFQFAWERWNCPENALQLSTHNRLRSATRETSFIHAISSAGVMYIITKNCSMGDFENCGCDGSNNGKTGGHGWIWGGCSDNVEFGERISKLFVDSLEKGKDARALMNLHNNRAGRLAVRATMKRTCKCHGISGSCSIQTCWLQLAEFREMGDYLKAKYDQALKIEMDKRQLRAGNSAEGHWVPAEAFLPSAEAELIFLEESPDYCTCNSSLGIYGTEGRECLQNSHNTSRWERRSCGRLCTECGLQVEERKTEVISSCNCKFQWCCTVKCDQCRHVVSKYYCARSPGSAQSLGKGSA

SEQ ID NO: 8091 - protein, 351 aa, unidentified
MFLSKPSVYICLFTCVLQLSHSWSVNNFLMTGPKAYLIYSSSVAAGAQSGIEECKYQFAWDRWNCPERALQLSSHGGLRSANRETAFVHAISSAGVMYTLTRNCSLGDFDNCGCDDSRNGQLGGQGWLWGGCSDNVGFGEAISKQFVDALETGQDARAAMNLHNNEAGRKAVKGTMKRTCKCHGVSGSCTTQTCWLQLPEFREVGAHLKEKYHAALKVDLLQGAGNSAAGRGAIADTFRSISTRELVHLEDSPDYCLENKTLGLLGTEGRECLRRGRALGRWERRSCRRLCGDCGLAVEERRAETVSSCNCKFHWCCAVRCEQCRRRVTKYFCSRAERPRGGAAHKPGRKP

SEQ ID NO: 8092 - protein, 365 aa, unidentified
MLDGSPLARWLAAAFGLTLLLAALRPSAAYFGLTGSEPLTILPLTLEPEAAAQAHYKACDRLKLERKQRRMCRRDPGVAETLVEAVSMSALECQFQFRFERWNCTLEGRYRASLLKRGFKETAFLYAISSAGLTHALAKACSAGRMERCTCDEAPDLENREAWQWGGCGDNLKYSSKFVKEFLGRRSSKDLRARVDFHNNLVGVKVIKAGVETTCKCHGVSGSCTVRTCWRQLAPFHEVGKHLKHKYETALKVGSTTNEAAGEAGAISPPRGRASGAGGSDPLPRTPELVHLDDSPSFCLAGRFSPGTAGRRCHREKNCESICCGRGHNTQSRVVTRPCQCQVRWCCYVECRQCTQREEVYTCKG

SEQ ID NO: 8093 - protein, 357 aa, unidentified
MRPPPALALAGLCLLALPAAAASYFGLTGREVLTPFPGLGTAAAPAQGGAHLKQCDLLKLSRRQKQLCRREPGLAETLRDAAHLGLLECQFQFRHERWNCSLEGRMGLLKRGFKETAFLYAVSSAALTHTLARACSAGRMERCTCDDSPGLESRQAWQWGVCGDNLKYSTKFLSNFLGSKRGNKDLRARADAHNTHVGIKAVKSGLRTTCKCHGVSGSCAVRTCWKQLSPFRETGQVLKLRYDSAVKVSSATNEALGRLELWAPARQGSLTKGLAPRSGDLVYMEDSPSFCRPSKYSPGTAGRVCSREASCSSLCCGRGYDTQSRLVAFSCHCQVQWCCYVECQQCVQEELVYTCKH

SEQ ID NO: 8094 - protein, 421 aa, unidentified
MASFPPRVNEKEIVRLRTIGELLAPAAPFDKKCGRENWTVAFAPDGSYFAWSQGHRTVKLVPWSQCLQNFLLHGTKNVTNSSSLRLPRQNSDGGQKNKPREHIIDCGDIVWSLAFGSSVPEKQSRCVNIEWHRFRFGQDQLLLATGLNNGRIKIWDVYTGKLLLNLVDHTEVVRDLTFAPDGSLILVSASRDKTLRVWDLKDDGNMMKVLRGHQNWVYSCAFSPDSSMLCSVGASKAVFLWNMDKYTMIRKLEGHHHDVVACDFSPDGALLATASYDTRVYIWDPHNGDILMEFGHLFPPPTPIFAGGANDRWVRSVSFSHDGLHVASLADDKMVRFWRIDEDYPVQVAPLSNGLCCAFSTDGSVLAAGTHDGSVYFWATPRQVPSLQHLCRMSIRRVMPTQEVQELPIPSKLLEFLSYRI

SEQ ID NO: 8095 - protein, 575 aa, unidentified
MAKPFFRLQKFLRRTQFLLFFLTAAYLMTGSLLLLQRVRVALPQGPRAPGPLQTLPVAAVALGVGLLDSRALHDPRVSPELLLGVDMLQSPLTRPRPGPRWLRSRNSELRQLRRRWFHHFMSDSQGPPALGPEAARPAIHSRGTYIGCFSDDGHERTLKGAVFYDLRKMTVSHCQDACAERSYVYAGLEAGAECYCGNRLPAVSVGLEECNHECKGEKGSVCGAVDRLSVYRVDELQPGSRKRRTATYRGCFRLPENITHAFPSSLIQANVTVGTCSGFCSQKEFPLAILRGWECYCAYPTPRFNLRDAMDSSVCGQDPEAQRLAEYCEVYQTPVQDTRCTDRRFLPNKSKVFVALSSFPGAGNTWARHLIEHATGFYTGSYYFDGTLYNKGFKGEKDHWRSRRTICVKTHESGRREIEMFDSAILLIRNPYRSLVAEFNRKCAGHLGYAADRNWKSKEWPDFVNSYASWWSSHVLDWLKYGKRLLVVHYEELRRSLVPTLREMVAFLNVSVSEERLLCVENNKEGSFRRRGRRSHDPEPFTPEMKDLINGYIRTVDQALRDHNWTGLPREYVPR

SEQ ID NO: 8096 - protein, 565 aa, unidentified
MAKLWFKFQRYFRRKPVRFFTFLALYLTAGSLVFLHSGFVGQPAVSGNQANPAAAGGPAEGAELSFLGDMHLGRGFRDTGEASSIARRYGPWFKGKDGNERAKLGDYGGAWSRALKGRVVREKEEERAKYIGCYLDDTQSRALRGVSFFDYKKMTIFRCQDNCAERGYLYGGLEFGAECYCGHKIQATNVSEAECDMECKGERGSVCGGANRLSVYRLQLAQESARRYGSAVFRGCFRRPDNLSLALPVTAAMLNMSVDKCVDFCTEKEYPLAALAGTACHCGFPTTRFPLHDREDEQLCAQKCSAEEFESCGTPSYFIVYQTQVQDNRCMDRRFLPGKSKQLIALASFPGAGNTWARHLIELATGFYTGSYYFDGSLYNKGFKGERDHWRSGRTICIKTHESGQKEIEAFDAAILLIRNPYKALMAEFNRKYGGHIGFAAHAHWKGKEWPEFVRNYAPWWATHTLDWLKFGKKVLVVHFEDLKQDLFVQLGRMVSLLGVAVREDRLLCVESQKDGNFKRSGLRKLEYDPYTADMQKTISAYIKMVDAALKGRNLTGVPDDYYPR

SEQ ID NO: 8097 - protein, 114 aa, unidentified
MRLLILALLGICSLTAYIVEGVGSEVSDKRTCVSLTTQRLPVSRIKTYTITEGSLRAVIFITKRGLKVCADPQATWVRDVVRSMDRKSNTRNNMIQTKPTGTQQSTNTAVTLTG

SEQ ID NO: 8098 - protein, 114 aa, unidentified
MRLLILALLGICSLTAYIVEGVGSEVSHRRTCVSLTTQRLPVSRIKTYTITEGSLRAVIFITKRGLKVCADPQATWVRDVVRSMDRKSNTRNNMIQTKPTGTQQSTNTAVTLTG

SEQ ID NO: 8099 - protein, 674 aa, unidentified
MARAHWGCCPWLVLLCACAWGHTKPVDLGGQDVRNCSTNPPYLPVTVVNTTMSLTALRQQMQTQNLSAYIIPGTDAHMNEYIGQHDERRAWITGFTGSAGTAVVTMKKAAVWTDSRYWTQAERQMDCNWELHKEVGTTPIVTWLLTEIPAGGRVGFDPFLLSIDTWESYDLALQGSNRQLVSITTNLVDLVWGSERPPVPNQPIYALQEAFTGSTWQEKVSGVRSQMQKHQKVPTAVLLSALEETAWLFNLRASDIPYNPFFYSYTLLTDSSIRLFANKSRFSSETLSYLNSSCTGPMCVQIEDYSQVRDSIQAYSLGDVRIWIGTSYTMYGIYEMIPKEKLVTDTYSPVMMTKAVKNSKEQALLKASHVRDAVAVIRYLVWLEKNVPKGTVDEFSGAEIVDKFRGEEQFSSGPSFETISASGLNAALAHYSPTKELNRKLSSDEMYLLDSGGQYWDGTTDITRTVHWGTPSAFQKEAYTRVLIGNIDLSRLIFPAATSGRMVEAFARRALWDAGLNYGHGTGHGIGNFLCVHEWPVGFQSNNIAMAKGMFTSIEPGYYKDGEFGIRLEDVALVVEAKTKYPGSYLTFEVVSFVPYDRNLIDVSLLSPEHLQYLNRYYQTIREKVGPELQRRQLLEEFEWLQQHTEPLAARAPDTASWASVLVVSTLAILGWSV

SEQ ID NO: 8100 - protein, 393 aa, unidentified
MGLLRGGLPCARAMARLGAVRSHYCALLLAAALAVCAFYYLGSGRETFSSATKRLKEARAGAPAAPSPPALELARGSVAPAPGAKAKSLEGGGAGPVDYHLLMMFTKAEHNAALQAKARVALRSLLRLAKFEAHEVLNLHFVSEEASREVAKGLLRELLPPAAGFKCKVIFHDVAVLTDKLFPIVEAMQKHFSAGLGTYYSDSIFFLSVAMHQIMPKEILQIIQLDLDLKFKTNIRELFEEFDSFLPGAIIGIAREMQPVYRHTFWQFRHENPQTRVGGPPPEGLPGFNSGVMLLNLEAMRQSPLYSRLLEPAQVQQLADKYHFRGHLGDQDFFTMIGMEHPKLFHVLDCTWNRQLCTWWRDHGYSDVFEAYFRCEGHVKIYHGNCNTPIPED

SEQ ID NO: 8101 - protein, 959 aa, unidentified
MVAAPCARRLARRSHSALLAALTVLLLQTLVVWNFSSLDSGAGERRGGAAVGGGEQPPPAPAPRRERRDLPAEPAAARGGGGGGGGGGGGRGPQARARGGGPGEPRGQQPASRGALPARALDPHPSPLITLETQDGYFSHRPKEKVRTDSNNENSVPKDFENVDNSNFAPRTQKQKHQPELAKKPPSRQKELLKRKLEQQEKGKGHTFPGKGPGEVLPPGDRAAANSSHGKDVSRPPHARKTGGSSPETKYDQPPKCDISGKEAISALSRAKSKHCRQEIGETYCRHKLGLLMPEKVTRFCPLEGKANKNVQWDEDSVEYMPANPVRIAFVLVVHGRASRQLQRMFKAIYHKDHFYYIHVDKRSNYLHRQVLQVSRQYSNVRVTPWRMATIWGGASLLSTYLQSMRDLLEMTDWPWDFFINLSAADYPIRTNDQLVAFLSRYRDMNFLKSHGRDNARFIRKQGLDRLFLECDAHMWRLGDRRIPEGIAVDGGSDWFLLNRRFVEYVTFSTDDLVTKMKQFYSYTLLPAESFFHTVLENSPHCDTMVDNNLRITNWNRKLGCKCQYKHIVDWCGCSPNDFKPQDFHRFQQTARPTFFARKFEAVVNQEIIGQLDYYLYGNYPAGTPGLRSYWENVYDEPDGIHSLSDVTLTLYHSFARLGLRRAETSLHTDGENSCRYYPMGHPASVHLYFLADRFQGFLIKHHATNLAVSKLETLETWVMPKKVFKIASPPSDFGRLQFSEVGTDWDAKERLFRNFGGLLGPMDEPVGMQKWGKGPNVTVTVIWVDPVNVIAATYDILIESTAEFTHYKPPLNLPLRPGVWTVKILHHWVPVAETKFLVAPLTFSNRQPIKPEEALKLHNGPLRNAYMEQSFQSLNPVLSLPINPAQVEQARRNAASTGTALEGWLDSLVGGMWTAMDICATGPTACPVMQTCSQTAWSSFSPDPKSELGAVKPDGRLR

SEQ ID NO: 8102 - protein, 865 aa, unidentified [sequence omitted]

SEQ ID NO: 8103 - protein, 234 aa, unidentified
MSSEVSARRDAKKLVRSPSGLRMVPEHRAFGSPFGLEEPQWVPDKECRRCMQCDAKFDFLTRKHHCRRCGKCFCDRCCSQKVPLRRMCFVDPVRQCAECALVSLKEAEFYDKQLKVLLSGATFLVTFGNSEKPETMTCRLSNNQRYLFLDGDSHYEIEIVHISTVQILTEGFPPGGGNARATGMFLQYTVPGTEGVTQLKLTVVEDVTVGRRQAVAWLVAMHKAAKLLYESRDQ

SEQ ID NO: 8104 - protein, 167 aa, unidentified
MLTVALLALLCASASGNAIQARSSSYSGEYGGGGGKRFSHSGNQLDGPITALRVRVNTYYIVGLQVRYGKVWSDYVGGRNGDLEEIFLHPGESVIQVSGKYKWYLKKLLFVTDKGRYLSFGKDSGTSFNAVPLHPNTVLRFISGRSGSLIDAIGLHWDVYPSSCSRC

SEQ ID NO: 8105 - protein, 208 aa, unidentified
MGAQGAQESIKAMWRVPGTTRRPVTGESPGMHRPEAMLLLLTLALLGGPTWAGKMYGPGGGKYFSTTEDYDHEITGLRVSVGLLLVKSVQVKLGDSWDVKLGALGGNTQEVTLQPGEYITKVFVAFQAFLRGMVMYTSKDRYFYFGKLDGQISSAYPSQEGQVLVGIYGQYQLLGIKSIGFEWNYPLEEPTTEPPVNLTYSANSPVGR

SEQ ID NO: 8106 - protein, 334 aa, unidentified
MRYKTSLVMRKRLRLYRNTLKESSSSSGHHGPQLTAASSPSVFPGLHEEPPQASPSRPLNGLLRLGLPGDMYARPEPFPPGPAARSDALAAAAALHGYGGMNLTVNLAAPHGPGAFFRYMRQPIKQELICKWLAADGTATPSLCSKTFSTMHELVTHVTVEHVGGPEQANHICFWEECPRQGKPFKAKYKLVNHIRVHTGEKPFPCPFPGCGKVFARSENLKIHKRTHTGEKPFRCEFEGCERRFANSSDRKKHSHVHTSDKPYTCKVRGCDKCYTHPSSLRKHMKVHGRSPPPSSGYDSATPSALVSPSSDCGHKSQVASSAAVAARTADLSE

SEQ ID NO: 8107 - protein, 478 aa, unidentified
MGRKKKKQLKPWCWYCNRDFDDEKILIQHQKAKHFKCHICHKKLYTGPGLAIHCMQVHKETIDAVPNAIPGRTDIELEIYGMEGIPEKDMDERRRLLEQKTQESQKKKQQDDSDEYDDDDSAASTSFQPQPVQPQQGYIPPMAQPGLPPVPGAPGMPPGIPPLMPGVPPLMPGMPPVMPGMPPGMMPMGGMMPPGPGIPPLMPGMPPGMPPPVPRPGIPPMTQAQAVSAPGILNRPPAPTATVPAPQPPVTKPLFPSAGQMGTPVTSSSTASSNSESLSASSKALFPSTAQAQAAVQGPVGTDFKPLNSTPATTTEPPKPTFPAYTQSTASTTSTTNSTAAKPAASITSKPATLTTTSATSKLIHPDEDISLEERRAQLPKYQRNLPRPGQAPIGNPPVGPIGGMMPPQPGIPQQQGMRPPMPPHGQYGGHHQGMPGYLPGAMPPYGQGPPMVPPYQGGPPRPPMGMRPPVMSQGGRY

SEQ ID NO: 8108 - protein, 533 aa, unidentified
MATSFRTASCWGLLSFKDISMEFTWDEWQLLDSTQKYLYRDVILENYHNLISVGYHGTKPDLIFKLEQGEDPWIINAKISRQSCPDGWEEWYQNNQDELESIERSYACSVLGRLNLSKTHDSSRQRLYNTRGKSLTQNSAPSRSYLRKNPDKFHGYEEPYFLKHQRAHSIEKNCVCSECGKAFRCKSQLIVHLRIHTGERPYECSKCERAFSAKSNLNAHQRVHTGEKPYSCSECEKVFSFRSQLIVHQEIHTGGKPYGCSECGKAYSWKSQLLLHQRSHTGVKPYECSECGKAFSLKSPFVVHQRTHTGVKPHKCSECGKAFRSKSYLLVHIRMHTGEKPYQCSDCGKAFNMKTQLIVHQGVHTGNNPYQCGECGKAFGRKEQLTAHLRAHAGEKPYGCSECGKAFSSKSYLVIHRRTHTGERPYECSLCERAFCGKSQLIIHQRTHSTEKPYECNECEKAYPRKASLQIHQKTHSGEKPFKCSECGKAFTQKSSLSEHQRVHTGEKPWKCSECGKSFCWNSGLRIHRKTHK

SEQ ID NO: 8109 - protein, 560 aa, unidentified
MLLLLSDQLLLTALRKPNPQAMAALFLSAPPQAEVTFEDVAVYLSREEWGRLGPAQRGLYRDVMLETYGNLVSLGVGPAGPKPGVISQLERGDEPWVLDVQGTSGKEHLRVNSPALGTRTEYKELTSQETFGEEDPQGSEPVEACDHISKSEGSLEKLVEQRGPRAVTLTNGESSRESGGNLRLLSRPVPDQRPHKCDICEQSFEQRSYLNNHKRVHRSKKTNTVRNSGEIFSANLVVKEDQKIPTGKKLHYCSYCGKTFRYSANLVKHQRLHTEEKPYKCDECGKAFSQSCEFINHRRMHSGEIPYRCDECGKTFTRRPNLMKHQRIHTGEKPYKCGECGKHFSAYSSLIYHQRIHTGEKPYKCNDCGKAFSDGSILIRHRRTHTGEKPFECKECGKGFTQSSNLIQHQRIHTGEKPYKCNECEKAFIQKTKLVEHQRSHTGEKPYECNDCGKVFSQSTHLIQHQRIHTGEKPYKCSECGKAFHNSSRLIHHQRLHHGEKPYRCSDCKKAFSQSTYLIQHRRIHTGEKPYKCSECGKAFRHSSNMCQHQRIHLREDFSM

SEQ ID NO: 8110 - protein, 510 aa, unidentified
MAAAALRDPAQVPVAADLLTDHEEGYVTFEDVAVYFSQEEWRLLDDAQRLLYRNVMLENFTLLASLGLASSKTHEITQLESWEEPFMPAWEVVTSAIPRGCWHGAEAEEAPEQIASVGLLSSNIQQHQKQHCGEKPLKRQEGRVPVLRSCKVHLSEKSLQSREVGKALLISSGVLKHQVTHTGEKSHRSSKSREAFHAGKRHYKCSECGKAFGQKYLLVQHQRLHAGKKTYECSECGKLFRDMSNLFIHQIVHTGERPYGCSNCGKSFSRNAHLIEHQRVHTGEKPFTCSECGKAFRHNSTLVQHHKIHTGVRPYECSECGKLFSFNSSLMKHQRIHTGERPYKCSECGKFYSHKSNLIKHWRVHTGERPYKCSDCGKFFTQCSSLMQHQKVHTGEKPFKCNECGRFFRENSTLVRHQRVHTGAKPYECRECGKFFSQSSTLMQHRKVHIGEKPFKCNECGRLFRENSSLVKHQRVHTGAKPYECRECGKFFRHNSSLFKHRRIHTGEMQ

SEQ ID NO: 8111 - protein, 673 aa, unidentified
MMFQDSVAFEDVAVTFTQEEWALLDPSQKNLCRDVMQETFRNLASIGKKWKPQNIYVEYENLRRNLRIVGERLFESKEGHQHGEILTQVPDDMLKKTTTGVKSCESSVYGEVGSAHSSLNRHIRDDTGHKAYEYQEYGQKPYKCKYCKKPFNCLSSVQTHERAHSGRKLYVCEECGKTFISHSNLQRHRIMHRGDGPYKCKFCGKALMFLSLYLIHKRTHTGEKPYQCKQCGKAFSHSSSLRIHERTHTGEKPYKCNECGKAFHSSTCLHAHKRTHTGEKPYECKQCGKAFSSSHSFQIHERTHTGEKPYECKECGKAFKCPSSVRRHERTHSRKKPYECKHCGKVLSYLTSFQNHLGMHTGEISHKCKICGKAFYSPSSLQTHEKTHTGEKPYKCNQCGKAFNSSSSFRYHERTHTGEKPYECKQCGKAFRSASLLQTHGRTHTGEKPYACKECGKPFSNFSFFQIHERMHREEKPYECKGYGKTFSLPSLFHRHERTHTGGKTYECKQCGRSFNCSSSFRYHGRTHTGEKPYECKQCGKAFRSASQLQIHGRTHTGEKPYECKQCGKAFGSASHLQMHGRTHTGEKPYECKQCGKSFGCASRLQMHGRTHTGEKPYKCKQCGKAFGCPSNLRRHGRTHTGEKPYKCNQCGKVFRCSSQLQVHGRAHCIDTP

SEQ ID NO: 8112 - protein, 828 aa, unidentified
MQNSVSVPPKDEGESNIPSGTIQSRKGLQNKSQFRTIAPKIVPKVLTSRMLPCHSPSRSDQVNLGPSINSKLLGMSTQNYALMQVAGQEGTFSLVALPHVASAQPIQKPRMSLPENLKLPIPRYQPPRNSKASRKKPILIFPKSGCSKAPAQTQMCPQMSPSPPHHPELLYKPSPFEEVPSLEQAPASISTAALTNGSDHGDLRPPVTNTHGSLNPPATPASSTPEEPAKQDLTALSGKAHFVSKITSSKPSAVASEKFKEQVDLAKTMTNLSPTILGNAVQLISSVPKGKLPIPPYSRMKTMEVYKIKSDANIAGFSLPGPKADCDKIPSTTEGFNAATKVASRLPVPQVSQQSACESAFCPPTKLDLNHKTKLNSGAAKRKGRKRKVPDEILAFQGKRRKYIINKCRDGKERVKNDPQEFRDQKLGTLKKYRSIMPKPIMVIPTLASLASPTTLQSQMLGGLGQDVLLNNSLTPKYLGCKQDNSSSPKPSSVFRNGFSGIKKPWHRCHVCNHHFQFKQHLRDHMNTHTNRRPYSCRICRKSYVRPGSLSTHMKLHHGENRLKKLMCCEFCAKVFGHIRVYFGHLKEVHRVVISTEPAPSELQPGDIPKNRDMSVRGMEGSLERENKSNLEEDFLLNQADEVKLQIKCGRCQITAQSFAEIKFHLLDVHGEEIEGRLQEGTFPGSKGTQEELVQHASPDWKRHPERGKPEKVHSSSEESHACPRLKRQLHLHQNGVEMLMENEGPQSGTNKPRETCQGPECPGLHTFLLWSHSGFNCLLCAEMLGRKEDLLHHWKHQHNCEDPSKLWAILNTVSNQGVIELSSEAEK

SEQ ID NO: 8113 - protein, 518 aa, unidentified
MAVALGCAIQASLNQGSVFQEYDTDCEVFRQRFRQFQYREAAGPHEAFNKLWELCCQWLKPKMRSKEQILELLVLEQFLTILPTEIETWVREHCPENRERVVSLIEDLQRELEIPEQQVDMHDMLLEELAPVGTAHIPPTMHLESPALQVMGPAQEAPVAEAWIPQAGPPELNYGATGECQNFLDPGYPLPKLDMNFSLENREEPWVKELQDSKEMKQLLDSKIGFEIGIENEEDTSKQKKMETMYPFIVTLEGNALQGPILQKDYVQLENQWETPPEDLQTDLAKLVDQQNPTLGETPENSNLEEPLNPKPHKKKSPGEKPHRCPQCGKCFARKSQLTGHQRIHSGEEPHKCPECGKRFLRSSDLYRHQRLHTGERPYECTVCKKRFTRRSHLIGHQRTHSEEETYKCLECGKSFCHGSSLKRHLKTHTGEKPHRCHNCGKSFSRLTALTLHQRTHTEERPFKCNYCGKSFRQRPSLVIHLRIHTGEKPYKCTHCSKSFRQRAGLIMHQVTHFRGLI

SEQ ID NO: 8114 - protein, 340 aa, unidentified
MPEWPPCLSVAPALVITMAAGKGAPLSPSAENRWRLSEPELGRGCKPVLLEKTNRLGPEAAVGRAGRDVGSAELALLVAPGKPRPGKPLPPKTRGEQRQSAFTELPRMKDRQVDAQAQEREHDDPTGQPGAPQLTQNIPRGPAGSKVFSVWPSGARSEQRSAFSKPTKRPAERPELTSVFPAGESADALGELSGLLNTTDLACWGRLSTPKLLVGDLWNLQALPQNAPLCSTFLGAPTLWLEHTQAQVPPPSSSSTTSWALLPPTLTSLGLSTQNWCAKCNLSFRLTSDLVFHMRSHHKKEHAGPDPHSQKRREEALACPVCQEHFRERHHLSRHMTSHS

SEQ ID NO: 8115 - protein, 252 aa, unidentified; identical to SEQ ID NO: 5329

SEQ ID NO: 8116 - protein, 536 aa, unidentified
MAVGLLKAMYQELVTFRDVAVDFSQEEWDCLDSSQRHLYSNVMLENYRILVSLGLCFSKPSVILLLEQGKAPWMVKRELTKGLCSGWEPICETEELTPKQDFYEEHQSQKIIETLTSYNLEYSSLREEWKCEGYFERQPGNQKACFKEEIITHEEPLFDEREQEYKSWGSFHQNPLLCTQKIIPKEEKVHKHDTQKRSFKKNLMAIKPKSVCAEKKLLKCNDCEKVFSQSSSLTLHQRIHTGEKPYKCIECGKAFSQRSNLVQHQRIHTGEKPYECKECRKAFSQNAHLVQHLRVHTGEKPYECKVCRKAFSQFAYLAQHQRVHTGEKPYECIECGKAFSNRSSIAQHQRVHTGEKPYECNVCGKAFSLRAYLTVHQRIHTGERPYECKECGKAFSQNSHLAQHQRIHTGEKPYKCQECRKAFSQIAYLAQHQRVHTGEKPYECIECGKAFSNDSSLTQHQRVHTGEKPYECTVCGKAFSYCGSLAQHQRIHTGERPYECKECKKTFRQHAHLAHHQRIHIGESLSPPNPVNHQVL

SEQ ID NO: 8117 - protein, 315 aa, unidentified
MSLCSPTHSAEMSLFLQGPEEMLPLSSEGSEMGSEKEQSPEPHLPEEGEGGKPWRVDDSEGSWIPPGEKEHGQESLSDELQETHPKKPWQKVTVRARELGDPIAHPRHEADEKPFICAQCGKTFNNTSNLRTHQRIHTGEKPYKCSECGKSFSRSSNRIRHERIHLEEKHYKCPKCQESFRRRSDLTTHQQDHLGKRPYRCDICGKSFSQSATLAVHHRTHLEPAPYICCECGKSFSNSSSFGVHHRTHTGERPYECTECGRTFSDISNFGAHQRTHRGEKPYRCTVCGKHFSRSSNLIRHQKTHLGEQAGKDSS

SEQ ID NO: 8118 - protein, 572 aa, unidentified
MPGPLGSLEMGVLTFRDVALEFSLEEWQCLDTAQQNLYRNVMLENYRNLVFVGIAASKPDLITCLEQGKEPWNVKRHEMVTEPPVVYSYFAQDLWPKQGKKNYFQKVILRTYKKCGRENLQLRKYCKSMDECKVHKECYNGLNQCLTTTQNKIFQYDKYVKVFHKFSNSNRHKIGHTGKKSFKCKECEKSFCMLSHLAQHKRIHSGEKPYKCKECGKAYNEASNLSTHKRIHTGKKPYKCEECGKAFNRLSHLTTHKIIHTGKKPYKCEECGKAFNQSANLTTHKRIHTGEKPYKCEECGRAFSQSSTLTAHKIIHAGEKPYKCEECGKAFSQSSTLTTHKIIHTGEKFYKCEECGKAFSRLSHLTTHKRIHSGEKPYKCEECGKAFKQSSTLTTHKRIHAGEKFYKCEVCSKAFSRFSHLTTHKRIHTGEKPYKCEECGKAFNLSSQLTTHKIIHTGEKPYKCEECGKAFNQSSTLSKHKVIHTGEKPYKCEECGKAFNQSSHLTTHKMIHTGEKPYKCEECGKAFNNSSILNRHKMIHTGEKLYKPESCNNACDNIAKISKYKRNCAGEK

SEQ ID NO: 8119 - protein, 351 aa, unidentified
MEAFALGPARRGRRRTRAAGSLLSRAAILLFISAFLVRVPSSVGHLVRLPRAFRLTKDSVKIVGSTSFPVKAYVMLHQKSPHVLCVTQQLRNAELIDPSFQWYGPKGKVVSVENRTAQITSTGSLVFQNFEESMSGIYTCFLEYKPTVEEIVKRLQLKYAIYAYREPHYYYQFTARYHAAPCNSIYNISFEKKLLQILSKLLLDLSCEISLLKSECHRVKMQRAGLQNELFFAFSVSSLDTEKGPKRCTDHNCEPYKRLFKAKNLIERFFNQQVEILGRRAEQLPQIYYIEGTLQMVWINRCFPGYGMNVQQHPKCPECCVICSPGSYNPRDGIHCLQCNSSLVYGAKTCL

SEQ ID NO: 8120 - protein, 338 aa, unidentified
MMRTCVLLSAVLWCLTGVQCPRFTLFNKKGFIYGKTGQPDKIYVELHQNSPVLICMDFKLSKKEIVDPTYLWIGPNEKTLTGNNRINITETGQLMVKDFLEPLSGLYTCTLSYKTVKAETQEEKTVKKRYDFMVFAYREPDYSYQMAVRFTTRSCIGRYNDVFFRVLKKILDSLISDLSCHVIEPSYKCHSVEIPEHGLIHELFIAFQVNPFAPGWKGACNGSVDCEDTTNHNILQARDRIEDFFRSQAYIFYHNFNKTLPAMHFVDHSLQVVRLDSCRPGFGKNERLHSNCASCCVVCSPATFSPDVNVTCQTCVSVLTYGAKSCPQTSNKNQQYED

SEQ ID NO: 8121 - protein, 852 aa, unidentified
MMAKSALRENGTNSETFRQRFRRFHYQEVAGPREAFSQLWELCCRWLRPEVRTKEQIVELLVLEQFLTVLPGEIQNWVQEQCPENGEEAVTLVEDLEREPGRPRSSVTVSVKGQEVRLEKMTPPKSSQELLSVRQESVEPQPRGVPKKERARSPDLGPQEQMNPKEKLKPFQRSGLPFPKSGVVSRLEQGEPWIPDLLGSKEKELPSGSHIGDRRVHADLLPSKKDRRSWVEQDHWSFEDEKVAGVHWGYEETRTLLAILSQTEFYEALRNCHRNSQVYGAVAERLREYGFLRTLEQCRTKFKGLQKSYRKVKSGHPPETCPFFEEMEALMSAQVIALPSNGLEAAASHSGLVGSDAETEEPGQRGWQHEEGAEEAVAQESDSDDMDLEATPQDPNSAAPVVFRSPGGVHWGYEETKTYLAILSETQFYEALRNCHRNSQLYGAVAERLWEYGFLRTPEQCRTKFKSLQTSYRKVKNGQAPETCPFFEEMDALVSVRVAAPPNDGQEETASCPVQGTSEAEAQKQAEEADEATEEDSDDDEEDTEIPPGAVITRAPVLFQSPRGFEAGFENEDNSKRDISEEVQLHRTLLARSERKIPRYLHQGKGNESDCRSGRQWAKTSGEKRGKLTLPEKSLSEVLSQQRPCLGERPYKYLKYSKSFGPNSLLMHQVSHQVENPYKCADCGKSFSRSARLIRHRRIHTGEKPYKCLDCGKSFRDSSNFITHRRIHTGEKPYQCGECGKCFNQSSSLIIHQRTHTGEKPYQCEECGKSFNNSSHFSAHRRIHTGERPHVCPDCGKSFSKSSDLRAHHRTHTGEKPYGCHDCGKCFSKSSALNKHGEIHAREKLLTQSAPK

SEQ ID NO: 8122 - DNA, 6325 bp, unidentified
  source 1..6325: mol_type = unassigned DNA
tttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcatttaaatttccgaactctccaaggccctcgtcggaaaatcttcaaacctttcgtccgatccatcttgcaggctacctctcgaacgaactatcgcaagtctcttggccggccttgcgccttggctattgcttggcagcgcctatcgccaggtattactccaatcccgaatatccgagatcgggatcacccgagagaagttcaacctacatcctcaatcccgatctatccgagatccgaggaatatcgaaatcggggcgcgcctggtgtaccgagaacgatcctctcagtgcgagtctcgacgatccatatcgttgcttggcagtcagccagtcggaatccagcttgggacccaggaagtccaatcgtcagatattgtactcaagcctggtcacggcagcgtaccgatctgtttaaacctagatattgatagtctgatcggtcaacgtataatcgagtcctagcttttgcaaacatctatcaagagacaggatcagcaggaggctttcgcatgagtattcaacatttccgtgtcgcccttattcccttttttgcggcattttgccttcctgtttttgctcacccagaaacgctggtgaaagtaaaagatgctgaagatcagttgggtgcgcgagtgggttacatcgaactggatctcaacagcggtaagatccttgagagttttcgccccgaagaacgctttccaatgatgagcacttttaaagttctgctatgtggcgcggtattatcccgtattgacgccgggcaagagcaactcggtcgccgcatacactattctcagaatgacttggttgagtattcaccagtcacagaaaagcatcttacggatggcatgacagtaagagaattatgcagtgctgccataaccatgagtgataacactgcggccaacttacttctgacaacgattggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaaccttgcgtaaactattaactggcgaactacttactctagcttcccggcaacagttgatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaaccgattctaggtgcattggcgcagaaaaaaatgcctgatgcgacgctgcgcgtcttatactcccacatatgccagattcagcaacggatacggcttccccaacttgcccacttccatacgtgtcctccttaccagaaatttatccttaagatcccgaatcgtttaaactcgactctggctctatcgaatctccgtcgtttcgagcttacgcgaacagccgtggcgctcatttgctcgtcgggcatcgaatctcgtcagctatcgtcagcttacctttttggcagcgatcgcggctcccgacatcttggaccattagctccacaggtatcttcttccctctagtggtcataacagcagcttcagctacctctcaattcaaaaaacccctcaagacccgtttagaggccccaaggggttatgctatcaatcgttgcgttacacacacaaaaaaccaacacacatccatcttcgatggatagcgattttattatctaactgctgatcgagtgtagccagatctagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatgctgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctggtttagtgaaccgtcagatcgcctggagacgccatccacgctgttttgacctccatagaagacaccgggaccgatccagcctcccctcgaagcttacatgtggtaccgagctcggatcctgagaacttcagggtgagtctatgggacccttgatgttttctttccccttcttttctatggttaagttcatgtcataggaaggggagaagtaacagggtacacatattgaccaaatcagggtaattttgcatttgtaattttaaaaaatgctttcttcttttaatatacttttttgtttatcttatttctaatactttccctaatctctttctttcagggcaataatgatacaatgtatcatgcctctttgcaccattctaaagaataacagtgataatttctgggttaaggcaatagcaatatttctgcatataaatatttctgcatataaattgtaactgatgtaagaggtttcatattgctaatagcagctacaatccagctaccattctgcttttattttatggttgggataaggctggattattctgagtccaagctaggcccttttgctaatcatgttcatacctcttatcttcctcccacagctcctgggcaacgtgctggtctgtgtgctggcccatcactttggcaaaggcggccgcgccgccaccatgtggtccgctgtaatcagtgccacgattccgctcgtgctgagtgtgccagtgattttacccgccggccgcgacggaaaatggaacgacgtaccaaatggattcaggtactgccctgcagttggggacgaatactcttacgggcgcgcacaaaccacagctataaccttgcttcaacctaagagcctggaacacgagggggctgaaggctatctgtgccatgttgccgtgtatgaggcaacatgtgactttcggtggtacggcgtgaaatataagacccaaaagatcagaaggcagatacctactgatgccgagtgtcaggccaagcagaaagctttaatggccggccgctctgactgggttggatttccctcattctcgtgtaattacgcatccgtcaccaccgaaaaacatctggagatcgtcctggttccccaccacgtgggcgtggacgattatctgggcttgtacgtggatccaactctgcaggacgggagttgcgttacccctccctgccacactctctatgaggacaccctctggctacctaaggcttctcctaaaccaggagggccgtgtgatcttgaattccatgagcaccgggggattatccgctatccgattcccagggcaggcatgagcatggccaacttccagatatccggtccaaccattcctactgcaacactggatggagcttgtcacatggggatctgcgggaaatggggaatcaggctgcgcagcggagtgtgggtgggcgtcaaagagaggcctatgctccagggtatggacctttacgagacctttatgcatccctgcgcgccaaatgcgacaatcagcgccgggcatttcaatcctggcgccctcaagatgatctgggatgccggcagactactgggctacagcctgtgccagaaaacatgggataaattggaccgaggcgattccattactcctttggacctttcatacttgaacccagtgtcacccggtcccggccttggttttctgtcaataaacggcactctcaagatggctaaattgcgtttctctcgggtcgaattaccagagggcatgatacgtaactatgattctaattcactgaacccctaccagtttcagtggcaaagatgggtgccacatggcaatgtcctggtgggacccaatgggatcacattaaacggatccacggtgaagtttccattcttcatggtcggtgtcgggcggcttgacagtgacctgaccgaggcggagtccatcgacctcctgacacaccacgacattaagcacagccacatgctgcatccggtagatgacagatatgattggtccaagtcgggtgaatccggagatctaattaagcatatcgagagctggttcactatccctgattggatcaagtactgtgtgattattgtagtctgtgtcctcctcatcatcgtgctcggatgcatgacgctagttaagctgagaaagaggccccggcctcccggtcgacgagatcccgaaattccactgagttctacaagctttctgtgagctagcttgactgactgagatacagcgtaccttcagctcacagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtattggcccatctctatcggtatcgtagcataaccccttggggcctctaaacgggtcttgaggggttttttgtgcccctcgggccggattgctatctaccggcattggcgcagaaaaaaatgcctgatgcgacgctgcgcgtcttatactcccacatatgccagattcagcaacggatacggcttccccaacttgcccacttccatacgtgtcctccttaccagaaatttatccttaaggtcgtcagctatcctgcaggcgatctctcgatttcgatcaagacattcctttaatggtcttttctggacaccactaggggtcagaagtagttcatcaaactttcttccctccctaatctcattggttaccttgggctatcgaaacttaattaaccagtcaagtcagctacttggcgagatcgacttgtctgggtttcgactacgctcagaattgcgtcagtcaagttcgatctggtccttgctattgcacccgttctccgattacgagtttcatttaaatcatgtgagcaaaaggccagcaaaaggccaggaaccgtaaaaaggccgcgttgctggcgtt

SEQ ID NO: 8123 - DNA, 6307 bp, unidentified
  source 1..6307: mol_type = unassigned DNA
tttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcatttaaatttccgaactctccaaggccctcgtcggaaaatcttcaaacctttcgtccgatccatcttgcaggctacctctcgaacgaactatcgcaagtctcttggccggccttgcgccttggctattgcttggcagcgcctatcgccaggtattactccaatcccgaatatccgagatcgggatcacccgagagaagttcaacctacatcctcaatcccgatctatccgagatccgaggaatatcgaaatcggggcgcgcctggtgtaccgagaacgatcctctcagtgcgagtctcgacgatccatatcgttgcttggcagtcagccagtcggaatccagcttgggacccaggaagtccaatcgtcagatattgtactcaagcctggtcacggcagcgtaccgatctgtttaaacctagatattgatagtctgatcggtcaacgtataatcgagtcctagcttttgcaaacatctatcaagagacaggatcagcaggaggctttcgcatgagtattcaacatttccgtgtcgcccttattcccttttttgcggcattttgccttcctgtttttgctcacccagaaacgctggtgaaagtaaaagatgctgaagatcagttgggtgcgcgagtgggttacatcgaactggatctcaacagcggtaagatccttgagagttttcgccccgaagaacgctttccaatgatgagcacttttaaagttctgctatgtggcgcggtattatcccgtattgacgccgggcaagagcaactcggtcgccgcatacactattctcagaatgacttggttgagtattcaccagtcacagaaaagcatcttacggatggcatgacagtaagagaattatgcagtgctgccataaccatgagtgataacactgcggccaacttacttctgacaacgattggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaaccttgcgtaaactattaactggcgaactacttactctagcttcccggcaacagttgatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaaccgattctaggtgcattggcgcagaaaaaaatgcctgatgcgacgctgcgcgtcttatactcccacatatgccagattcagcaacggatacggcttccccaacttgcccacttccatacgtgtcctccttaccagaaatttatccttaagatcccgaatcgtttaaactcgactctggctctatcgaatctccgtcgtttcgagcttacgcgaacagccgtggcgctcatttgctcgtcgggcatcgaatctcgtcagctatcgtcagcttacctttttggcagcgatcgcggctcccgacatcttggaccattagctccacaggtatcttcttccctctagtggtcataacagcagcttcagctacctctcaattcaaaaaacccctcaagacccgtttagaggccccaaggggttatgctatcaatcgttgcgttacacacacaaaaaaccaacacacatccatcttcgatggatagcgattttattatctaactgctgatcgagtgtagccagatctagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatgctgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctggtttagtgaaccgtcagatcgcctggagacgccatccacgctgttttgacctccatagaagacaccgggaccgatccagcctcccctcgaagcttacatgtggtaccgagctcggatcctgagaacttcagggtgagtctatgggacccttgatgttttctttccccttcttttctatggttaagttcatgtcataggaaggggagaagtaacagggtacacatattgaccaaatcagggtaattttgcatttgtaattttaaaaaatgctttcttcttttaatatacttttttgtttatcttatttctaatactttccctaatctctttctttcagggcaataatgatacaatgtatcatgcctctttgcaccattctaaagaataacagtgataatttctgggttaaggcaatagcaatatttctgcatataaatatttctgcatataaattgtaactgatgtaagaggtttcatattgctaatagcagctacaatccagctaccattctgcttttattttatggttgggataaggctggattattctgagtccaagctaggcccttttgctaatcatgttcatacctcttatcttcctcccacagctcctgggcaacgtgctggtctgtgtgctggcccatcactttggcaaaggcggccgcgccgccaccatggtcagaataatttgttggctgggccttgtgctgtcagtccaagctgccaaggtaattctgcccgttaagctggaatctgattgggtgccggtgtacagcggggaacgcatctgccagagccaccgagagaaaatcccccctggtatctacgagagcttgaaggtcgagggtcaggtcccagtacgtcagcagtcccaaggagcagatgggtattattgccataaaacaatttactctgtgctttgcgattttaagtggtacggcgtgaagcgtgtgagacatagtgttaagcgggatactccgtcctattctgagtgtctgaaagctgtggacgacgaaatctctggtatgagcgaatatgtgggattccctcccccatcatgtaactacctagtagagacacggtcccaaaacattgagatcatcctgtcgaaacactccgttaaaatcgatgattataaacaatcttggatggattccacctttttggatggggggtgtagtcatgccccctgtcttactaccgtgcccggaacgctctggattcctacagacaatctcaccagcgcgtgtgacatcaccttccggaaacaggaattcaccatttactatcctaaacagaaacccgcccacttaagttcagaccagattttcataacgtctccatatcaccctgtcagctccctttctaaatcgtgcctgattacattgtgtgggaaaaccggcatcagactccctggcggatcctggagcagcctcgataatcacaagtcattccatgacataaagatcgagactttactctccaattgcaagagctccaccgagatctattctagtccaccagacctgcgcaatatccgcatggtgtgggacctggagagagtgatcgagaactctctatgccagggaacttgggacaagattgaaacacgccaaaagataaccccactggacctgaattacttaagcccatccgagcccggccccggctggggcttcattcccaagaacggctcaatacataaggctcagatcctctacattagggccgatgtcgacgatgatacgatcgcacttggccagaagtacaacaagggaaaagacgaattttattttaactggaacgattgggagttgctaaatgggattaagataggacctaacgggatcattactaatggtactcacgtgaggatcccgtactacagcgtgggcatcggcaagctggatgaagacatgattacacctgacgaggtaggggttatacaccacattgaccacctgaagcagagggtgctggttcagacaaatctggacagagtctggatccatgagggcgagaacggggatctgatcactagcgtttcccactggtggcacgacgtcattaaacattcatgggaaatctttgcactcatcggtggattgttcagtctcagttgcatatgcagtctgtgctcttgtcggaaaaagaggagggaatcacgacatcaggaaaccatgtcgtttgtgtgagctagcttgactgactgagatacagcgtaccttcagctcacagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtattggcccatctctatcggtatcgtagcataaccccttggggcctctaaacgggtcttgaggggttttttgtgcccctcgggccggattgctatctaccggcattggcgcagaaaaaaatgcctgatgcgacgctgcgcgtcttatactcccacatatgccagattcagcaacggatacggcttccccaacttgcccacttccatacgtgtcctccttaccagaaatttatccttaaggtcgtcagctatcctgcaggcgatctctcgatttcgatcaagacattcctttaatggtcttttctggacaccactaggggtcagaagtagttcatcaaactttcttccctccctaatctcattggttaccttgggctatcgaaacttaattaaccagtcaagtcagctacttggcgagatcgacttgtctgggtttcgactacgctcagaattgcgtcagtcaagttcgatctggtccttgctattgcacccgttctccgattacgagtttcatttaaatcatgtgagcaaaaggccagcaaaaggccaggaaccgtaaaaaggccgcgttgctggcgtt

SEQ ID NO: 8124 - DNA, 6376 bp, unidentified
  source 1..6376: mol_type = unassigned DNA
tttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcatttaaatttccgaactctccaaggccctcgtcggaaaatcttcaaacctttcgtccgatccatcttgcaggctacctctcgaacgaactatcgcaagtctcttggccggccttgcgccttggctattgcttggcagcgcctatcgccaggtattactccaatcccgaatatccgagatcgggatcacccgagagaagttcaacctacatcctcaatcccgatctatccgagatccgaggaatatcgaaatcggggcgcgcctggtgtaccgagaacgatcctctcagtgcgagtctcgacgatccatatcgttgcttggcagtcagccagtcggaatccagcttgggacccaggaagtccaatcgtcagatattgtactcaagcctggtcacggcagcgtaccgatctgtttaaacctagatattgatagtctgatcggtcaacgtataatcgagtcctagcttttgcaaacatctatcaagagacaggatcagcaggaggctttcgcatgagtattcaacatttccgtgtcgcccttattcccttttttgcggcattttgccttcctgtttttgctcacccagaaacgctggtgaaagtaaaagatgctgaagatcagttgggtgcgcgagtgggttacatcgaactggatctcaacagcggtaagatccttgagagttttcgccccgaagaacgctttccaatgatgagcacttttaaagttctgctatgtggcgcggtattatcccgtattgacgccgggcaagagcaactcggtcgccgcatacactattctcagaatgacttggttgagtattcaccagtcacagaaaagcatcttacggatggcatgacagtaagagaattatgcagtgctgccataaccatgagtgataacactgcggccaacttacttctgacaacgattggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaaccttgcgtaaactattaactggcgaactacttactctagcttcccggcaacagttgatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaaccgattctaggtgcattggcgcagaaaaaaatgcctgatgcgacgctgcgcgtcttatactcccacatatgccagattcagcaacggatacggcttccccaacttgcccacttccatacgtgtcctccttaccagaaatttatccttaagatcccgaatcgtttaaactcgactctggctctatcgaatctccgtcgtttcgagcttacgcgaacagccgtggcgctcatttgctcgtcgggcatcgaatctcgtcagctatcgtcagcttacctttttggcagcgatcgcggctcccgacatcttggaccattagctccacaggtatcttcttccctctagtggtcataacagcagcttcagctacctctcaattcaaaaaacccctcaagacccgtttagaggccccaaggggttatgctatcaatcgttgcgttacacacacaaaaaaccaacacacatccatcttcgatggatagcgattttattatctaactgctgatcgagtgtagccagatctagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatgctgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctggtttagtgaaccgtcagatcgcctggagacgccatccacgctgttttgacctccatagaagacaccgggaccgatccagcctcccctcgaagcttacatgtggtaccgagctcggatcctgagaacttcagggtgagtctatgggacccttgatgttttctttccccttcttttctatggttaagttcatgtcataggaaggggagaagtaacagggtacacatattgaccaaatcagggtaattttgcatttgtaattttaaaaaatgctttcttcttttaatatacttttttgtttatcttatttctaatactttccctaatctctttctttcagggcaataatgatacaatgtatcatgcctctttgcaccattctaaagaataacagtgataatttctgggttaaggcaatagcaatatttctgcatataaatatttctgcatataaattgtaactgatgtaagaggtttcatattgctaatagcagctacaatccagctaccattctgcttttattttatggttgggataaggctggattattctgagtccaagctaggcccttttgctaatcatgttcatacctcttatcttcctcccacagctcctgggcaacgtgctggtctgtgtgctggcccatcactttggcaaaggcggccgcgccgccaccatggacctgtttccaattttggttgtggtcctgatgaccgatacagtattaggcaaattccagattgtatttcctgaccaaaacgagctagaatggaggccggtcgttggcgatagccgccactgtcctcagtcaagcgagatgcagtttgatggtagcagatcccaaaccatcttgacaggcaaggcacctgtgggcattacaccaagcaagtccgatggttttatctgccatgcagccaaatgggtaaccacatgcgatttccggtggtacggaccaaagtacatcactcacagcattcatcatctgcgcccgactaccagtgactgcgagacagcgctgcagaggtataaagacggtagtttaataaacctcggatttccccccgagtcctgtggatacgctaccgtgaccgactctgaggccatgctagtgcaggtcaccccccaccatgttggagtcgatgactatagaggccattggatcgaccctctcttccctggaggggaatgcagtacaaatttttgtgacaccgtgcacaacagctcagtgtggataccgaagtcgcagaaaacagacatttgcgctcagtccttcaagaatatcaaaatgacggctagttatccttccgagggtgcacttgtgtctgatagattcgcgttccactcggcctaccaccccaatatgccagggtccaccgtgtgtataatggacttttgtgaacaaaaggggctccgttttacaaacggcgagtggatgggccttaacgtcgagcagtcaattcgagaaaagaaaatctccgcaatcttcccaaattgtgtcgccggcaccgaaatccgagcaactcttgaaagcgagggggctcggacactgacttgggagacccagagaatgcttgattacagcctgtgccagaacacctgggataaagtgtcacgcaaagagcccctctcccccctggacctgagttacctcagcccacgcgcccccggcaaggggatggcatatactgtgatcaacgggactctgcacagcgctcacgcaaaatacatccggacgtggattgattacggcgaaatgaaggagattaaaggggggaggggcgagtattctaaggccccagaactgctgtggtctcaatggttcgattttggtccattcaagattggacctaacggattactacacacagggaagactttcaagtttcccttgtacctgattggggctggtataattgatgaagatctgcatgaactcgacgaagccgctcctatcgaccacccacagatgcccgacgccaaatctgtactgcccgaggacgaggagatcttcttcggcgacacgggcgtgagtaagaaccctatcgaactcatccagggatggttttctaattggcgcgagtcagtgatggccatagtcggaatcgtgttgctgatagttgttacgttcttggcgatcaaaactgtgcgagtcctcaattgcctttggcggccgaggaagaagcggattgtgagacaagaagtcgatgtggaatcaaggctgaatcatttcgagatgcgtggatttcccgagtatgttaagaggtgagctagcttgactgactgagatacagcgtaccttcagctcacagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtattggcccatctctatcggtatcgtagcataaccccttggggcctctaaacgggtcttgaggggttttttgtgcccctcgggccggattgctatctaccggcattggcgcagaaaaaaatgcctgatgcgacgctgcgcgtcttatactcccacatatgccagattcagcaacggatacggcttccccaacttgcccacttccatacgtgtcctccttaccagaaatttatccttaaggtcgtcagctatcctgcaggcgatctctcgatttcgatcaagacattcctttaatggtcttttctggacaccactaggggtcagaagtagttcatcaaactttcttccctccctaatctcattggttaccttgggctatcgaaacttaattaaccagtcaagtcagctacttggcgagatcgacttgtctgggtttcgactacgctcagaattgcgtcagtcaagttcgatctggtccttgctattgcacccgttctccgattacgagtttcatttaaatcatgtgagcaaaaggccagcaaaaggccaggaaccgtaaaaaggccgcgttgctggcgtt

SEQ ID NO: 8125 - DNA, 6370 bp, unidentified
  source 1..6370: mol_type = unassigned DNA
tttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcatttaaatttccgaactctccaaggccctcgtcggaaaatcttcaaacctttcgtccgatccatcttgcaggctacctctcgaacgaactatcgcaagtctcttggccggccttgcgccttggctattgcttggcagcgcctatcgccaggtattactccaatcccgaatatccgagatcgggatcacccgagagaagttcaacctacatcctcaatcccgatctatccgagatccgaggaatatcgaaatcggggcgcgcctggtgtaccgagaacgatcctctcagtgcgagtctcgacgatccatatcgttgcttggcagtcagccagtcggaatccagcttgggacccaggaagtccaatcgtcagatattgtactcaagcctggtcacggcagcgtaccgatctgtttaaacctagatattgatagtctgatcggtcaacgtataatcgagtcctagcttttgcaaacatctatcaagagacaggatcagcaggaggctttcgcatgagtattcaacatttccgtgtcgcccttattcccttttttgcggcattttgccttcctgtttttgctcacccagaaacgctggtgaaagtaaaagatgctgaagatcagttgggtgcgcgagtgggttacatcgaactggatctcaacagcggtaagatccttgagagttttcgccccgaagaacgctttccaatgatgagcacttttaaagttctgctatgtggcgcggtattatcccgtattgacgccgggcaagagcaactcggtcgccgcatacactattctcagaatgacttggttgagtattcaccagtcacagaaaagcatcttacggatggcatgacagtaagagaattatgcagtgctgccataaccatgagtgataacactgcggccaacttacttctgacaacgattggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaaccttgcgtaaactattaactggcgaactacttactctagcttcccggcaacagttgatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaaccgattctaggtgcattggcgcagaaaaaaatgcctgatgcgacgctgcgcgtcttatactcccacatatgccagattcagcaacggatacggcttccccaacttgcccacttccatacgtgtcctccttaccagaaatttatccttaagatcccgaatcgtttaaactcgactctggctctatcgaatctccgtcgtttcgagcttacgcgaacagccgtggcgctcatttgctcgtcgggcatcgaatctcgtcagctatcgtcagcttacctttttggcagcgatcgcggctcccgacatcttggaccattagctccacaggtatcttcttccctctagtggtcataacagcagcttcagctacctctcaattcaaaaaacccctcaagacccgtttagaggccccaaggggttatgctatcaatcgttgcgttacacacacaaaaaaccaacacacatccatcttcgatggatagcgattttattatctaactgctgatcgagtgtagccagatctagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatgctgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctggtttagtgaaccgtcagatcgcctggagacgccatccacgctgttttgacctccatagaagacaccgggaccgatccagcctcccctcgaagcttacatgtggtaccgagctcggatcctgagaacttcagggtgagtctatgggacccttgatgttttctttccccttcttttctatggttaagttcatgtcataggaaggggagaagtaacagggtacacatattgaccaaatcagggtaattttgcatttgtaattttaaaaaatgctttcttcttttaatatacttttttgtttatcttatttctaatactttccctaatctctttctttcagggcaataatgatacaatgtatcatgcctctttgcaccattctaaagaataacagtgataatttctgggttaaggcaatagcaatatttctgcatataaatatttctgcatataaattgtaactgatgtaagaggtttcatattgctaatagcagctacaatccagctaccattctgcttttattttatggttgggataaggctggattattctgagtccaagctaggcccttttgctaatcatgttcatacctcttatcttcctcccacagctcctgggcaacgtgctggtctgtgtgctggcccatcactttggcaaaggcggccgcgccgccaccatgaaatctagcgtcacaatcggggttatgttgattatttcgtttatcaacccctcttacagcagtctgtcaattgcttttccggaaaataccaaactggactggaaaccagtgacaaaaaatacacggtactgtccaatgggcggggagtggttcttagagccagggctccaagaagagagttttctgtcgagcaccccgatcggagccactcccagtaagagcgatgggtttctttgccatgctgcaaaatgggtgacgacatgtgatttccgttggtatggccctaaatacatcacccactccatccataatattaagcccacgaggtcagactgtgacacagcgctcgcttcttacaagagcggcactctggtgagccccggttttccccctgagagctgcggctatgcctccgtgaccgatagtgaattcctggtgattatgattactccccaccatgtgggggtcgacgactaccgcggtcattgggtcgatccattgttcgtcggcggtgagtgcgaccagtcttattgtgacacaattcacaattccagtgtgtggattccagcagattctaccaagaagaatatttgcgggcagtcattcactcccctgactgtgaccgtcgcatatgacaaaactaaagagatcgccgctggcggaatcgtctttaaaagcaagtatcattcccacatggagggcgccagaacatgtcgcctctcttattgcgggcgaaacggtatcaagttcccgaacggagagtgggtgagcctcgacgtgaagacaaagatccaggagaaacctcttttgccattattcaaagaatgccctgccggcaccgaggtacggtccacgctgcagagcgacggagcacaagtacttacctccgaaatccagcgcatcctggattactccctttgccagaacacctgggacaaagtggagagaaaggagcccttgagcccactggacctgtcatacctcgcttccaaatcgccggggaagggcctagcctatactgttataaatggaaccctcgcgtttgcccacacacggtacgtcaggatgtggattgatggacctgtgctgaaggagctcaaaggaaagcgagaatccccatcagggatctcatctgatatatggacgcagtggttcaagtacggcgatatggaaatcggccccaatggactgctaaagacagcgggtggctataagttcccatggcacctgattggcatggggatagtagacaacgaactgcacgagttgtccgaagctaaccccctcgatcaccctcaactgccccatgcccagagtatagcagacgacagcgaagagatctttttcggtgataccggagtttccaagaaccctgtcgaattagttaccggctggttcacttcttggaaggagagtctggccgccggggttgtgctgatcctagtggtggtgcttatatacggtgtacttagatgctttcctgtcctctgtaccacttgtaggaaacctaaatggaagaagggagttgaaagatcagattcttttgagatgaggattttcaagcctaacaatatgcggtaagctagcttgactgactgagatacagcgtaccttcagctcacagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtattggcccatctctatcggtatcgtagcataaccccttggggcctctaaacgggtcttgaggggttttttgtgcccctcgggccggattgctatctaccggcattggcgcagaaaaaaatgcctgatgcgacgctgcgcgtcttatactcccacatatgccagattcagcaacggatacggcttccccaacttgcccacttccatacgtgtcctccttaccagaaatttatccttaaggtcgtcagctatcctgcaggcgatctctcgatttcgatcaagacattcctttaatggtcttttctggacaccactaggggtcagaagtagttcatcaaactttcttccctccctaatctcattggttaccttgggctatcgaaacttaattaaccagtcaagtcagctacttggcgagatcgacttgtctgggtttcgactacgctcagaattgcgtcagtcaagttcgatctggtccttgctattgcacccgttctccgattacgagtttcatttaaatcatgtgagcaaaaggccagcaaaaggccaggaaccgtaaaaaggccgcgttgctggcgtt

SEQ ID NO: 8126 - DNA, 6592 bp, unidentified
  source 1..6592: mol_type = unassigned DNA
tttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcatttaaatttccgaactctccaaggccctcgtcggaaaatcttcaaacctttcgtccgatccatcttgcaggctacctctcgaacgaactatcgcaagtctcttggccggccttgcgccttggctattgcttggcagcgcctatcgccaggtattactccaatcccgaatatccgagatcgggatcacccgagagaagttcaacctacatcctcaatcccgatctatccgagatccgaggaatatcgaaatcggggcgcgcctggtgtaccgagaacgatcctctcagtgcgagtctcgacgatccatatcgttgcttggcagtcagccagtcggaatccagcttgggacccaggaagtccaatcgtcagatattgtactcaagcctggtcacggcagcgtaccgatctgtttaaacctagatattgatagtctgatcggtcaacgtataatcgagtcctagcttttgcaaacatctatcaagagacaggatcagcaggaggctttcgcatgagtattcaacatttccgtgtcgcccttattcccttttttgcggcattttgccttcctgtttttgctcacccagaaacgctggtgaaagtaaaagatgctgaagatcagttgggtgcgcgagtgggttacatcgaactggatctcaacagcggtaagatccttgagagttttcgccccgaagaacgctttccaatgatgagcacttttaaagttctgctatgtggcgcggtattatcccgtattgacgccgggcaagagcaactcggtcgccgcatacactattctcagaatgacttggttgagtattcaccagtcacagaaaagcatcttacggatggcatgacagtaagagaattatgcagtgctgccataaccatgagtgataacactgcggccaacttacttctgacaacgattggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaaccttgcgtaaactattaactggcgaactacttactctagcttcccggcaacagttgatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaaccgattctaggtgcattggcgcagaaaaaaatgcctgatgcgacgctgcgcgtcttatactcccacatatgccagattcagcaacggatacggcttccccaacttgcccacttccatacgtgtcctccttaccagaaatttatccttaagatcccgaatcgtttaaactcgactctggctctatcgaatctccgtcgtttcgagcttacgcgaacagccgtggcgctcatttgctcgtcgggcatcgaatctcgtcagctatcgtcagcttacctttttggcagcgatcgcggctcccgacatcttggaccattagctccacaggtatcttcttccctctagtggtcataacagcagcttcagctacctctcaattcaaaaaacccctcaagacccgtttagaggccccaaggggttatgctatcaatcgttgcgttacacacacaaaaaaccaacacacatccatcttcgatggatagcgattttattatctaactgctgatcgagtgtagccagatctagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatgctgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctggtttagtgaaccgtcagatcgcctggagacgccatccacgctgttttgacctccatagaagacaccgggaccgatccagcctcccctcgaagcttacatgtggtaccgagctcggatcctgagaacttcagggtgagtctatgggacccttgatgttttctttccccttcttttctatggttaagttcatgtcataggaaggggagaagtaacagggtacacatattgaccaaatcagggtaattttgcatttgtaattttaaaaaatgctttcttcttttaatatacttttttgtttatcttatttctaatactttccctaatctctttctttcagggcaataatgatacaatgtatcatgcctctttgcaccattctaaagaataacagtgataatttctgggttaaggcaatagcaatatttctgcatataaatatttctgcatataaattgtaactgatgtaagaggtttcatattgctaatagcagctacaatccagctaccattctgcttttattttatggttgggataaggctggattattctgagtccaagctaggcccttttgctaatcatgttcatacctcttatcttcctcccacagctcctgggcaacgtgctggtctgtgtgctggcccatcactttggcaaaggcggccgcgccgccaccatggagacagacacactcctgctatgggtactgctgctctgggttccaggttccactggtgacgaggtcaaattgcaggaatctggtcccgggctcgtggcaccatcccagtcccttagtgtcacctgcacggtgagtggggtgtccctgcccgactacggagtgtcctggattcggcagcctccgaggaagggactggaatggctgggtgtcatctggggctctgagaccacttactataacagtgctctgaagagccgcttgaccatcattaaggataactccaagtctcaagtgttcttaaagatgaactctctgcagactgatgacactgcgatctattattgcgctaaacattattactacggcggatcctatgccatggattactgggggcagggaacatcagttacagtgagctcatcctctggcggtggaggtagtggcggagggggcagcgggggaggcggcagtgacatccagatgacccaaacaaccagctcactctcggcatcgttaggcgaccgtgtaactatcagctgtagggccagtcaggacattagcaaatatctgaattggtaccaacaaaagcccgacgggaccgttaaacttctcatatatcacacttctcgactgcacagcggggtaccatccagattttctggctcaggctcagggacagattacagcctcacaatcagcaatctggagcaggaggatattgccacatacttctgtcagcagggtaataccttgccttacacctttggtggcggaacgaaactagaaataaaggaacccaagtcatgcgacaagacgcacacctgccccccctgccctgcacctgaactgttggggggtccttctgtgttcctttttccacccaagccaaaagacaccttaatgattagccggacgcctgaagtcacatgtgtggtggtcgacgtgtcccatgaggacccagaggtgaagttcaattggtacgtggacggggtcgaggtgcacaatgccaaaaccaaaccccgcgaagagcagtacaacagcacttatagggttgtatccgtacttactgtcctgcatcaagactggctgaatggaaaagagtataagtgtaaagtgagcaacaaggccctcccagcccccatcgaaaagactatcagtaaggctaagggccagccccgtgagcctcaggtgtacaccttgccgccttccagagacgaactcacaaaaaatcaagttagtctaacatgtctggtcaagggattctacccgtccgacatcgcggtcgaatgggagtcaaatggacagccagaaaacaactataaaacaactccaccggttctggattccgatggtagctttttcctgtatagtaaactcacagttgataagtctcgatggcagcagggcaacgtgttcagctgcagcgtcatgcacgaggctctccataaccactatacccagaaatctctcagtctgtcccctggaaaaagcggggggtcttccagaggtgagcagaaactgattagtgaggaggatctgatcgaggtcatgtaccccccaccttatctcgataatgaaaagtcaaatggcactataatccacgttaagggcaagcatctttgcccatcacctttgttcccaggaccctcaaaaccattttgggtgctggtggtagtgggcggcgtattggcctgttattctctgcttgtgaccgtggcatttattatattttgggtgagatctaagaggtcgcgcctattacactcggattacatgaaccgggttaggcaagggtacagctgagctagcttgactgactgagatacagcgtaccttcagctcacagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtattggcccatctctatcggtatcgtagcataaccccttggggcctctaaacgggtcttgaggggttttttgtgcccctcgggccggattgctatctaccggcattggcgcagaaaaaaatgcctgatgcgacgctgcgcgtcttatactcccacatatgccagattcagcaacggatacggcttccccaacttgcccacttccatacgtgtcctccttaccagaaatttatccttaaggtcgtcagctatcctgcaggcgatctctcgatttcgatcaagacattcctttaatggtcttttctggacaccactaggggtcagaagtagttcatcaaactttcttccctccctaatctcattggttaccttgggctatcgaaacttaattaaccagtcaagtcagctacttggcgagatcgacttgtctgggtttcgactacgctcagaattgcgtcagtcaagttcgatctggtccttgctattgcacccgttctccgattacgagtttcatttaaatcatgtgagcaaaaggccagcaaaaggccaggaaccgtaaaaaggccgcgttgctggcgtt

SEQ ID NO: 8127 - DNA, 5764 bp, unidentified
  source 1..5764: mol_type = unassigned DNA
tttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcatttaaatttccgaactctccaaggccctcgtcggaaaatcttcaaacctttcgtccgatccatcttgcaggctacctctcgaacgaactatcgcaagtctcttggccggccttgcgccttggctattgcttggcagcgcctatcgccaggtattactccaatcccgaatatccgagatcgggatcacccgagagaagttcaacctacatcctcaatcccgatctatccgagatccgaggaatatcgaaatcggggcgcgcctggtgtaccgagaacgatcctctcagtgcgagtctcgacgatccatatcgttgcttggcagtcagccagtcggaatccagcttgggacccaggaagtccaatcgtcagatattgtactcaagcctggtcacggcagcgtaccgatctgtttaaacctagatattgatagtctgatcggtcaacgtataatcgagtcctagcttttgcaaacatctatcaagagacaggatcagcaggaggctttcgcatgagtattcaacatttccgtgtcgcccttattcccttttttgcggcattttgccttcctgtttttgctcacccagaaacgctggtgaaagtaaaagatgctgaagatcagttgggtgcgcgagtgggttacatcgaactggatctcaacagcggtaagatccttgagagttttcgccccgaagaacgctttccaatgatgagcacttttaaagttctgctatgtggcgcggtattatcccgtattgacgccgggcaagagcaactcggtcgccgcatacactattctcagaatgacttggttgagtattcaccagtcacagaaaagcatcttacggatggcatgacagtaagagaattatgcagtgctgccataaccatgagtgataacactgcggccaacttacttctgacaacgattggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaaccttgcgtaaactattaactggcgaactacttactctagcttcccggcaacagttgatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaaccgattctaggtgcattggcgcagaaaaaaatgcctgatgcgacgctgcgcgtcttatactcccacatatgccagattcagcaacggatacggcttccccaacttgcccacttccatacgtgtcctccttaccagaaatttatccttaagatcccgaatcgtttaaactcgactctggctctatcgaatctccgtcgtttcgagcttacgcgaacagccgtggcgctcatttgctcgtcgggcatcgaatctcgtcagctatcgtcagcttacctttttggcagcgatcgcggctcccgacatcttggaccattagctccacaggtatcttcttccctctagtggtcataacagcagcttcagctacctctcaattcaaaaaacccctcaagacccgtttagaggccccaaggggttatgctatcaatcgttgcgttacacacacaaaaaaccaacacacatccatcttcgatggatagcgattttattatctaactgctgatcgagtgtagccagatctagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatgctgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctggtttagtgaaccgtcagatcgcctggagacgccatccacgctgttttgacctccatagaagacaccgggaccgatccagcctcccctcgaagcttacatgtggtaccgagctcggatcctgagaacttcagggtgagtctatgggacccttgatgttttctttccccttcttttctatggttaagttcatgtcataggaaggggagaagtaacagggtacacatattgaccaaatcagggtaattttgcatttgtaattttaaaaaatgctttcttcttttaatatacttttttgtttatcttatttctaatactttccctaatctctttctttcagggcaataatgatacaatgtatcatgcctctttgcaccattctaaagaataacagtgataatttctgggttaaggcaatagcaatatttctgcatataaatatttctgcatataaattgtaactgatgtaagaggtttcatattgctaatagcagctacaatccagctaccattctgcttttattttatggttgggataaggctggattattctgagtccaagctaggcccttttgctaatcatgttcatacctcttatcttcctcccacagctcctgggcaacgtgctggtctgtgtgctggcccatcactttggcaaaggcggccgcgccgccaccatggagacagacacactcctgctatgggtactgctgctctgggttccaggttccactggtgacgaggtcaaattgcaggaatctggtcccgggctcgtggcaccatcccagtcccttagtgtcacctgcacggtgagtggggtgtccctgcccgactacggagtgtcctggattcggcagcctccgaggaagggactggaatggctgggtgtcatctggggctctgagaccacttactataacagtgctctgaagagccgcttgaccatcattaaggataactccaagtctcaagtgttcttaaagatgaactctctgcagactgatgacactgcgatctattattgcgctaaacattattactacggcggatcctatgccatggattactgggggcagggaacatcagttacagtgagctcatcctctggcggtggaggtagtggcggagggggcagcgggggaggcggcagtgacatccagatgacccaaacaaccagctcactctcggcatcgttaggcgaccgtgtaactatcagctgtagggccagtcaggacattagcaaatatctgaattggtaccaacaaaagcccgacgggaccgttaaacttctcatatatcacacttctcgactgcacagcggggtaccatccagattttctggctcaggctcagggacagattacagcctcacaatcagcaatctggagcaggaggatattgccacatacttctgtcagcagggtaataccttgccttacacctttggtggcggaacgaaactagaaataaaggaacaaaaactcatctcagaagaggatctgaatgctgtgggccaggacacgcaggaggtcatcgtggtgccacactccttgccctttaaggtggtggtgatctcagccatcctggccctggtggtgctcaccatcatctcccttatcatcctcatcatgctttggcagaagaagccacgttgagctagcttgactgactgagatacagcgtaccttcagctcacagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtattggcccatctctatcggtatcgtagcataaccccttggggcctctaaacgggtcttgaggggttttttgtgcccctcgggccggattgctatctaccggcattggcgcagaaaaaaatgcctgatgcgacgctgcgcgtcttatactcccacatatgccagattcagcaacggatacggcttccccaacttgcccacttccatacgtgtcctccttaccagaaatttatccttaaggtcgtcagctatcctgcaggcgatctctcgatttcgatcaagacattcctttaatggtcttttctggacaccactaggggtcagaagtagttcatcaaactttcttccctccctaatctcattggttaccttgggctatcgaaacttaattaaccagtcaagtcagctacttggcgagatcgacttgtctgggtttcgactacgctcagaattgcgtcagtcaagttcgatctggtccttgctattgcacccgttctccgattacgagtttcatttaaatcatgtgagcaaaaggccagcaaaaggccaggaaccgtaaaaaggccgcgttgctggcgtt

SEQ ID NO: 8128 - DNA, 5764 bp, unidentified; identical to SEQ ID NO: 8127
  source 1..5764: mol_type = unassigned DNA

SEQ ID NO: 8129 - DNA, 6592 bp, unidentified; identical to SEQ ID NO: 8126
  source 1..6592: mol_type = unassigned DNA

SEQ ID NO: 8130 - DNA, 6571 bp, unidentified
  source 1..6571: mol_type = unassigned DNA
tttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcatttaaatttccgaactctccaaggccctcgtcggaaaatcttcaaacctttcgtccgatccatcttgcaggctacctctcgaacgaactatcgcaagtctcttggccggccttgcgccttggctattgcttggcagcgcctatcgccaggtattactccaatcccgaatatccgagatcgggatcacccgagagaagttcaacctacatcctcaatcccgatctatccgagatccgaggaatatcgaaatcggggcgcgcctggtgtaccgagaacgatcctctcagtgcgagtctcgacgatccatatcgttgcttggcagtcagccagtcggaatccagcttgggacccaggaagtccaatcgtcagatattgtactcaagcctggtcacggcagcgtaccgatctgtttaaacctagatattgatagtctgatcggtcaacgtataatcgagtcctagcttttgcaaacatctatcaagagacaggatcagcaggaggctttcgcatgagtattcaacatttccgtgtcgcccttattcccttttttgcggcattttgccttcctgtttttgctcacccagaaacgctggtgaaagtaaaagatgctgaagatcagttgggtgcgcgagtgggttacatcgaactggatctcaacagcggtaagatccttgagagttttcgccccgaagaacgctttccaatgatgagcacttttaaagttctgctatgtggcgcggtattatcccgtattgacgccgggcaagagcaactcggtcgccgcatacactattctcagaatgacttggttgagtattcaccagtcacagaaaagcatcttacggatggcatgacagtaagagaattatgcagtgctgccataaccatgagtgataacactgcggccaacttacttctgacaacgattggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaaccttgcgtaaactattaactggcgaactacttactctagcttcccggcaacagttgatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaaccgattctaggtgcattggcgcagaaaaaaatgcctgatgcgacgctgcgcgtcttatactcccacatatgccagattcagcaacggatacggcttccccaacttgcccacttccatacgtgtcctccttaccagaaatttatccttaagatcccgaatcgtttaaactcgactctggctctatcgaatctccgtcgtttcgagcttacgcgaacagccgtggcgctcatttgctcgtcgggcatcgaatctcgtcagctatcgtcagcttacctttttggcagcgatcgcggctcccgacatcttggaccattagctccacaggtatcttcttccctctagtggtcataacagcagcttcagctacctctcaattcaaaaaacccctcaagacccgtttagaggccccaaggggttatgctatcaatcgttgcgttacacacacaaaaaaccaacacacatccatcttcgatggatagcgattttattatctaactgctgatcgagtgtagccagatctagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatgctgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctggtttagtgaaccgtcagatcgcctggagacgccatccacgctgttttgacctccatagaagacaccgggaccgatccagcctcccctcgaagcttacatgtggtaccgagctcggatcctgagaacttcagggtgagtctatgggacccttgatgttttctttccccttcttttctatggttaagttcatgtcataggaaggggagaagtaacagggtacacatattgaccaaatcagggtaattttgcatttgtaattttaaaaaatgctttcttcttttaatatacttttttgtttatcttatttctaatactttccctaatctctttctttcagggcaataatgatacaatgtatcatgcctctttgcaccattctaaagaataacagtgataatttctgggttaaggcaatagcaatatttctgcatataaatatttctgcatataaattgtaactgatgtaagaggtttcatattgctaatagcagctacaatccagctaccattctgcttttattttatggttgggataaggctggattattctgagtccaagctaggcccttttgctaatcatgttcatacctcttatcttcctcccacagctcctgggcaacgtgctggtctgtgtgctggcccatcactttggcaaaggcggccgcgccgccaccatgggggtgcctacccaactactgggcctcttgctgctctggatcaccgacgctatatgcgacattcaaatgacgcagtcccccgccagtctgagtacaagcctgggcgaaaccgtgaccatccagtgtcaggcttcagaggacatttactcaggactggcatggtaccagcagaaacccgggaaatccccgcagttgctgatctatggcgcatccgatctccaggatggagtcccatccaggttcagcgggtccggatcaggaacccagtactccctaaagatcacaagcatgcagacagaggacgagggagtgtatttttgccagcagggcttgacttatccccggacattcgggggtggcactaagctggagctgaagggcggcggtggtagtggaggaggggggtccggtggaggaggaagtgaggtacagcttcaacagtctggggccgagttggtaaggcctggtacctctgtcaaactaagttgtaaggtttcaggtgataccattaccttctattacatgcacttcgtgaagcagcgcccaggccaaggcctcgaatggatcggccgaattgaccctgaagatgaatcgaccaagtactccgaaaagtttaagaataaagctactctcacagcagacacttcaagcaacaccgcttacctgaaactgtcttcattgacctctgaggacacggccacgtatttctgcatctacggcgggtattactttgactactggggccagggagtcatggtcactgtttctagcgaacccaagtcatgcgacaagacgcacacctgccccccctgccctgcacctgaactgttggggggtccttctgtgttcctttttccacccaagccaaaagacaccttaatgattagccggacgcctgaagtcacatgtgtggtggtcgacgtgtcccatgaggacccagaggtgaagttcaattggtacgtggacggggtcgaggtgcacaatgccaaaaccaaaccccgcgaagagcagtacaacagcacttatagggttgtatccgtacttactgtcctgcatcaagactggctgaatggaaaagagtataagtgtaaagtgagcaacaaggccctcccagcccccatcgaaaagactatcagtaaggctaagggccagccccgtgagcctcaggtgtacaccttgccgccttccagagacgaactcacaaaaaatcaagttagtctaacatgtctggtcaagggattctacccgtccgacatcgcggtcgaatgggagtcaaatggacagccagaaaacaactataaaacaactccaccggttctggattccgatggtagctttttcctgtatagtaaactcacagttgataagtctcgatggcagcagggcaacgtgttcagctgcagcgtcatgcacgaggctctccataaccactatacccagaaatctctcagtctgtcccctggaaaaagcggggggtcttccagaggtgagcagaaactgattagtgaggaggatctgatcgaggtcatgtaccccccaccttatctcgataatgaaaagtcaaatggcactataatccacgttaagggcaagcatctttgcccatcacctttgttcccaggaccctcaaaaccattttgggtgctggtggtagtgggcggcgtattggcctgttattctctgcttgtgaccgtggcatttattatattttgggtgagatctaagaggtcgcgcctattacactcggattacatgaaccgggttaggcaagggtacagctgagctagcttgactgactgagatacagcgtaccttcagctcacagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtattggcccatctctatcggtatcgtagcataaccccttggggcctctaaacgggtcttgaggggttttttgtgcccctcgggccggattgctatctaccggcattggcgcagaaaaaaatgcctgatgcgacgctgcgcgtcttatactcccacatatgccagattcagcaacggatacggcttccccaacttgcccacttccatacgtgtcctccttaccagaaatttatccttaaggtcgtcagctatcctgcaggcgatctctcgatttcgatcaagacattcctttaatggtcttttctggacaccactaggggtcagaagtagttcatcaaactttcttccctccctaatctcattggttaccttgggctatcgaaacttaattaaccagtcaagtcagctacttggcgagatcgacttgtctgggtttcgactacgctcagaattgcgtcagtcaagttcgatctggtccttgctattgcacccgttctccgattacgagtttcatttaaatcatgtgagcaaaaggccagcaaaaggccaggaaccgtaaaaaggccgcgttgctggcgtt

SEQ ID NO: 8131 - DNA, 5791 bp, unidentified
  source 1..5791: mol_type = unassigned DNA
tttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcatttaaatttccgaactctccaaggccctcgtcggaaaatcttcaaacctttcgtccgatccatcttgcaggctacctctcgaacgaactatcgcaagtctcttggccggccttgcgccttggctattgcttggcagcgcctatcgccaggtattactccaatcccgaatatccgagatcgggatcacccgagagaagttcaacctacatcctcaatcccgatctatccgagatccgaggaatatcgaaatcggggcgcgcctggtgtaccgagaacgatcctctcagtgcgagtctcgacgatccatatcgttgcttggcagtcagccagtcggaatccagcttgggacccaggaagtccaatcgtcagatattgtactcaagcctggtcacggcagcgtaccgatctgtttaaacctagatattgatagtctgatcggtcaacgtataatcgagtcctagcttttgcaaacatctatcaagagacaggatcagcaggaggctttcgcatgagtattcaacatttccgtgtcgcccttattcccttttttgcggcattttgccttcctgtttttgctcacccagaaacgctggtgaaagtaaaagatgctgaagatcagttgggtgcgcgagtgggttacatcgaactggatctcaacagcggtaagatccttgagagttttcgccccgaagaacgctttccaatgatgagcacttttaaagttctgctatgtggcgcggtattatcccgtattgacgccgggcaagagcaactcggtcgccgcatacactattctcagaatgacttggttgagtattcaccagtcacagaaaagcatcttacggatggcatgacagtaagagaattatgcagtgctgccataaccatgagtgataacactgcggccaacttacttctgacaacgattggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaaccttgcgtaaactattaactggcgaactacttactctagcttcccggcaacagttgatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaaccgattctaggtgcattggcgcagaaaaaaatgcctgatgcgacgctgcgcgtcttatactcccacatatgccagattcagcaacggatacggcttccccaacttgcccacttccatacgtgtcctccttaccagaaatttatccttaagatcccgaatcgtttaaactcgactctggctctatcgaatctccgtcgtttcgagcttacgcgaacagccgtggcgctcatttgctcgtcgggcatcgaatctcgtcagctatcgtcagcttacctttttggcagcgatcgcggctcccgacatcttggaccattagctccacaggtatcttcttccctctagtggtcataacagcagcttcagctacctctcaattcaaaaaacccctcaagacccgtttagaggccccaaggggttatgctatcaatcgttgcgttacacacacaaaaaaccaacacacatccatcttcgatggatagcgattttattatctaactgctgatcgagtgtagccagatctagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatgctgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctggtttagtgaaccgtcagatcgcctggagacgccatccacgctgttttgacctccatagaagacaccgggaccgatccagcctcccctcgaagcttacatgtggtaccgagctcggatcctgagaacttcagggtgagtctatgggacccttgatgttttctttccccttcttttctatggttaagttcatgtcataggaaggggagaagtaacagggtacacatattgaccaaatcagggtaattttgcatttgtaattttaaaaaatgctttcttcttttaatatacttttttgtttatcttatttctaatactttccctaatctctttctttcagggcaataatgatacaatgtatcatgcctctttgcaccattctaaagaataacagtgataatttctgggttaaggcaatagcaatatttctgcatataaatatttctgcatataaattgtaactgatgtaagaggtttcatattgctaatagcagctacaatccagctaccattctgcttttattttatggttgggataaggctggattattctgagtccaagctaggcccttttgctaatcatgttcatacctcttatcttcctcccacagctcctgggcaacgtgctggtctgtgtgctggcccatcactttggcaaaggcggccgcgccgccaccatggagacagacacactcctgctatgggtactgctgctctgggttccaggttccactggtgacgccatccagatgacgcagtctccgtccagtctgtcagcctctgtgggcgaccgggttaccatcacttgtagagccagccaggatatccgcaattacctcaactggtaccaacagaagcctggtaaggcccccaagctactgatctattacactagtcgtttggaaagcggggtgccctcccgattcagcgggtctgggagtgggacagactacacactgaccatttcatcccttcaacctgaggactttgctacttactactgccagcaaggcaacaccctgccttggacgtttggacagggcactaaagtggagattaaaggcggagggggaagcggcggaggggggtcaggcggaggaggcagtggtggtggtggttctggaggaggatcagaggtacaactagtggaatcaggaggagggctcgtgcagccagggggtagcctgcggctttcctgtgctgctagcggctattctttcacagggtatacaatgaattgggttaggcaggcaccaggaaagggattagaatgggtcgcgttgataaacccctataaaggtgtaagtacctacaatcagaaattcaaagacaggttcaccattagcgtggacaagagcaagaatacagcttatctgcaaatgaactctctgagagccgaggataccgcagtatattactgcgcacgctccggctactacggtgattctgattggtattttgatgtttggggccagggaactctcgtgaccgtcagcagtgaacaaaaactcatctcagaagaggatctgaatgctgtgggccaggacacgcaggaggtcatcgtggtgccacactccttgccctttaaggtggtggtgatctcagccatcctggccctggtggtgctcaccatcatctcccttatcatcctcatcatgctttggcagaagaagccacgttgagctagcttgactgactgagatacagcgtaccttcagctcacagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtattggcccatctctatcggtatcgtagcataaccccttggggcctctaaacgggtcttgaggggttttttgtgcccctcgggccggattgctatctaccggcattggcgcagaaaaaaatgcctgatgcgacgctgcgcgtcttatactcccacatatgccagattcagcaacggatacggcttccccaacttgcccacttccatacgtgtcctccttaccagaaatttatccttaaggtcgtcagctatcctgcaggcgatctctcgatttcgatcaagacattcctttaatggtcttttctggacaccactaggggtcagaagtagttcatcaaactttcttccctccctaatctcattggttaccttgggctatcgaaacttaattaaccagtcaagtcagctacttggcgagatcgacttgtctgggtttcgactacgctcagaattgcgtcagtcaagttcgatctggtccttgctattgcacccgttctccgattacgagtttcatttaaatcatgtgagcaaaaggccagcaaaaggccaggaaccgtaaaaaggccgcgttgctggcgtt

SEQ ID NO: 8132 - DNA, 6619 bp, unidentified
  source 1..6619: mol_type = unassigned DNA
tttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcatttaaatttccgaactctccaaggccctcgtcggaaaatcttcaaacctttcgtccgatccatcttgcaggctacctctcgaacgaactatcgcaagtctcttggccggccttgcgccttggctattgcttggcagcgcctatcgccaggtattactccaatcccgaatatccgagatcgggatcacccgagagaagttcaacctacatcctcaatcccgatctatccgagatccgaggaatatcgaaatcggggcgcgcctggtgtaccgagaacgatcctctcagtgcgagtctcgacgatccatatcgttgcttggcagtcagccagtcggaatccagcttgggacccaggaagtccaatcgtcagatattgtactcaagcctggtcacggcagcgtaccgatctgtttaaacctagatattgatagtctgatcggtcaacgtataatcgagtcctagcttttgcaaacatctatcaagagacaggatcagcaggaggctttcgcatgagtattcaacatttccgtgtcgcccttattcccttttttgcggcattttgccttcctgtttttgctcacccagaaacgctggtgaaagtaaaagatgctgaagatcagttgggtgcgcgagtgggttacatcgaactggatctcaacagcggtaagatccttgagagttttcgccccgaagaacgctttccaatgatgagcacttttaaagttctgctatgtggcgcggtattatcccgtattgacgccgggcaagagcaactcggtcgccgcatacactattctcagaatgacttggttgagtattcaccagtcacagaaaagcatcttacggatggcatgacagtaagagaattatgcagtgctgccataaccatgagtgataacactgcggccaacttacttctgacaacgattggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaaccttgcgtaaactattaactggcgaactacttactctagcttcccggcaacagttgatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaaccgattctaggtgcattggcgcagaaaaaaatgcctgatgcgacgctgcgcgtcttatactcccacatatgccagattcagcaacggatacggcttccccaacttgcccacttccatacgtgtcctccttaccagaaatttatccttaagatcccgaatcgtttaaactcgactctggctctatcgaatctccgtcgtttcgagcttacgcgaacagccgtggcgctcatttgctcgtcgggcatcgaatctcgtcagctatcgtcagcttacctttttggcagcgatcgcggctcccgacatcttggaccattagctccacaggtatcttcttccctctagtggtcataacagcagcttcagctacctctcaattcaaaaaacccctcaagacccgtttagaggccccaaggggttatgctatcaatcgttgcgttacacacacaaaaaaccaacacacatccatcttcgatggatagcgattttattatctaactgctgatcgagtgtagccagatctagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatgctgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctggtttagtgaaccgtcagatcgcctggagacgccatccacgctgttttgacctccatagaagacaccgggaccgatccagcctcccctcgaagcttacatgtggtaccgagctcggatcctgagaacttcagggtgagtctatgggacccttgatgttttctttccccttcttttctatggttaagttcatgtcataggaaggggagaagtaacagggtacacatattgaccaaatcagggtaattttgcatttgtaattttaaaaaatgctttcttcttttaatatacttttttgtttatcttatttctaatactttccctaatctctttctttcagggcaataatgatacaatgtatcatgcctctttgcaccattctaaagaataacagtgataatttctgggttaaggcaatagcaatatttctgcatataaatatttctgcatataaattgtaactgatgtaagaggtttcatattgctaatagcagctacaatccagctaccattctgcttttattttatggttgggataaggctggattattctgagtccaagctaggcccttttgctaatcatgttcatacctcttatcttcctcccacagctcctgggcaacgtgctggtctgtgtgctggcccatcactttggcaaaggcggccgcgccgccaccatggagacagacacactcctgctatgggtactgctgctctgggttccaggttccactggtgacgccatccagatgacgcagtctccgtccagtctgtcagcctctgtgggcgaccgggttaccatcacttgtagagccagccaggatatccgcaattacctcaactggtaccaacagaagcctggtaaggcccccaagctactgatctattacactagtcgtttggaaagcggggtgccctcccgattcagcgggtctgggagtgggacagactacacactgaccatttcatcccttcaacctgaggactttgctacttactactgccagcaaggcaacaccctgccttggacgtttggacagggcactaaagtggagattaaaggcggagggggaagcggcggaggggggtcaggcggaggaggcagtggtggtggtggttctggaggaggatcagaggtacaactagtggaatcaggaggagggctcgtgcagccagggggtagcctgcggctttcctgtgctgctagcggctattctttcacagggtatacaatgaattgggttaggcaggcaccaggaaagggattagaatgggtcgcgttgataaacccctataaaggtgtaagtacctacaatcagaaattcaaagacaggttcaccattagcgtggacaagagcaagaatacagcttatctgcaaatgaactctctgagagccgaggataccgcagtatattactgcgcacgctccggctactacggtgattctgattggtattttgatgtttggggccagggaactctcgtgaccgtcagcagtgaacccaagtcatgcgacaagacgcacacctgccccccctgccctgcacctgaactgttggggggtccttctgtgttcctttttccacccaagccaaaagacaccttaatgattagccggacgcctgaagtcacatgtgtggtggtcgacgtgtcccatgaggacccagaggtgaagttcaattggtacgtggacggggtcgaggtgcacaatgccaaaaccaaaccccgcgaagagcagtacaacagcacttatagggttgtatccgtacttactgtcctgcatcaagactggctgaatggaaaagagtataagtgtaaagtgagcaacaaggccctcccagcccccatcgaaaagactatcagtaaggctaagggccagccccgtgagcctcaggtgtacaccttgccgccttccagagacgaactcacaaaaaatcaagttagtctaacatgtctggtcaagggattctacccgtccgacatcgcggtcgaatgggagtcaaatggacagccagaaaacaactataaaacaactccaccggttctggattccgatggtagctttttcctgtatagtaaactcacagttgataagtctcgatggcagcagggcaacgtgttcagctgcagcgtcatgcacgaggctctccataaccactatacccagaaatctctcagtctgtcccctggaaaaagcggggggtcttccagaggtgagcagaaactgattagtgaggaggatctgatcgaggtcatgtaccccccaccttatctcgataatgaaaagtcaaatggcactataatccacgttaagggcaagcatctttgcccatcacctttgttcccaggaccctcaaaaccattttgggtgctggtggtagtgggcggcgtattggcctgttattctctgcttgtgaccgtggcatttattatattttgggtgagatctaagaggtcgcgcctattacactcggattacatgaaccgggttaggcaagggtacagctgagctagcttgactgactgagatacagcgtaccttcagctcacagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtattggcccatctctatcggtatcgtagcataaccccttggggcctctaaacgggtcttgaggggttttttgtgcccctcgggccggattgctatctaccggcattggcgcagaaaaaaatgcctgatgcgacgctgcgcgtcttatactcccacatatgccagattcagcaacggatacggcttccccaacttgcccacttccatacgtgtcctccttaccagaaatttatccttaaggtcgtcagctatcctgcaggcgatctctcgatttcgatcaagacattcctttaatggtcttttctggacaccactaggggtcagaagtagttcatcaaactttcttccctccctaatctcattggttaccttgggctatcgaaacttaattaaccagtcaagtcagctacttggcgagatcgacttgtctgggtttcgactacgctcagaattgcgtcagtcaagttcgatctggtccttgctattgcacccgttctccgattacgagtttcatttaaatcatgtgagcaaaaggccagcaaaaggccaggaaccgtaaaaaggccgcgttgctggcgtt

SEQ ID NO: 8133 - DNA, 6583 bp, unidentified
  source 1..6583: mol_type = unassigned DNA
tttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcatttaaatttccgaactctccaaggccctcgtcggaaaatcttcaaacctttcgtccgatccatcttgcaggctacctctcgaacgaactatcgcaagtctcttggccggccttgcgccttggctattgcttggcagcgcctatcgccaggtattactccaatcccgaatatccgagatcgggatcacccgagagaagttcaacctacatcctcaatcccgatctatccgagatccgaggaatatcgaaatcggggcgcgcctggtgtaccgagaacgatcctctcagtgcgagtctcgacgatccatatcgttgcttggcagtcagccagtcggaatccagcttgggacccaggaagtccaatcgtcagatattgtactcaagcctggtcacggcagcgtaccgatctgtttaaacctagatattgatagtctgatcggtcaacgtataatcgagtcctagcttttgcaaacatctatcaagagacaggatcagcaggaggctttcgcatgagtattcaacatttccgtgtcgcccttattcccttttttgcggcattttgccttcctgtttttgctcacccagaaacgctggtgaaagtaaaagatgctgaagatcagttgggtgcgcgagtgggttacatcgaactggatctcaacagcggtaagatccttgagagttttcgccccgaagaacgctttccaatgatgagcacttttaaagttctgctatgtggcgcggtattatcccgtattgacgccgggcaagagcaactcggtcgccgcatacactattctcagaatgacttggttgagtattcaccagtcacagaaaagcatcttacggatggcatgacagtaagagaattatgcagtgctgccataaccatgagtgataacactgcggccaacttacttctgacaacgattggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaaccttgcgtaaactattaactggcgaactacttactctagcttcccggcaacagttgatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaaccgattctaggtgcattggcgcagaaaaaaatgcctgatgcgacgctgcgcgtcttatactcccacatatgccagattcagcaacggatacggcttccccaacttgcccacttccatacgtgtcctccttaccagaaatttatccttaagatcccgaatcgtttaaactcgactctggctctatcgaatctccgtcgtttcgagcttacgcgaacagccgtggcgctcatttgctcgtcgggcatcgaatctcgtcagctatcgtcagcttacctttttggcagcgatcgcggctcccgacatcttggaccattagctccacaggtatcttcttccctctagtggtcataacagcagcttcagctacctctcaattcaaaaaacccctcaagacccgtttagaggccccaaggggttatgctatcaatcgttgcgttacacacacaaaaaaccaacacacatccatcttcgatggatagcgattttattatctaactgctgatcgagtgtagccagatctagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatgctgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctggtttagtgaaccgtcagatcgcctggagacgccatccacgctgttttgacctccatagaagacaccgggaccgatccagcctcccctcgaagcttacatgtggtaccgagctcggatcctgagaacttcagggtgagtctatgggacccttgatgttttctttccccttcttttctatggttaagttcatgtcataggaaggggagaagtaacagggtacacatattgaccaaatcagggtaattttgcatttgtaattttaaaaaatgctttcttcttttaatatacttttttgtttatcttatttctaatactttccctaatctctttctttcagggcaataatgatacaatgtatcatgcctctttgcaccattctaaagaataacagtgataatttctgggttaaggcaatagcaatatttctgcatataaatatttctgcatataaattgtaactgatgtaagaggtttcatattgctaatagcagctacaatccagctaccattctgcttttattttatggttgggataaggctggattattctgagtccaagctaggcccttttgctaatcatgttcatacctcttatcttcctcccacagctcctgggcaacgtgctggtctgtgtgctggcccatcactttggcaaaggcggccgcgccgccaccatggagacagacacactcctgctatgggtactgctgctctgggttccaggttccactggtgacgaggttaagctggtggaatccggtggaggcctagtccaaccgggaaagtcgctgaagttgtcttgtgaggcttcaggcttcaccttttctggctacggcatgcactgggtcagacaagcacccggcaggggactagaaagcgtggcctatatcacgagtagctctattaacattaaatatctggacgccgtgaagggaaggttcactgtcagtcgcgacaatgcaaagaatctgctcttcttacagatgaacattctcaagtcagaagataccgccatgtactattgcgcacgatttgattgggacaaaaattactggggacaagggactatggtaacagtttcaagcggagagggaacttcaacggggtctggcgggtcgggtgggtccgggggtgctgatgacatccagatgacccagagcccaagctccttgcccgcctctctgggggaccgggtgaccattaactgtcaggctagtcaggatatatctaactatctcaactggtatcagcagaaacctggtaaagccccaaaacttctcatctactacacaaacaagctggcggacggggtgccaagccggttctccggcagtggcagcggcagagattccagctttacaatatcctccctggagagtgaggacatcggctcatactactgccagcagtactataattacccctggaccttcgggcctggaacaaaacttgaaatcaaggaacccaagtcatgcgacaagacgcacacctgccccccctgccctgcacctgaactgttggggggtccttctgtgttcctttttccacccaagccaaaagacaccttaatgattagccggacgcctgaagtcacatgtgtggtggtcgacgtgtcccatgaggacccagaggtgaagttcaattggtacgtggacggggtcgaggtgcacaatgccaaaaccaaaccccgcgaagagcagtacaacagcacttatagggttgtatccgtacttactgtcctgcatcaagactggctgaatggaaaagagtataagtgtaaagtgagcaacaaggccctcccagcccccatcgaaaagactatcagtaaggctaagggccagccccgtgagcctcaggtgtacaccttgccgccttccagagacgaactcacaaaaaatcaagttagtctaacatgtctggtcaagggattctacccgtccgacatcgcggtcgaatgggagtcaaatggacagccagaaaacaactataaaacaactccaccggttctggattccgatggtagctttttcctgtatagtaaactcacagttgataagtctcgatggcagcagggcaacgtgttcagctgcagcgtcatgcacgaggctctccataaccactatacccagaaatctctcagtctgtcccctggaaaaagcggggggtcttccagaggtgagcagaaactgattagtgaggaggatctgatcgaggtcatgtaccccccaccttatctcgataatgaaaagtcaaatggcactataatccacgttaagggcaagcatctttgcccatcacctttgttcccaggaccctcaaaaccattttgggtgctggtggtagtgggcggcgtattggcctgttattctctgcttgtgaccgtggcatttattatattttgggtgagatctaagaggtcgcgcctattacactcggattacatgaaccgggttaggcaagggtacagctgagctagcttgactgactgagatacagcgtaccttcagctcacagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtattggcccatctctatcggtatcgtagcataaccccttggggcctctaaacgggtcttgaggggttttttgtgcccctcgggccggattgctatctaccggcattggcgcagaaaaaaatgcctgatgcgacgctgcgcgtcttatactcccacatatgccagattcagcaacggatacggcttccccaacttgcccacttccatacgtgtcctccttaccagaaatttatccttaaggtcgtcagctatcctgcaggcgatctctcgatttcgatcaagacattcctttaatggtcttttctggacaccactaggggtcagaagtagttcatcaaactttcttccctccctaatctcattggttaccttgggctatcgaaacttaattaaccagtcaagtcagctacttggcgagatcgacttgtctgggtttcgactacgctcagaattgcgtcagtcaagttcgatctggtccttgctattgcacccgttctccgattacgagtttcatttaaatcatgtgagcaaaaggccagcaaaaggccaggaaccgtaaaaaggccgcgttgctggcgtt

SEQ ID NO: 8134 - DNA, 6598 bp, unidentified
  source 1..6598: mol_type = unassigned DNA
tttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcatttaaatttccgaactctccaaggccctcgtcggaaaatcttcaaacctttcgtccgatccatcttgcaggctacctctcgaacgaactatcgcaagtctcttggccggccttgcgccttggctattgcttggcagcgcctatcgccaggtattactccaatcccgaatatccgagatcgggatcacccgagagaagttcaacctacatcctcaatcccgatctatccgagatccgaggaatatcgaaatcggggcgcgcctggtgtaccgagaacgatcctctcagtgcgagtctcgacgatccatatcgttgcttggcagtcagccagtcggaatccagcttgggacccaggaagtccaatcgtcagatattgtactcaagcctggtcacggcagcgtaccgatctgtttaaacctagatattgatagtctgatcggtcaacgtataatcgagtcctagcttttgcaaacatctatcaagagacaggatcagcaggaggctttcgcatgagtattcaacatttccgtgtcgcccttattcccttttttgcggcattttgccttcctgtttttgctcacccagaaacgctggtgaaagtaaaagatgctgaagatcagttgggtgcgcgagtgggttacatcgaactggatctcaacagcggtaagatccttgagagttttcgccccgaagaacgctttccaatgatgagcacttttaaagttctgctatgtggcgcggtattatcccgtattgacgccgggcaagagcaactcggtcgccgcatacactattctcagaatgacttggttgagtattcaccagtcacagaaaagcatcttacggatggcatgacagtaagagaattatgcagtgctgccataaccatgagtgataacactgcggccaacttacttctgacaacgattggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaaccttgcgtaaactattaactggcgaactacttactctagcttcccggcaacagttgatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaaccgattctaggtgcattggcgcagaaaaaaatgcctgatgcgacgctgcgcgtcttatactcccacatatgccagattcagcaacggatacggcttccccaacttgcccacttccatacgtgtcctccttaccagaaatttatccttaagatcccgaatcgtttaaactcgactctggctctatcgaatctccgtcgtttcgagcttacgcgaacagccgtggcgctcatttgctcgtcgggcatcgaatctcgtcagctatcgtcagcttacctttttggcagcgatcgcggctcccgacatcttggaccattagctccacaggtatcttcttccctctagtggtcataacagcagcttcagctacctctcaattcaaaaaacccctcaagacccgtttagaggccccaaggggttatgctatcaatcgttgcgttacacacacaaaaaaccaacacacatccatcttcgatggatagcgattttattatctaactgctgatcgagtgtagccagatctagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatgctgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctggtttagtgaaccgtcagatcgcctggagacgccatccacgctgttttgacctccatagaagacaccgggaccgatccagcctcccctcgaagcttacatgtggtaccgagctcggatcctgagaacttcagggtgagtctatgggacccttgatgttttctttccccttcttttctatggttaagttcatgtcataggaaggggagaagtaacagggtacacatattgaccaaatcagggtaattttgcatttgtaattttaaaaaatgctttcttcttttaatatacttttttgtttatcttatttctaatactttccctaatctctttctttcagggcaataatgatacaatgtatcatgcctctttgcaccattctaaagaataacagtgataatttctgggttaaggcaatagcaatatttctgcatataaatatttctgcatataaattgtaactgatgtaagaggtttcatattgctaatagcagctacaatccagctaccattctgcttttattttatggttgggataaggctggattattctgagtccaagctaggcccttttgctaatcatgttcatacctcttatcttcctcccacagctcctgggcaacgtgctggtctgtgtgctggcccatcactttggcaaaggcggccgcgccgccaccatggagacagacacactcctgctatgggtactgctgctctgggttccaggttccactggtgacgatatacagatgactcagtcgccttcaagcgtgagcgctagtgtcggggacagagtgacaatcacgtgtagggctagccaggacatcagcagctggcttgcctggtaccagcacaagcctgggaaagctcccaagttgctgatttacgcagcgtcctccctgcagtcaggcgtccccagccgattttcaggttcgggatctggcactgacttcaccctcaccatcagttccctacagcctgaggatttcgccacatactactgtcaacaagccaattccttcccatatactttcggccagggaactaaactggaaataaagggaggaggtggcagtggaggaggagggtctggtgggggagggagtggtggaggaggatcaggaggaggatcacaggtgcagcttcagcagtggggtgcaggactcttgaagccaagcgagacgctgtccctgacctgcgccgtatatggtggaagcttctcaggctattattggagttggatcaggcaaccacccgggaaagggctcgaatggattggcgagattaatcattcaggctctaccaactacaaccccagcctgaagtctcgcgtaacaattagtgtggacacatccaagaaccaattttccctcaaactgagctctgttaccgccgcggacaccgcagtttattactgcgcccgggtcatcaattggtttgatccgtggggacaggggacattagtgaccgtgagcagtgaacccaagtcatgcgacaagacgcacacctgccccccctgccctgcacctgaactgttggggggtccttctgtgttcctttttccacccaagccaaaagacaccttaatgattagccggacgcctgaagtcacatgtgtggtggtcgacgtgtcccatgaggacccagaggtgaagttcaattggtacgtggacggggtcgaggtgcacaatgccaaaaccaaaccccgcgaagagcagtacaacagcacttatagggttgtatccgtacttactgtcctgcatcaagactggctgaatggaaaagagtataagtgtaaagtgagcaacaaggccctcccagcccccatcgaaaagactatcagtaaggctaagggccagccccgtgagcctcaggtgtacaccttgccgccttccagagacgaactcacaaaaaatcaagttagtctaacatgtctggtcaagggattctacccgtccgacatcgcggtcgaatgggagtcaaatggacagccagaaaacaactataaaacaactccaccggttctggattccgatggtagctttttcctgtatagtaaactcacagttgataagtctcgatggcagcagggcaacgtgttcagctgcagcgtcatgcacgaggctctccataaccactatacccagaaatctctcagtctgtcccctggaaaaagcggggggtcttccagaggtgagcagaaactgattagtgaggaggatctgatcgaggtcatgtaccccccaccttatctcgataatgaaaagtcaaatggcactataatccacgttaagggcaagcatctttgcccatcacctttgttcccaggaccctcaaaaccattttgggtgctggtggtagtgggcggcgtattggcctgttattctctgcttgtgaccgtggcatttattatattttgggtgagatctaagaggtcgcgcctattacactcggattacatgaaccgggttaggcaagggtacagctgagctagcttgactgactgagatacagcgtaccttcagctcacagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtattggcccatctctatcggtatcgtagcataaccccttggggcctctaaacgggtcttgaggggttttttgtgcccctcgggccggattgctatctaccggcattggcgcagaaaaaaatgcctgatgcgacgctgcgcgtcttatactcccacatatgccagattcagcaacggatacggcttccccaacttgcccacttccatacgtgtcctccttaccagaaatttatccttaaggtcgtcagctatcctgcaggcgatctctcgatttcgatcaagacattcctttaatggtcttttctggacaccactaggggtcagaagtagttcatcaaactttcttccctccctaatctcattggttaccttgggctatcgaaacttaattaaccagtcaagtcagctacttggcgagatcgacttgtctgggtttcgactacgctcagaattgcgtcagtcaagttcgatctggtccttgctattgcacccgttctccgattacgagtttcatttaaatcatgtgagcaaaaggccagcaaaaggccaggaaccgtaaaaaggccgcgttgctggcgtt

SEQ ID NO: 8135 - DNA, 6601 bp, unidentified
  source 1..6601: mol_type = unassigned DNA
tttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcatttaaatttccgaactctccaaggccctcgtcggaaaatcttcaaacctttcgtccgatccatcttgcaggctacctctcgaacgaactatcgcaagtctcttggccggccttgcgccttggctattgcttggcagcgcctatcgccaggtattactccaatcccgaatatccgagatcgggatcacccgagagaagttcaacctacatcctcaatcccgatctatccgagatccgaggaatatcgaaatcggggcgcgcctggtgtaccgagaacgatcctctcagtgcgagtctcgacgatccatatcgttgcttggcagtcagccagtcggaatccagcttgggacccaggaagtccaatcgtcagatattgtactcaagcctggtcacggcagcgtaccgatctgtttaaacctagatattgatagtctgatcggtcaacgtataatcgagtcctagcttttgcaaacatctatcaagagacaggatcagcaggaggctttcgcatgagtattcaacatttccgtgtcgcccttattcccttttttgcggcattttgccttcctgtttttgctcacccagaaacgctggtgaaagtaaaagatgctgaagatcagttgggtgcgcgagtgggttacatcgaactggatctcaacagcggtaagatccttgagagttttcgccccgaagaacgctttccaatgatgagcacttttaaagttctgctatgtggcgcggtattatcccgtattgacgccgggcaagagcaactcggtcgccgcatacactattctcagaatgacttggttgagtattcaccagtcacagaaaagcatcttacggatggcatgacagtaagagaattatgcagtgctgccataaccatgagtgataacactgcggccaacttacttctgacaacgattggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaaccttgcgtaaactattaactggcgaactacttactctagcttcccggcaacagttgatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaaccgattctaggtgcattggcgcagaaaaaaatgcctgatgcgacgctgcgcgtcttatactcccacatatgccagattcagcaacggatacggcttccccaacttgcccacttccatacgtgtcctccttaccagaaatttatccttaagatcccgaatcgtttaaactcgactctggctctatcgaatctccgtcgtttcgagcttacgcgaacagccgtggcgctcatttgctcgtcgggcatcgaatctcgtcagctatcgtcagcttacctttttggcagcgatcgcggctcccgacatcttggaccattagctccacaggtatcttcttccctctagtggtcataacagcagcttcagctacctctcaattcaaaaaacccctcaagacccgtttagaggccccaaggggttatgctatcaatcgttgcgttacacacacaaaaaaccaacacacatccatcttcgatggatagcgattttattatctaactgctgatcgagtgtagccagatctagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatgctgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctggtttagtgaaccgtcagatcgcctggagacgccatccacgctgttttgacctccatagaagacaccgggaccgatccagcctcccctcgaagcttacatgtggtaccgagctcggatcctgagaacttcagggtgagtctatgggacccttgatgttttctttccccttcttttctatggttaagttcatgtcataggaaggggagaagtaacagggtacacatattgaccaaatcagggtaattttgcatttgtaattttaaaaaatgctttcttcttttaatatacttttttgtttatcttatttctaatactttccctaatctctttctttcagggcaataatgatacaatgtatcatgcctctttgcaccattctaaagaataacagtgataatttctgggttaaggcaatagcaatatttctgcatataaatatttctgcatataaattgtaactgatgtaagaggtttcatattgctaatagcagctacaatccagctaccattctgcttttattttatggttgggataaggctggattattctgagtccaagctaggcccttttgctaatcatgttcatacctcttatcttcctcccacagctcctgggcaacgtgctggtctgtgtgctggcccatcactttggcaaaggcggccgcgccgccaccatggagacagacacactcctgctatgggtactgctgctctgggttccaggttccactggtgacgataccgtgcttacgcagtctcctgcattggccgtcagtccaggggaacgcgtgacgatctcatgcagggccaccgagcggtttagcacactgatccactggcttcagcagaggccaggtcaacagcccaaattactaatctatctgacctcccacctggattccggcgtccctgcgcggttctctggctctgggagtgggaccgattttactctaacaatagacccagtagaggccgacgacaccgctacgtattactgtcagcagacatggaacgatccgtggacctttggcggtggaacaaagctcgagctgaagcgaggaggaggtggcagtggaggaggagggtctggtgggggagggagtggtggaggaggatcaggaggaggatcagaggtgcaactgcaacaggacggcgcagaactgggaaaacccggaacttccgtgaagctgagctgtaaggtatcagactacaatatccgcagaacatacatgcattgggtgaaccagcgtcccggaaaagggctcgagtggattggtagaatagatcctgctaatggcaatactatttatggcgaaaagttcaaatcgaaagcgaccttgactgcagatactagcagcaacacagcctacatgcagctcagccaactgaagtccgacgacacagccatttacttctgcgctatcggcgtgcagtatctcgactactgggggcagggagtcatggttaccgttagctcagaacccaagtcatgcgacaagacgcacacctgccccccctgccctgcacctgaactgttggggggtccttctgtgttcctttttccacccaagccaaaagacaccttaatgattagccggacgcctgaagtcacatgtgtggtggtcgacgtgtcccatgaggacccagaggtgaagttcaattggtacgtggacggggtcgaggtgcacaatgccaaaaccaaaccccgcgaagagcagtacaacagcacttatagggttgtatccgtacttactgtcctgcatcaagactggctgaatggaaaagagtataagtgtaaagtgagcaacaaggccctcccagcccccatcgaaaagactatcagtaaggctaagggccagccccgtgagcctcaggtgtacaccttgccgccttccagagacgaactcacaaaaaatcaagttagtctaacatgtctggtcaagggattctacccgtccgacatcgcggtcgaatgggagtcaaatggacagccagaaaacaactataaaacaactccaccggttctggattccgatggtagctttttcctgtatagtaaactcacagttgataagtctcgatggcagcagggcaacgtgttcagctgcagcgtcatgcacgaggctctccataaccactatacccagaaatctctcagtctgtcccctggaaaaagcggggggtcttccagaggtgagcagaaactgattagtgaggaggatctgatcgaggtcatgtaccccccaccttatctcgataatgaaaagtcaaatggcactataatccacgttaagggcaagcatctttgcccatcacctttgttcccaggaccctcaaaaccattttgggtgctggtggtagtgggcggcgtattggcctgttattctctgcttgtgaccgtggcatttattatattttgggtgagatctaagaggtcgcgcctattacactcggattacatgaaccgggttaggcaagggtacagctgagctagcttgactgactgagatacagcgtaccttcagctcacagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtattggcccatctctatcggtatcgtagcataaccccttggggcctctaaacgggtcttgaggggttttttgtgcccctcgggccggattgctatctaccggcattggcgcagaaaaaaatgcctgatgcgacgctgcgcgtcttatactcccacatatgccagattcagcaacggatacggcttccccaacttgcccacttccatacgtgtcctccttaccagaaatttatccttaaggtcgtcagctatcctgcaggcgatctctcgatttcgatcaagacattcctttaatggtcttttctggacaccactaggggtcagaagtagttcatcaaactttcttccctccctaatctcattggttaccttgggctatcgaaacttaattaaccagtcaagtcagctacttggcgagatcgacttgtctgggtttcgactacgctcagaattgcgtcagtcaagttcgatctggtccttgctattgcacccgttctccgattacgagtttcatttaaatcatgtgagcaaaaggccagcaaaaggccaggaaccgtaaaaaggccgcgttgctggcgtt

SEQ ID NO: 8136 - DNA, 6601 bp, unidentified
  source 1..6601: mol_type = unassigned DNA
tttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcatttaaatttccgaactctccaaggccctcgtcggaaaatcttcaaacctttcgtccgatccatcttgcaggctacctctcgaacgaactatcgcaagtctcttggccggccttgcgccttggctattgcttggcagcgcctatcgccaggtattactccaatcccgaatatccgagatcgggatcacccgagagaagttcaacctacatcctcaatcccgatctatccgagatccgaggaatatcgaaatcggggcgcgcctggtgtaccgagaacgatcctctcagtgcgagtctcgacgatccatatcgttgcttggcagtcagccagtcggaatccagcttgggacccaggaagtccaatcgtcagatattgtactcaagcctggtcacggcagcgtaccgatctgtttaaacctagatattgatagtctgatcggtcaacgtataatcgagtcctagcttttgcaaacatctatcaagagacaggatcagcaggaggctttcgcatgagtattcaacatttccgtgtcgcccttattcccttttttgcggcattttgccttcctgtttttgctcacccagaaacgctggtgaaagtaaaagatgctgaagatcagttgggtgcgcgagtgggttacatcgaactggatctcaacagcggtaagatccttgagagttttcgccccgaagaacgctttccaatgatgagcacttttaaagttctgctatgtggcgcggtattatcccgtattgacgccgggcaagagcaactcggtcgccgcatacactattctcagaatgacttggttgagtattcaccagtcacagaaaagcatcttacggatggcatgacagtaagagaattatgcagtgctgccataaccatgagtgataacactgcggccaacttacttctgacaacgattggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaaccttgcgtaaactattaactggcgaactacttactctagcttcccggcaacagttgatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaaccgattctaggtgcattggcgcagaaaaaaatgcctgatgcgacgctgcgcgtcttatactcccacatatgccagattcagcaacggatacggcttccccaacttgcccacttccatacgtgtcctccttaccagaaatttatccttaagatcccgaatcgtttaaactcgactctggctctatcgaatctccgtcgtttcgagcttacgcgaacagccgtggcgctcatttgctcgtcgggcatcgaatctcgtcagctatcgtcagcttacctttttggcagcgatcgcggctcccgacatcttggaccattagctccacaggtatcttcttccctctagtggtcataacagcagcttcagctacctctcaattcaaaaaacccctcaagacccgtttagaggccccaaggggttatgctatcaatcgttgcgttacacacacaaaaaaccaacacacatccatcttcgatggatagcgattttattatctaactgctgatcgagtgtagccagatctagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatgctgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctggtttagtgaaccgtcagatcgcctggagacgccatccacgctgttttgacctccatagaagacaccgggaccgatccagcctcccctcgaagcttacatgtggtaccgagctcggatcctgagaacttcagggtgagtctatgggacccttgatgttttctttccccttcttttctatggttaagttcatgtcataggaaggggagaagtaacagggtacacatattgaccaaatcagggtaattttgcatttgtaattttaaaaaatgctttcttcttttaatatacttttttgtttatcttatttctaatactttccctaatctctttctttcagggcaataatgatacaatgtatcatgcctctttgcaccattctaaagaataacagtgataatttctgggttaaggcaatagcaatatttctgcatataaatatttctgcatataaattgtaactgatgtaagaggtttcatattgctaatagcagctacaatccagctaccattctgcttttattttatggttgggataaggctggattattctgagtccaagctaggcccttttgctaatcatgttcatacctcttatcttcctcccacagctcctgggcaacgtgctggtctgtgtgctggcccatcactttggcaaaggcggccgcgccgccaccatggagacagacacactcctgctatgggtactgctgctctgggttccaggttccactggtgacgatatacagatgacgcaaagccccgcttcactctcagccagtctgggggataaagtgacaatcacctgccaggcaagccagaacatcgacaagtatatcgcctggtaccagcaaaagccggggaaggccccccggcaactaatacactacaccagtaccctagtaagcggcaccccaagcaggttttctggtagtggaagtggacgagattattcctttagcattagctccgtggagtccgaagacattgccagctattactgtcttcaatacgataccctctatacattcggcgctgggactaaactcgaattgaaaggaggaggtggcagtggaggaggagggtctggtgggggagggagtggtggaggaggatcaggaggaggatcagaggtcaaactgcaggagtccgggcccagtcttgtgcagccttctcagacactgtccctcacgtgttctgtcagcggcttttcactgatttctgactctgttcattgggttagacagccacctggcaaggggctggaatggatgggaggaatttgggcggacggctccactgactacaattctgcactgaagtccaggctgtcgatctcaagagacacatccaagagtcagggcttcttaaaaatgaactcgttgcagaccgacgatacagcaatctacttctgcacttctaatcgcgagtcatactatttcgattactggggtcagggtgtgatggtcactgtgtcctcagaacccaagtcatgcgacaagacgcacacctgccccccctgccctgcacctgaactgttggggggtccttctgtgttcctttttccacccaagccaaaagacaccttaatgattagccggacgcctgaagtcacatgtgtggtggtcgacgtgtcccatgaggacccagaggtgaagttcaattggtacgtggacggggtcgaggtgcacaatgccaaaaccaaaccccgcgaagagcagtacaacagcacttatagggttgtatccgtacttactgtcctgcatcaagactggctgaatggaaaagagtataagtgtaaagtgagcaacaaggccctcccagcccccatcgaaaagactatcagtaaggctaagggccagccccgtgagcctcaggtgtacaccttgccgccttccagagacgaactcacaaaaaatcaagttagtctaacatgtctggtcaagggattctacccgtccgacatcgcggtcgaatgggagtcaaatggacagccagaaaacaactataaaacaactccaccggttctggattccgatggtagctttttcctgtatagtaaactcacagttgataagtctcgatggcagcagggcaacgtgttcagctgcagcgtcatgcacgaggctctccataaccactatacccagaaatctctcagtctgtcccctggaaaaagcggggggtcttccagaggtgagcagaaactgattagtgaggaggatctgatcgaggtcatgtaccccccaccttatctcgataatgaaaagtcaaatggcactataatccacgttaagggcaagcatctttgcccatcacctttgttcccaggaccctcaaaaccattttgggtgctggtggtagtgggcggcgtattggcctgttattctctgcttgtgaccgtggcatttattatattttgggtgagatctaagaggtcgcgcctattacactcggattacatgaaccgggttaggcaagggtacagctgagctagcttgactgactgagatacagcgtaccttcagctcacagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtattggcccatctctatcggtatcgtagcataaccccttggggcctctaaacgggtcttgaggggttttttgtgcccctcgggccggattgctatctaccggcattggcgcagaaaaaaatgcctgatgcgacgctgcgcgtcttatactcccacatatgccagattcagcaacggatacggcttccccaacttgcccacttccatacgtgtcctccttaccagaaatttatccttaaggtcgtcagctatcctgcaggcgatctctcgatttcgatcaagacattcctttaatggtcttttctggacaccactaggggtcagaagtagttcatcaaactttcttccctccctaatctcattggttaccttgggctatcgaaacttaattaaccagtcaagtcagctacttggcgagatcgacttgtctgggtttcgactacgctcagaattgcgtcagtcaagttcgatctggtccttgctattgcacccgttctccgattacgagtttcatttaaatcatgtgagcaaaaggccagcaaaaggccaggaaccgtaaaaaggccgcgttgctggcgtt

SEQ ID NO: 8137 - DNA, 6607 bp, unidentified
  source 1..6607: mol_type = unassigned DNA
tttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcatttaaatttccgaactctccaaggccctcgtcggaaaatcttcaaacctttcgtccgatccatcttgcaggctacctctcgaacgaactatcgcaagtctcttggccggccttgcgccttggctattgcttggcagcgcctatcgccaggtattactccaatcccgaatatccgagatcgggatcacccgagagaagttcaacctacatcctcaatcccgatctatccgagatccgaggaatatcgaaatcggggcgcgcctggtgtaccgagaacgatcctctcagtgcgagtctcgacgatccatatcgttgcttggcagtcagccagtcggaatccagcttgggacccaggaagtccaatcgtcagatattgtactcaagcctggtcacggcagcgtaccgatctgtttaaacctagatattgatagtctgatcggtcaacgtataatcgagtcctagcttttgcaaacatctatcaagagacaggatcagcaggaggctttcgcatgagtattcaacatttccgtgtcgcccttattcccttttttgcggcattttgccttcctgtttttgctcacccagaaacgctggtgaaagtaaaagatgctgaagatcagttgggtgcgcgagtgggttacatcgaactggatctcaacagcggtaagatccttgagagttttcgccccgaagaacgctttccaatgatgagcacttttaaagttctgctatgtggcgcggtattatcccgtattgacgccgggcaagagcaactcggtcgccgcatacactattctcagaatgacttggttgagtattcaccagtcacagaaaagcatcttacggatggcatgacagtaagagaattatgcagtgctgccataaccatgagtgataacactgcggccaacttacttctgacaacgattggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaaccttgcgtaaactattaactggcgaactacttactctagcttcccggcaacagttgatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaaccgattctaggtgcattggcgcagaaaaaaatgcctgatgcgacgctgcgcgtcttatactcccacatatgccagattcagcaacggatacggcttccccaacttgcccacttccatacgtgtcctccttaccagaaatttatccttaagatcccgaatcgtttaaactcgactctggctctatcgaatctccgtcgtttcgagcttacgcgaacagccgtggcgctcatttgctcgtcgggcatcgaatctcgtcagctatcgtcagcttacctttttggcagcgatcgcggctcccgacatcttggaccattagctccacaggtatcttcttccctctagtggtcataacagcagcttcagctacctctcaattcaaaaaacccctcaagacccgtttagaggccccaaggggttatgctatcaatcgttgcgttacacacacaaaaaaccaacacacatccatcttcgatggatagcgattttattatctaactgctgatcgagtgtagccagatctagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatgctgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctggtttagtgaaccgtcagatcgcctggagacgccatccacgctgttttgacctccatagaagacaccgggaccgatccagcctcccctcgaagcttacatgtggtaccgagctcggatcctgagaacttcagggtgagtctatgggacccttgatgttttctttccccttcttttctatggttaagttcatgtcataggaaggggagaagtaacagggtacacatattgaccaaatcagggtaattttgcatttgtaattttaaaaaatgctttcttcttttaatatacttttttgtttatcttatttctaatactttccctaatctctttctttcagggcaataatgatacaatgtatcatgcctctttgcaccattctaaagaataacagtgataatttctgggttaaggcaatagcaatatttctgcatataaatatttctgcatataaattgtaactgatgtaagaggtttcatattgctaatagcagctacaatccagctaccattctgcttttattttatggttgggataaggctggattattctgagtccaagctaggcccttttgctaatcatgttcatacctcttatcttcctcccacagctcctgggcaacgtgctggtctgtgtgctggcccatcactttggcaaaggcggccgcgccgccaccatggagacagacacactcctgctatgggtactgctgctctgggttccaggttccactggtgacgacgtacaaatcacccagagcccatcgtctctgtcagcatctgtgggtgacagggtcactattacctgcaggacgtcacggtcaatctcccagtacctcgcttggtatcagcagaagcccggcaaggtgccgaaactcctgatctacagtgggagtactttacagtccggggtgccatcccgatttagcggatccgggagcggaacagacttcactcttacaatctcaagcctgcaaccagaggacgttgctacatactactgtcaacagcataatgaaaatcccttgaccttcggcggcggaaccaaagtggaaattaagggaggaggtggcagtggaggaggagggtctggtgggggagggagtggtggaggaggatcaggaggaggatcagaagtgcagttggtcgagagcgggggcgggctagtgcagcctggtggcagtctgcgcctctcctgtgccgcgtctggtttcaacattaaagatacgtatatacactttgtccggcaggcacccggcaaggggctggagtggattggcagaatagaccctgccaacgataacacactttatgcctctaagttccagggcaaggcgacaatcagcgccgatacaagcaaaaacaccgcctacctgcaaatgaatagtctccgcgctgaggataccgcagtatattactgcggaagagggtacggttactatgtctttgaccactggggacagggcaccctggttactgtgagcagcgaacccaagtcatgcgacaagacgcacacctgccccccctgccctgcacctgaactgttggggggtccttctgtgttcctttttccacccaagccaaaagacaccttaatgattagccggacgcctgaagtcacatgtgtggtggtcgacgtgtcccatgaggacccagaggtgaagttcaattggtacgtggacggggtcgaggtgcacaatgccaaaaccaaaccccgcgaagagcagtacaacagcacttatagggttgtatccgtacttactgtcctgcatcaagactggctgaatggaaaagagtataagtgtaaagtgagcaacaaggccctcccagcccccatcgaaaagactatcagtaaggctaagggccagccccgtgagcctcaggtgtacaccttgccgccttccagagacgaactcacaaaaaatcaagttagtctaacatgtctggtcaagggattctacccgtccgacatcgcggtcgaatgggagtcaaatggacagccagaaaacaactataaaacaactccaccggttctggattccgatggtagctttttcctgtatagtaaactcacagttgataagtctcgatggcagcagggcaacgtgttcagctgcagcgtcatgcacgaggctctccataaccactatacccagaaatctctcagtctgtcccctggaaaaagcggggggtcttccagaggtgagcagaaactgattagtgaggaggatctgatcgaggtcatgtaccccccaccttatctcgataatgaaaagtcaaatggcactataatccacgttaagggcaagcatctttgcccatcacctttgttcccaggaccctcaaaaccattttgggtgctggtggtagtgggcggcgtattggcctgttattctctgcttgtgaccgtggcatttattatattttgggtgagatctaagaggtcgcgcctattacactcggattacatgaaccgggttaggcaagggtacagctgagctagcttgactgactgagatacagcgtaccttcagctcacagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtattggcccatctctatcggtatcgtagcataaccccttggggcctctaaacgggtcttgaggggttttttgtgcccctcgggccggattgctatctaccggcattggcgcagaaaaaaatgcctgatgcgacgctgcgcgtcttatactcccacatatgccagattcagcaacggatacggcttccccaacttgcccacttccatacgtgtcctccttaccagaaatttatccttaaggtcgtcagctatcctgcaggcgatctctcgatttcgatcaagacattcctttaatggtcttttctggacaccactaggggtcagaagtagttcatcaaactttcttccctccctaatctcattggttaccttgggctatcgaaacttaattaaccagtcaagtcagctacttggcgagatcgacttgtctgggtttcgactacgctcagaattgcgtcagtcaagttcgatctggtccttgctattgcacccgttctccgattacgagtttcatttaaatcatgtgagcaaaaggccagcaaaaggccaggaaccgtaaaaaggccgcgttgctggcgtt

SEQ ID NO: 8138 - DNA, 5599 bp, unidentified
  source 1..5599: mol_type = unassigned DNA
tttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcatttaaatttccgaactctccaaggccctcgtcggaaaatcttcaaacctttcgtccgatccatcttgcaggctacctctcgaacgaactatcgcaagtctcttggccggccttgcgccttggctattgcttggcagcgcctatcgccaggtattactccaatcccgaatatccgagatcgggatcacccgagagaagttcaacctacatcctcaatcccgatctatccgagatccgaggaatatcgaaatcggggcgcgcctggtgtaccgagaacgatcctctcagtgcgagtctcgacgatccatatcgttgcttggcagtcagccagtcggaatccagcttgggacccaggaagtccaatcgtcagatattgtactcaagcctggtcacggcagcgtaccgatctgtttaaacctagatattgatagtctgatcggtcaacgtataatcgagtcctagcttttgcaaacatctatcaagagacaggatcagcaggaggctttcgcatgagtattcaacatttccgtgtcgcccttattcccttttttgcggcattttgccttcctgtttttgctcacccagaaacgctggtgaaagtaaaagatgctgaagatcagttgggtgcgcgagtgggttacatcgaactggatctcaacagcggtaagatccttgagagttttcgccccgaagaacgctttccaatgatgagcacttttaaagttctgctatgtggcgcggtattatcccgtattgacgccgggcaagagcaactcggtcgccgcatacactattctcagaatgacttggttgagtattcaccagtcacagaaaagcatcttacggatggcatgacagtaagagaattatgcagtgctgccataaccatgagtgataacactgcggccaacttacttctgacaacgattggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaaccttgcgtaaactattaactggcgaactacttactctagcttcccggcaacagttgatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaaccgattctaggtgcattggcgcagaaaaaaatgcctgatgcgacgctgcgcgtcttatactcccacatatgccagattcagcaacggatacggcttccccaacttgcccacttccatacgtgtcctccttaccagaaatttatccttaagatcccgaatcgtttaaactcgactctggctctatcgaatctccgtcgtttcgagcttacgcgaacagccgtggcgctcatttgctcgtcgggcatcgaatctcgtcagctatcgtcagcttacctttttggcagcgatcgcggctcccgacatcttggaccattagctccacaggtatcttcttccctctagtggtcataacagcagcttcagctacctctcaattcaaaaaacccctcaagacccgtttagaggccccaaggggttatgctatcaatcgttgcgttacacacacaaaaaaccaacacacatccatcttcgatggatagcgattttattatctaactgctgatcgagtgtagccagatctagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatgctgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctggtttagtgaaccgtcagatcgcctggagacgccatccacgctgttttgacctccatagaagacaccgggaccgatccagcctcccctcgaagcttacatgtggtaccgagctcggatcctgagaacttcagggtgagtctatgggacccttgatgttttctttccccttcttttctatggttaagttcatgtcataggaaggggagaagtaacagggtacacatattgaccaaatcagggtaattttgcatttgtaattttaaaaaatgctttcttcttttaatatacttttttgtttatcttatttctaatactttccctaatctctttctttcagggcaataatgatacaatgtatcatgcctctttgcaccattctaaagaataacagtgataatttctgggttaaggcaatagcaatatttctgcatataaatatttctgcatataaattgtaactgatgtaagaggtttcatattgctaatagcagctacaatccagctaccattctgcttttattttatggttgggataaggctggattattctgagtccaagctaggcccttttgctaatcatgttcatacctcttatcttcctcccacagctcctgggcaacgtgctggtctgtgtgctggcccatcactttggcaaaggcggccgcgccgccaccatgggtcacactagaaggcagggcacatctcctagcaaatgcccatatctcaatttcttccagctgctggtgctggcaggactaagtcatttttgcagcggagtcatccatgtaacgaaagaggtcaaagaagtggccacgttatcctgcgggcataatgtgagcgtcgaagagttggcccagacccgaatatattggcagaaggaaaaaaagatggtgctcacaatgatgtccggggatatgaatatttggcccgagtataagaaccggaccatttttgatataactaacaacctatccattgtaatccttgcattgagaccatcggacgaggggacctacgagtgcgtcgtgctgaagtacgaaaaggacgccttcaagcgtgagcacctcgctgaggttacactctccgtgaaggctgattttcccactccgtctattagcgactttgaaatccctaccagtaatatcaggcgcatcatttgttccacttctggcggattccccgagccccacctttcatggctggagaatggtgaagaactcaatgccataaacacaaccgttagtcaggacccagaaacagagttgtacgcggtttcatcaaaactggatttcaacatgaccacgaaccattctttcatgtgtctgatcaaatatggccacctgcgcgtgaatcaaactttcaactggaacactacaaagcaagagcacttcccagacaaccttctgccttcatgggcaattaccttaattagcgtcaatggcatctttgtgatctgttgcctgacctactgttttgctcctcggtgagctagcttgactgactgagatacagcgtaccttcagctcacagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtattggcccatctctatcggtatcgtagcataaccccttggggcctctaaacgggtcttgaggggttttttgtgcccctcgggccggattgctatctaccggcattggcgcagaaaaaaatgcctgatgcgacgctgcgcgtcttatactcccacatatgccagattcagcaacggatacggcttccccaacttgcccacttccatacgtgtcctccttaccagaaatttatccttaaggtcgtcagctatcctgcaggcgatctctcgatttcgatcaagacattcctttaatggtcttttctggacaccactaggggtcagaagtagttcatcaaactttcttccctccctaatctcattggttaccttgggctatcgaaacttaattaaccagtcaagtcagctacttggcgagatcgacttgtctgggtttcgactacgctcagaattgcgtcagtcaagttcgatctggtccttgctattgcacccgttctccgattacgagtttcatttaaatcatgtgagcaaaaggccagcaaaaggccaggaaccgtaaaaaggccgcgttgctggcgtt

SEQ ID NO: 8139 - DNA, 6433 bp, unidentified
  source 1..6433: mol_type = unassigned DNA
agtccaatcgtcagatattgtactcaagcctggtcacggcagcgtaccgatctgtttaaacctagatattgatagtctgatcggtcaacgtataatcgagtcctagcttttgcaaacatctatcaagagacaggatcagcaggaggctttcgcatgattgaacaagatggattgcacgcaggttctccggcggcttgggtggagaggctattcggctatgactgggcacaacagacaatcggctgctctgatgccgccgtgttccggctgtcagcgcaggggcgtccggttctttttgtcaagaccgacctgtccggtgccctgaatgaactgcaagacgaggcagcgcggctatcgtggctggcgacgacgggcgttccttgcgcggctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgtctatgcccgacggcgaggatctcgtcgtgacccacggcgatgcctgcttgccgaatatcatggtggaaaatggccgcttttctggattcatcgactgtggccgtctgggtgtggcggaccgctatcaggacatagcgttggctacccgtgatattgctgaagagcttggcggcgaatgggctgaccgcttccttgtgctttacggtatcgccgcgcccgattcgcagcgcatcgccttctatcgccttcttgacgagttcttctgaccgattctaggtgcattggcgcagaaaaaaatgcctgatgcgacgctgcgcgtcttatactcccacatatgccagattcagcaacggatacggcttccccaacttgcccacttccatacgtgtcctccttaccagaaatttatccttaaggtcgtttaaactcgactctggctctatcgaatctccgtcgtttcgagcttacgcgaacagccgtggcgctcatttgctcgtcgggcatcgaatctcgtcagctatcgtcagcttacctttttggcagcgatcgcggctcccgacatcttggaccattagctccacaggtatcttcttccctctagtggtcataacagcagcttcagctacctctcaattcaaaaaacccctcaagacccgtttagaggccccaaggggttatgctatcaatcgttgcgttacacacacaaaaaaccaacacacatccatcttcgatggatagcgattttattatctaactgctgatcgagtgtagccagatctagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatgctgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctggtttagtgaaccgtcagatcagatctttgtcgatcctaccatccactcgacacacccgccagcggccgctgccaagcttccgagctctcgaattcaaaggaggtacccaccatggagtttgggctgagctgggttttcctggttgctctttttagaggagtgcagtgtgaagttcagctggtcgaaagtggtggaggattagttcagcctggaggatctctgagactgtcttgtgctgcttctggcttcacctttagcgactcctggattcattgggtgagacaagctcctggaaaaggactggaatgggtggcttggatttccccttatggcggatctacctactacgctgatagcgtgaaaggcagattcaccatctctgccgatacctccaagaacaccgcttacctgcagatgaacagcctgagagctgaggatacagctgtgtactactgtgccagaagacattggcctggcggctttgattattggggacagggaacactggtgacagtgtcttctgcttccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacgccagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtgctggcggtggcgggagtggtggaggtgggtctggaggtggtggtagtggtggtggagggtctggacatgtacaacttcagcagtccggcccagaactcgttcgtcccggtgcttcagtcaaacttagctgcaaggcatctggctacatttttattacttactggatgaattgggttaagcaacgcccaggtcaaggactggagtggatagggcagatctttcccgctagtgggagtactaattacaacgaaatgtttgaaggcaaggccaccctgactgtagatacctctagtagcacagcatatatgcaactttcctctctgacctcagaagactcagctgtctactactgcgctcggggggatggcaattatgctttggacgcaatggattattggggccagggtactagcgtaactgtcagttcaggcggcggtggttcagggggtggcggatctggtggtggaggatctggaggaggaggaaatatcgtcctcactcaatctcccgcttctctcgctgtgtcactcggacagagggctactatctcctgtagggcctcagaaagtgtggattcctatggcaactcatttatgcactggtaccaacaaaagagtggtcaacctccaaaacttttgatataccttgcttctaacctggagtctggcgtcccagcccgtttcagcggttctgggtccagaaccgacttcaccctgaccattgaccctgtagaagccgatgacgctgccacttactactgccaacagaacaacgaggacccactcacatttggggccgggacaaaactggaactcaagcgttgaaagttgtctggtcctgcactgactgactgatacaatcgatttctggatccgcaggcctctgctagcttgactgactgagatacagcgtaccttcagctcacagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtattggcccatctctatcggtatcgtagcataaccccttggggcctctaaacgggtcttgaggggttttttgtgcccctcgggccggattgctatctaccggcattggcgcagaaaaaaatgcctgatgcgacgctgcgcgtcttatactcccacatatgccagattcagcaacggatacggcttccccaacttgcccacttccatacgtgtcctccttaccagaaatttatccttaaggtcgtcagctatcctgcaggcgatctctcgatttcgatcaagacattcctttaatggtcttttctggacaccactaggggtcagaagtagttcatcaaactttcttccctccctaatctcattggttaccttgggctatcgaaacttaattaaccagtcaagtcagctacttggcgagatcgacttgtctgggtttcgactacgctcagaattgcgtcagtcaagttcgatctggtccttgctattgcacccgttctccgattacgagtttcatttaaatcatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcatttaaatttccgaactctccaaggccctcgtcggaaaatcttcaaacctttcgtccgatccatcttgcaggctacctctcgaacgaactatcgcaagtctcttggccggccttgcgccttggctattgcttggcagcgcctatcgccaggtattactccaatcccgaatatccgagatcgggatcacccgagagaagttcaacctacatcctcaatcccgatctatccgagatccgaggaatatcgaaatcggggcgcgcctggtgtaccgagaacgatcctctcagtgcgagtctcgacgatccatatcgttgcttggcagtcagccagtcggaatccagcttgggacccagga

SEQ ID NO: 8140 - DNA, 10077 bp, unidentified
  source 1..10077: mol_type = unassigned DNA
gtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtcgacggatcgggagatcaacttgtttattgcagcttataatggttacaaataaagcaatagcatcacaaatttcacaaataaagcatttttttcactgcattctagttgtggtttgtccaaactcatcaatgtatcttatcatgtctggatcaactggataactcaagctaaccaaaatcatcccaaacttcccaccccataccctattaccactgccaattaccctgtggcgcaattaaccctcactaaagggaacaaaagctggagctgcaagcttaatgtagtcttatgcaatactcttgtagtcttgcaacatggtaacgatgagttagcaacatgccttacaaggagagaaaaagcaccgtgcatgccgattggtggaagtaaggtggtacgatcgtgccttattaggaaggcaacagacgggtctgacatggattggacgaaccactgaattgccgcattgcagagatattgtatttaagtgcctagctcgatacataaacgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccggccgctgatcttcagacctggaggaggagatatgagggacaattaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcgcctttaaaagaaaaggggggattggggggtacagtgcaggggaaagaatagtagacataatagcaacagacatacaaactaaagaattacaaaaacaaattacaaaaattcaaaattttcgggtttattacagggacagcagagatccagtttatctaatacgactcactatagggagagagagagaattaccctcactaaagggaggagaagcatgaattcttgggggagtaattcatacaaaaggactcgcccctgccttggggaatcccagggaccgtcgttaaactcccactaacgtagaacccagagatcgctgcgttcccgccccctcacccgcccgctctcgtcatcactgaggtggagaagagcatgcgtgaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacgcccctggctgcagtacgtgattcttgatcccgagcttcgggttggaagtgggtgggagagttcgaggccttgcgcttaaggagccccttcgcctcgtgcttgagttgaggcctggcttgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgaactagaagctttattgcggtagtttatcacagttaaattgctaacgcagtcagtgcttctgacacaacagtctcggccgccaccatggagacccttcttggattgcttatactctggctccagttgcaatgggtatcctccggagaggatgtggagcagagtcttttcctgagtgtccgagagggagacagctccgttataaactgcacttacacagacagctcctccacctacttatactggtataagcaagaacctggagcaggtctccagttgctgacgtatattttttcaaatatggacatgaaacaagaccaaagactcactgttctattgaataaaaaggataaacatctgtctctgcgcattgcagacacccagactggggactcagctatctacttctgtgcagagatcgcgaacagagatgacaagatcatctttggaaaagggacacgacttcatattctccccaatatccagaaccctgaccctgccgtgtaccagctgagagactctaaatccagtgacaagtctgtctgcctattcaccgattttgattctcaaacaaatgtgtcacaaagtaaggattctgatgtgtatatcacagacaaaactgtgctagacatgaggtctatggacttcaagagcaacagtgctgtggcctggagcaacaaatctgactttgcatgtgcaaacgccttcaacaacagcattattccagaagacaccttcttccccagcccagaaagttcctgtgatgtcaagctggtcgagaaaagctttgaaacagatacgaacctaaactttcaaaacctgtcagtgattgggttccgaatcctcctcctgaaagtggccgggtttaatctgctcatgacgctgcggctgtggtccagcggcagcggcgcgaccaactttagcctgctgaaacaggcgggcgatgtggaagaaaacccaggaccgatgagtattggcctcctgtgctgtgcggctcttagcttgctttgggctgggccagtcgacactgaagttacccagacaccaaaacacctggtcatgggaatgacaaataagaagtctttgaaatgtgaacaacatatggggcacagggctatgtattggtacaagcagaaagctaagaagccaccggagctcatgtttgtctacagctatgagaaactctctataaatgaaagtgtgccaagtcgcttctcacctgaatgccccaacagctctctcttaaaccttcacctacacgccctgcagccagaagactcagccctgtatctctgcgccagcagccaagcggtgaacaccggggagctgttttttggagaaggctctaggctgaccgtactggaggacctgaaaaacgtgttcccacccgaggtcgctgtgtttgagccatcagaagcagagatctcccacacccaaaaggccacactggtatgcctggccacaggcttctaccccgaccacgtggagctgagctggtgggtgaatgggaaggaggtgcacagtggggtcagcacagacccgcagcccctcaaggagcagcccgccctcaatgactccagatactgcctgagcagccgcctgagggtctcggccaccttctggcagaacccccgcaaccacttccgctgtcaagtccagttctacgggctctcggagaatgacgagtggacccaggatagggccaaacccgtcacccagatcgtcagcgccgaggcctggggtagagcagactgtggcttcacctccgagtcttaccagcaaggggtcctgtctgccaccatcctctatgagatcttgctagggaaggccaccttgtatgccgtgctggtcagtgccctcgtgctgatggccatggtcaagagaaaggattccagaggctaggcggccgcgatcccgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtgcacatgctttacatgtgtttagtcgaggttaaaaaaacgtctaggccccccgaaccacggggacgtggttttcctttgaaaaacacgatgataagcttgccacaacccacaaggagacgaccttccatgaccgagtacaagcccacggtgcgcctcgccacccgcgacgacgtcccccgggccgtacgcaccctcgccgccgcgttcgccgactaccccgccacgcgccacaccgtcgacccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctagacgcgtctggaacaatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaagctgacgtcctttccatggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcctggaattaattctgcagtcgagacctagaaaaacatggagcaatcacaagtagcaatacagcagctaccaatgctgattgtgcctggctagaagcacaagaggaggaggaggtgggtttccagtcacacctcaggacctttaagaccaatgacttacaaggcagctgtagatcttagccactttttaaaagaaaagaggggactggaagggctaattcactcccaacgaagacaagatctgctttttgcctgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtagtagttcatgtcatcttattattcagtatttataacttgcaaagaaatgaatatcagagagtgagaggctaacgttttaccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtg

SEQ ID NO: 8141-8149 - skipped (9 entries)

SEQ ID NO: 8150 - DNA, 9416 bp, unidentified
  source 1..9416: mol_type = unassigned DNA
ccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagctgcggtaaagctcatcagcgtggtcgtgaagcgattcacagatgtctgcctgttcatccgcgtccagctcgttgagtttctccagaagcgttaatgtctggcttctgataaagcgggccatgttaagggcggttttttcctgtttggtcactgatgcctccgtgtaagggggatttctgttcatgggggtaatgataccgatgaaacgagagaggatgctcacgatacgggttactgatgatgaacatgcccggttactggaacgttgtgagggtaaacaactggcggtatggatgcggcgggaccagagaaaaatcactcagggtcaatgccagcgcttcgttaatacagatgtaggtgttccacagggtagccagcagcatcctgcgatgcagatccggaacataatggtgcagggcgctgacttccgcgtttccagactttacgaaacacggaaaccgaagaccattcatgttgttgctcaggtcgcagacgttttgcagcagcagtcgcttcacgttcgctcgcgtatcggtgattcattctgctaaccagtaaggcaaccccgccagcctagccgggtcctcaacgacaggagcacgatcatgcgcacccgtggggccgccatgccggcgataatggcctgcttctcgccgaaacgtttggtggcgggaccagtgacgaaggcttgagcgagggcgtgcaagattccgaataccgcaagcgacaggccgatcatcgtcgcgctccagcgaaagcggtcctcgccgaaaatgacccagagcgctgccggcacctgtcctacgagttgcatgataaagaagacagtcataagtgcggcgacgatagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatatccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcacattcaccaccctgaattgactctcttccgggcgctatcatgccataccgcgaaaggttttgcgccattcgatggtgtccgggatctcgacgctctcccttatgcgactcctgcattaggaagcagcccagtagtaggttgaggccgttgagcaccgccgccgcaaggaatggtgcatgcaaggagatggcgcccaacagtcccccggccacggggcctgccaccatacccacgccgaaacaagcgctcatgagcccgaagtggcgagcccgatcttccccatcggtgatgtcggcgatataggcgccagcaaccgcacctgtggcgccggtgatgccggccacgatgcgtccggcgtagaggatcgagatctcgatcccgcgaaattaatacgactcactataggggaattgtgagcggataacaattcccctctagaaataattttgtttaactttaagaaggagatatacatatgaactttcagccgtttttccagaaatttgttcatctgtatccgattagcaaaaccctgcgttttgaactgattccgcagggtgcaacccagaaatttattagcgaaaaacaggttctgctgcaggatgaaattcgtgcacgtaaatatccggaaatgaaacaggcaattgatggttatcataaagattttattcagcgtgcactgagcaatattgatagccaggtttttgaacaggcactgaatacctttgaagatctgtttctgcgtagccaggcagaacgtgcaaccgatgcatataagaaagatttcgaaaccgcacagaccaaactgcgtgaactgattgttcatagctttgaaaaaggtgaatttaagcaggaatataagagcctgtttgataaaaatctgattaccaatctgctgaaaccgtgggttgaacagcagaatcagattggtgatagcaactatacctatcatgaagattttaacaaatttaccacctattttctgggttttcatgaaaatcgcaagaatatttatagcaaagatccgcataaaaccgcactggcatatcgtctgattcatgaaaatttaccgaagttcctggaaaataacaagattctgctgaaaattcaaaatgatcatccgagcctgtgggaacagctgcagaccctgaatcagaccatgccgcagctgtttgatggttgggattttagccagctgatgcaggttagcttttttagcaataccctgacccagaccggtattgatcagtataataccattattggtggtattagcgaaggtgaaaatcgtcagaaaattcagggtattaatgagctgattaacctgtataatcagaaacaggataaaaaaaatcgtgttgcaaaactgaagcagctgtataaacagattctgagcgatcgtagcaccctgagctttctgccggaaaaatttgttgatgataccgaactgtatcatgcaattaatatgttttacctggaacatctgcatcatcagagcatgattaatggtcatagctataccctgctggaacgtgttcagctgctgattaatgaactggcaaattatgatctgagcaaagtttatctggcaccgaatcagctgagcaccgttagccatcagatgtttggtgattttggttatatcggtcgtgccctgaattattattatatgcaggttattcagccggattatgaacagctgctggcaagcgcaaaaaccaccaaaaaaattgaagcaaccgaaaagctgaaaacaattttcctggataccccgcagagcctggttgttattcaggcagcaattgatgaatatattcagctgcagccgagcaccaaaccgcatacccagctgaccgattttattattagcctgctgaaacagtatgaaaccgttgcagatgatcagagcattaaagttattaatgtttttagcgatattgagggtaagtatagctgtatcaaaggtctggttaataccaaaagcgaaagcaaacgtgaagttttacaggatgaaaaactggcaaccgatattaaggccttcatggatgcagtgaataatgttattaaactgctgaagccgtttagcctgaatgaaaagctggttgcaagcgttgaaaaagatgcacgtttttatagcgattttgaagaaatttatcagtctctgctgatttttgttccgctgtataataaagttcgtaattatattacccagaaaccgtatagcaccgaaaaatttaaactgaatttcaataagccgaccctgctgagcggttgggatgcaaataaagaagcagataatctgagcattctgctgcgtaaaaatggtaattattacctggcaattatggataccgcaaaaggtgcaaacaaagcatttgaaccgaagaccttaaatcagctgaaagttgatgatacaaccgattgttatgaaaagatggtttataaactgctgtcaggtccgagcaaaatgtttccgaaagcatttaaagcaaaaaataacgagggtaattattatccgaccccggaactgctgaccagctataataataacgaacacctgaaaaatgataaaaactttaccctggcaagcctgcatgcatatattgattggtgtaaagagtatattaatcgtaacccgagctggcatcagtttaattttaaatttagcccgacccagagctttcaggatattagccagttttatagcgaagttagcagccagagctataaagttcattttcagaccattccgagcgattatattgatcagctggttgcagaaggtaaactgtatctgtttcagatttataataaagatttcagcccgaatgcaaaaggtaaggaaaatctgcataccctgtattttaaagcactgtttagcgatgaaaatttaaaacagccggtttttaaactgagcggtgaagcagaaatgttttatcgtccggcaagcttacagctggcaaataccaccattcataaagcaggtgaaccgatggcagcaaaaaatccgctgaccccgaatgcaacccgtaccctggcatatgatattattaaagatcgtcgttttaccaccgataaatatctgctgcatgttccgattagcctgaattttcatgcacaggaaagcatgagcattaagaaacataatgatctggttcgtcagatgattaaacataatcatcaggatctgcatgttattggtattgatcgtggtgaaaaacatctgctgtatgttagcgttattgatctgaaaggtaatattgtttaccaggaaagcctgaatagcattaagagcgaagcacagaattttgaaaccccgtatcatcagctgctgcagcatcgtgaagaaggtcgtgcacaggcacgtaccgcatggggtaaaatcgaaaatattaaagaactgaaagatggttacctgagccaggttgttcatcgtattcagcagctgattctgaaatacaatgcaattgttatgctggaagacctgaattttggttttaaacgtggtcgttttaaaatcgagaaacagatttatcagaaatttgaaaaggccctgattcataaactgaattatgttgttgataaaagcacccaggcagatgaactgggtggtgttcgtaaagcatatcagctgaccgcaccgtttgaaagctttgaaaagctgggtaaacagagcggtgttctgttttatgttccggcatggaataccagcaaaattgatccggttaccggttttgttgatctgttaaaaccgaaatatgaaaatctggataaagcacaggcattttttaatgcatttgacagcattcattacaatgcacagaaaaactactttgagttcaaagtgaatctgaaacaatttgcaggtctgaaagcacaggccgcacaggcagaatggaccatttgtagctatggtgatgaacgtcatgtttatcagaaaaaaaatgcacagcagggtgaaaccgttattgttaacgtgaccgaagaattaaaagttctgtttgcaaaaaataatattgaagttgcccagagcgttgaactgaaagaaaccatttgtacccagacccaggttgatttttttaaacgtctgatgtggctgctgcaggttctgttagcactgcgttatagcagcagcaaagataaactggattatattctgagcccggttgcaaatgcacagggtgaattttttgatagccgtcatgcaagcgttcagctgccgcaggatagcgatgcaaatggtgcatatcatattgcactgaaaggtctgtgggttattgaacagctgaaagcagcagataatttagataaggttaaactggcaattagcaatgatgattggctgcattttgcacagcagaaaccttatctggcaaaacgtccggcagcgactaagaaggcggggcaagctaagaagaaaaaggggtcgggtcctgctgccaagagggtcaagttggacggcagtggtcatcaccatcatcatcattaacgaattcgagctccgtcgacaagcttgcggccgcactcgagcaccaccaccaccaccactgagatccggctgctaacaaagcccgaaaggaagctgagttggctgctgccaccgctgagcaataactagcataaccccttggggcctctaaacgggtcttgaggggttttttgctgaaaggaggaactatatccggattggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgtttacaatttcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgcagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctgg

SEQ ID NO: 8151 - DNA, 9355 bp, unidentified
  source 1..9355: mol_type = unassigned DNA
tggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcgcctttaaaagaaaaggggggattggggggtacagtgcaggggaaagaatagtagacataatagcaacagacatacaaactaaagaattacaaaaacaaattacaaaaattcaaaattttcgggtttattacagggacagcagagatccagtttatctaatacgactcactatagggagagagagagaattaccctcactaaagggaggagaagcatgaattcttgggggagtaattcatacaaaaggactcgcccctgccttggggaatcccagggaccgtcgttaaactcccactaacgtagaacccagagatcgctgcgttcccgccccctcacccgcccgctctcgtcatcactgaggtggagaagagcatgcgtgaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacgcccctggctgcagtacgtgattcttgatcccgagcttcgggttggaagtgggtgggagagttcgaggccttgcgcttaaggagccccttcgcctcgtgcttgagttgaggcctggcttgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgaactagaagctttattgcggtagtttatcacagttaaattgctaacgcagtcagtgcttctgacacaacagtctcggccgccaccatggagacagacacactcctgctatgggtactgctgctctgggttccaggttccactggtgacgacatccagatgacccaaacaaccagctcactctcggcatcgttaggcgaccgtgtaactatcagctgtagggccagtcaggacattagcaaatatctgaattggtaccaacaaaagcccgacgggaccgttaaacttctcatatatcacacttctcgactgcacagcggggtaccatccagattttctggctcaggctcagggacagattacagcctcacaatcagcaatctggagcaggaggatattgccacatacttctgtcagcagggtaataccttgccttacacctttggtggcggaacgaaactagaaataaagggaggaggtggcagtggaggaggagggtctggtgggggagggagtggtggaggaggatcaggaggaggatcagaggtcaaattgcaggaatctggtcccgggctcgtggcaccatcccagtcccttagtgtcacctgcacggtgagtggggtgtccctgcccgactacggagtgtcctggattcggcagcctccgaggaagggactggaatggctgggtgtcatctggggctctgagaccacttactataacagtgctctgaagagccgcttgaccatcattaaggataactccaagtctcaagtgttcttaaagatgaactctctgcagactgatgacactgcgatctattattgcgctaaacattattactacggcggatcctatgccatggattactgggggcagggaacatcagttacagtgagctcatcctctgaacagaaacttatctctgaggaggatctcattgagttcatgtatccaccgccatacctggataatgaaaggagcaacggaactataattcacatcaaggagaagcacctgtgccatactcagtcgagccctaagctgttttgggcattggtggtggttgccggcgtgctgttctgttacgggttactagtcactgtagccctttgtgtgatatggacaaacagtagaagaaacagggggggacagagcgactacatgaacatgaccccacggagaccaggcctcacacgcaaaccctaccaaccttatgcacccgcgcgggatttcgccgcctacaggccacgcgccaaatttagccgctctgcggagacagccgctaacttacaggatcctaaccagctctataacgagctcaatctgggccgacgagaagagtatgacgtgctggaaaagaagcgggctagagaccccgagatgggcggcaaacaacagcgcagaagaaatccccaggagggcgtgtataatgcgcttcaaaaggataagatggcagaggcttactccgaaatcggtacaaagggtgaacggcgtagggggaaagggcacgacggactgtatcagggtctgagcactgctaccaaagatacgtacgacgccttacatatgcaaacacttgcccctcgtggcagcggcgcgaccaactttagcctgctgaaacaggcgggcgatgtggaagaaaacccaggaccgatgactgccctgaccgaaggtgctaagctgtttgagaaggagattccgtacatcaccgagctggaaggggacgtcgaaggaatgaagttcatcatcaagggagaaggaaccggggacgctacgactggaaccattaaggccaagtatatctgtaccactggagatctgccagtgccttgggccacccttgtgtcaaccctctcgtatggagtgcagtgttttgctaagtaccctagccacattaaggacttcttcaaatccgccatgccggaaggttatacccaagagcgcaccatttcttttgagggagatggagtgtacaagacccgcgcgatggtcacctatgagaggggatctatctacaaccgggtgactctgactggagaaaactttaagaaggacgggcatattcttcggaagaatgtcgccttccagtgccctcccagcatcctttacattctccccgacactgtgaacaacggaatccgcgtggagttcaatcaagcctacgacatcgagggggtgacggagaagctggtgaccaagtgtagccagatgaatcggccactggccggttcagcggctgtccacattccgcgctaccatcatatcacttatcacactaagctctccaaagaccgcgatgagaggagagatcacatgtgcctggtggaagtggtcaaggccgtcgatctcgatacctatcagtaaacgcgtctggaacaatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaagctgacgtcctttccatggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcctggaattaattctgcagtcgagacctagaaaaacatggagcaatcacaagtagcaatacagcagctaccaatgctgattgtgcctggctagaagcacaagaggaggaggaggtgggttttccagtcacacctcaggacctttaagaccaatgacttacaaggcagctgtagatcttagccactttttaaaagaaaagaggggactggaagggctaattcactcccaacgaagacaagatctgctttttgcctgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtagtagttcatgtcatcttattattcagtatttataacttgcaaagaaatgaatatcagagagtgagaggctaacgttttaccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggaagaaatgaatatcagagagtgagaggctaacgggttccgcgcacatttccccgaaaagtgccacctgacgtcgacggatcgggagatcaacttgtttattgcagcttataatggttacaaataaagcaatagcatcacaaatttcacaaataaagcatttttttcactgcattctagttgtggtttgtccaaactcatcaatgtatcttatcatgtctggatcaactggataactcaagctaaccaaaatcatcccaaacttcccaccccataccctattaccactgccaattaccctgtggcgcaattaaccctcactaaagggaacaaaagctggagctgcaagcttaatgtagtcttatgcaatactcttgtagtcttgcaacatggtaacgatgagttagcaacatgccttacaaggagagaaaaagcaccgtgcatgccgattggtggaagtaaggtggtacgatcgtgccttattaggaaggcaacagacgggtctgacatggattggacgaaccactgaattgccgcattgcagagatattgtatttaagtgcctagctcgatacataaacgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccggccgctgatcttcagacctggaggaggagatatgagggacaattaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagt

SEQ ID NO: 8152 - DNA, 9307 bp, unidentified
  source 1..9307: mol_type = unassigned DNA
tggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcgcctttaaaagaaaaggggggattggggggtacagtgcaggggaaagaatagtagacataatagcaacagacatacaaactaaagaattacaaaaacaaattacaaaaattcaaaattttcgggtttattacagggacagcagagatccagtttatctaatacgactcactatagggagagagagagaattaccctcactaaagggaggagaagcatgaattcttgggggagtaattcatacaaaaggactcgcccctgccttggggaatcccagggaccgtcgttaaactcccactaacgtagaacccagagatcgctgcgttcccgccccctcacccgcccgctctcgtcatcactgaggtggagaagagcatgcgtgaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacgcccctggctgcagtacgtgattcttgatcccgagcttcgggttggaagtgggtgggagagttcgaggccttgcgcttaaggagccccttcgcctcgtgcttgagttgaggcctggcttgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgaactagaagctttattgcggtagtttatcacagttaaattgctaacgcagtcagtgcttctgacacaacagtctcggccgccaccatgggggtgcctacccaactactgggcctcttgctgctctggatcaccgacgctatatgcgacattcaaatgacgcagtcccccgccagtctgagtacaagcctgggcgaaaccgtgaccatccagtgtcaggcttcagaggacatttactcaggactggcatggtaccagcagaaacccgggaaatccccgcagttgctgatctatggcgcatccgatctccaggatggagtcccatccaggttcagcgggtccggatcaggaacccagtactccctaaagatcacaagcatgcagacagaggacgagggagtgtatttttgccagcagggcttgacttatccccggacattcgggggtggcactaagctggagctgaagggcggcggtggtagtggaggaggggggtccggtggaggaggaagtgaggtacagcttcaacagtctggggccgagttggtaaggcctggtacctctgtcaaactaagttgtaaggtttcaggtgataccattaccttctattacatgcacttcgtgaagcagcgcccaggccaaggcctcgaatggatcggccgaattgaccctgaagatgaatcgaccaagtactccgaaaagtttaagaataaagctactctcacagcagacacttcaagcaacaccgcttacctgaaactgtcttcattgacctctgaggacacggccacgtatttctgcatctacggcgggtattactttgactactggggccagggagtcatggtcactgtttctagcgaacagaaacttatctctgaggaggatctcattgagttcatgtatccaccgccatacctggataatgaaaggagcaacggaactataattcacatcaaggagaagcacctgtgccatactcagtcgagccctaagctgttttgggcattggtggtggttgccggcgtgctgttctgttacgggttactagtcactgtagccctttgtgtgatatggacaaacagtagaagaaacagggggggacagagcgactacatgaacatgaccccacggagaccaggcctcacacgcaaaccctaccaaccttatgcacccgcgcgggatttcgccgcctacaggccacgcgccaaatttagccgctctgcggagacagccgctaacttacaggatcctaaccagctctataacgagctcaatctgggccgacgagaagagtatgacgtgctggaaaagaagcgggctagagaccccgagatgggcggcaaacaacagcgcagaagaaatccccaggagggcgtgtataatgcgcttcaaaaggataagatggcagaggcttactccgaaatcggtacaaagggtgaacggcgtagggggaaagggcacgacggactgtatcagggtctgagcactgctaccaaagatacgtacgacgccttacatatgcaaacacttgcccctcgtggcagcggcgcgaccaactttagcctgctgaaacaggcgggcgatgtggaagaaaacccaggaccgatgactgccctgaccgaaggtgctaagctgtttgagaaggagattccgtacatcaccgagctggaaggggacgtcgaaggaatgaagttcatcatcaagggagaaggaaccggggacgctacgactggaaccattaaggccaagtatatctgtaccactggagatctgccagtgccttgggccacccttgtgtcaaccctctcgtatggagtgcagtgttttgctaagtaccctagccacattaaggacttcttcaaatccgccatgccggaaggttatacccaagagcgcaccatttcttttgagggagatggagtgtacaagacccgcgcgatggtcacctatgagaggggatctatctacaaccgggtgactctgactggagaaaactttaagaaggacgggcatattcttcggaagaatgtcgccttccagtgccctcccagcatcctttacattctccccgacactgtgaacaacggaatccgcgtggagttcaatcaagcctacgacatcgagggggtgacggagaagctggtgaccaagtgtagccagatgaatcggccactggccggttcagcggctgtccacattccgcgctaccatcatatcacttatcacactaagctctccaaagaccgcgatgagaggagagatcacatgtgcctggtggaagtggtcaaggccgtcgatctcgatacctatcagtaaacgcgtctggaacaatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaagctgacgtcctttccatggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcctggaattaattctgcagtcgagacctagaaaaacatggagcaatcacaagtagcaatacagcagctaccaatgctgattgtgcctggctagaagcacaagaggaggaggaggtgggttttccagtcacacctcaggacctttaagaccaatgacttacaaggcagctgtagatcttagccactttttaaaagaaaagaggggactggaagggctaattcactcccaacgaagacaagatctgctttttgcctgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtagtagttcatgtcatcttattattcagtatttataacttgcaaagaaatgaatatcagagagtgagaggctaacgttttaccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggaagaaatgaatatcagagagtgagaggctaacgggttccgcgcacatttccccgaaaagtgccacctgacgtcgacggatcgggagatcaacttgtttattgcagcttataatggttacaaataaagcaatagcatcacaaatttcacaaataaagcatttttttcactgcattctagttgtggtttgtccaaactcatcaatgtatcttatcatgtctggatcaactggataactcaagctaaccaaaatcatcccaaacttcccaccccataccctattaccactgccaattaccctgtggcgcaattaaccctcactaaagggaacaaaagctggagctgcaagcttaatgtagtcttatgcaatactcttgtagtcttgcaacatggtaacgatgagttagcaacatgccttacaaggagagaaaaagcaccgtgcatgccgattggtggaagtaaggtggtacgatcgtgccttattaggaaggcaacagacgggtctgacatggattggacgaaccactgaattgccgcattgcagagatattgtatttaagtgcctagctcgatacataaacgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccggccgctgatcttcagacctggaggaggagatatgagggacaattaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagt

SEQ ID NO: 8153 - DNA, 9886 bp, unidentified
  source 1..9886: mol_type = unassigned DNA
tggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcgcctttaaaagaaaaggggggattggggggtacagtgcaggggaaagaatagtagacataatagcaacagacatacaaactaaagaattacaaaaacaaattacaaaaattcaaaattttcgggtttattacagggacagcagagatccagtttatctaatacgactcactatagggagagagagagaattaccctcactaaagggaggagaagcatgaattcttgggggagtaattcatacaaaaggactcgcccctgccttggggaatcccagggaccgtcgttaaactcccactaacgtagaacccagagatcgctgcgttcccgccccctcacccgcccgctctcgtcatcactgaggtggagaagagcatgcgtgaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacgcccctggctgcagtacgtgattcttgatcccgagcttcgggttggaagtgggtgggagagttcgaggccttgcgcttaaggagccccttcgcctcgtgcttgagttgaggcctggcttgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgaactagaagctttattgcggtagtttatcacagttaaattgctaacgcagtcagtgcttctgacacaacagtctcggccgccaccatgggggtgcctacccaactactgggcctcttgctgctctggatcaccgacgctatatgcgacattcaaatgacgcagtcccccgccagtctgagtacaagcctgggcgaaaccgtgaccatccagtgtcaggcttcagaggacatttactcaggactggcatggtaccagcagaaacccgggaaatccccgcagttgctgatctatggcgcatccgatctccaggatggagtcccatccaggttcagcgggtccggatcaggaacccagtactccctaaagatcacaagcatgcagacagaggacgagggagtgtatttttgccagcagggcttgacttatccccggacattcgggggtggcactaagctggagctgaagggcggcggtggtagtggaggaggggggtccggtggaggaggaagtgaggtacagcttcaacagtctggggccgagttggtaaggcctggtacctctgtcaaactaagttgtaaggtttcaggtgataccattaccttctattacatgcacttcgtgaagcagcgcccaggccaaggcctcgaatggatcggccgaattgaccctgaagatgaatcgaccaagtactccgaaaagtttaagaataaagctactctcacagcagacacttcaagcaacaccgcttacctgaaactgtcttcattgacctctgaggacacggccacgtatttctgcatctacggcgggtattactttgactactggggccagggagtcatggtcactgtttctagcgaacagaaacttatctctgaggaggatctcattgagttcatgtatccaccgccatacctggataatgaaaggagcaacggaactataattcacatcaaggagaagcacctgtgccatactcagtcgagccctaagctgttttgggcattggtggtggttgccggcgtgctgttctgttacgggttactagtcactgtagccctttgtgtgatatggacaaacagtagaagaaacagggggggacagagcgactacatgaacatgaccccacggagaccaggcctcacacgcaaaccctaccaaccttatgcacccgcgcgggatttcgccgcctacaggccacgcgccaaatttagccgctctgcggagacagccgctaacttacaggatcctaaccagctctataacgagctcaatctgggccgacgagaagagtatgacgtgctggaaaagaagcgggctagagaccccgagatgggcggcaaacaacagcgcagaagaaatccccaggagggcgtgtataatgcgcttcaaaaggataagatggcagaggcttactccgaaatcggtacaaagggtgaacggcgtagggggaaagggcacgacggactgtatcagggtctgagcactgctaccaaagatacgtacgacgccttacatatgcaaacacttgcccctcgtggcagcggcgcgaccaactttagcctgctgaaacaggcgggcgatgtggaagaaaacccaggaccgatgcccaaccctaggccagccaagcctatggctccttccttggcccttggcccatccccaggagtcttgccaagctggaagactgcacccaagggctcagaacttctagggaccaggggctctgggggacccttccaaggtcgggacctgcgaagtggggcccacacctcttcttccttgaaccccctgccaccatcccagctgcagctgcctacagtgcccctagtcatggtggcaccgtctggggcccgactaggtccctcaccccacctacaggcccttctccaggacagaccacacttcatgcatcagctctccactgtggatgcccatgcccagacccctgtgctccaagtgcgtccactggacaacccagccatgatcagcctcccaccaccttctgctgccactggggtcttctccctcaaggcccggcctggcctgccacctgggatcaatgtggccagtctggaatgggtgtccagggagccagctctactctgcaccttcccacgctcgggtacacccaggaaagacagcaaccttttggctgcaccccaaggatcctacccactgctggcaaatggagtctgcaagtggcctggttgtgagaaggtcttcgaggagccagaagagtttctcaagcactgccaagcagatcatctcctggatgagaaaggcaaggcccagtgcctcctccagagagaagtggtgcagtctctggagcagcagctggagctggaaaaggagaagctgggagctatgcaggcccacctggctgggaagatggcgctggccaaggctccatctgtggcctcaatggacaagagctcttgctgcatcgtagccaccagtactcagggcagtgtgctcccggcctggtctgctcctcgggaggctccagacggcggcctgtttgcagtgcggaggcacctctggggaagccatggcaatagttccttcccagagttcttccacaacatggactacttcaagtaccacaatatgcgaccccctttcacctatgccacccttatccgatgggccatcctggaagccccggagaggcagaggacactcaatgaaatctaccattggtttactcgcatgttcgcctacttcagaaaccaccccgccacctggaagaatgccatccgccacaacctgagcctgcacaagtgctttgtgcgagtggagagcgagaagggagcagtgtggaccgtagatgaatttgagtttcgcaagaagaggagccaacgccccaacaagtgctccaatccctgcccttaaacgcgtctggaacaatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaagctgacgtcctttccatggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcctggaattaattctgcagtcgagacctagaaaaacatggagcaatcacaagtagcaatacagcagctaccaatgctgattgtgcctggctagaagcacaagaggaggaggaggtgggttttccagtcacacctcaggacctttaagaccaatgacttacaaggcagctgtagatcttagccactttttaaaagaaaagaggggactggaagggctaattcactcccaacgaagacaagatctgctttttgcctgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtagtagttcatgtcatcttattattcagtatttataacttgcaaagaaatgaatatcagagagtgagaggctaacgttttaccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggaagaaatgaatatcagagagtgagaggctaacgggttccgcgcacatttccccgaaaagtgccacctgacgtcgacggatcgggagatcaacttgtttattgcagcttataatggttacaaataaagcaatagcatcacaaatttcacaaataaagcatttttttcactgcattctagttgtggtttgtccaaactcatcaatgtatcttatcatgtctggatcaactggataactcaagctaaccaaaatcatcccaaacttcccaccccataccctattaccactgccaattaccctgtggcgcaattaaccctcactaaagggaacaaaagctggagctgcaagcttaatgtagtcttatgcaatactcttgtagtcttgcaacatggtaacgatgagttagcaacatgccttacaaggagagaaaaagcaccgtgcatgccgattggtggaagtaaggtggtacgatcgtgccttattaggaaggcaacagacgggtctgacatggattggacgaaccactgaattgccgcattgcagagatattgtatttaagtgcctagctcgatacataaacgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccggccgctgatcttcagacctggaggaggagatatgagggacaattaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagt

SEQ ID NO: 8154 - protein, 564 aa, unidentified
VLCVLVAIGGQTWGLVGYDCTSSVANITTISLFSVLPCELDQKPQSEYLSVIQVVQQRSVSRVHTFSCLVIRSSVIHHCGMHHHTSVGPMSIGEIMHTSNTQCADLHHFGKLAVGSGTLLTGFKVNETVQISITEHGYSDSEFKCRGTSFSHNGIAYHDAVMKSSYTVTLREEWASLDLDTGDLKMSTGYMHPFKTGQSFDASAGDVFWSTQDNQDCTPTSYLVLHEGAGIIYQGHRDTKTLVVNSSTHAMAVGILGPTLVCHQPALRTEHPKIFIVMKHPGSPSFFFKKSIVDPANVDMFLYINSKLVYLERHMGYQMSLVYEHFHKRTCNIKHQLLRHLIAIAVMNPEEFAWLYSKRPGVTAILRGELIYLMECQAVPVTIRKPSGRCYNELPVTFNNTPMFIKPRSRILVHYGSEIDCSPIVPAGFMIEGRWWALRPDSTQLPAPTTLSAEPEEGKWSYTSPHDLFKSGIYTLEELLAFQKRLLFSFEKPAISHTLSSAAARQPADLSGIDGAGLFHPGQLEEIQKNFMSKIWGWYWNVSVVLGGLVGIYMVFQLIKSVIN

SEQ ID NO: 8155 - protein, 586 aa, unidentified
FRLLVIFTCLLNVEALVAYDCSHGNTGIKDISLVDVKTCVPKLRNVTKVDAYIQLIQPKYFETTPYFQCLVEVTHLIFRCGKTIDTHHQGGLYSEVLSLSRDECNTLITRGEFKYQGFLVIIDITKNVNRISMETYGTINSGSCTPGSYDYALVINGVQYDRAVRTSNFIITTKRSIATVDIETRKIILDDGIKCDYNPLSCFSSDNGFVFWESMFENPSCNSEDEYYPIFEGHATKYIEYVGNQATTSVIIHYSNYDFQIALLGKTKRICGQISYLTEHPKLAIVFSTKTEGFNLKINSASMSKNVNLMAYVNSKIVYVLRHVKEQVDSLYDRVSHDRCIAETKIIHNMLALAVISPQEFAYEYFNAPGHTAVVLGETIYVSKCVPVSVNFTKVANKCYKELPVTVNGETMFMLPRSRILSGIGTEVDCSGLLTVKYKLTHEWYTVGSNLIVTSAPERLDFSNKDDWTFRTIDDLIETGIYTLEDLEAVQKIIMTPIQKNALTERISRTIQGESELPTGSNVIHLFTEEDLKTLAKDSVRSVLGSIADGIHYLGDICSFIVGSFIILRFIKFILNFIINGVLIFK

SEQ ID NO: 8156 - protein, 285 aa, unidentified
KIVSRAGGALVANILRTRANTALGFYESCAEWKIFYEGVVFSPYMRQACTGTNGEWSRMKEQFYTKFYEMATRFQCFKFVRVPYIRPAESTQEVAPGCGAGGTINGVEYITDPRNGTIITSVVTDLKITGEYLMPFCYFVYRSRDIWLAENRGYDSDPFLKVYNEQGETLFDWNQLTDGYGEPKAEKMIKCSFIIVEKTSKITIQSWSASQFITRAAYYFNETIPRRPIQVIESKWAQSRMSDPITQESACRRLGDYCIYFRIGTYLGIFDDELGDLQVRDILSG

SEQ ID NO: 8157 - protein, 285 aa, unidentified; identical to SEQ ID NO: 8156

SEQ ID NO: 8158 - protein, 293 aa, unidentified
KIVSRAGGALVANILRTRANTALGFYESCAEWKIFYEGVVFSPYMRQACTGTNGEWSRMKEQFYTKFYEMATRFQCFKFVRVPYIRPAESTQEVAPGCGAGGTINGVEYITDPRNGTIITSVVTDLKITGEYLMPFCYFVYRSRDIWLAENRGYDSDPFLKVYNEQGETLFDWNQLTDGYGEPKAEKMIKCSFIIVEKTSKITIQSWSASQFITRAAYYFNETIPRRPIQVIESKWAQSRMSDPITQESACRRLGDYCIYFRIGTYLGIFDDELGDLQVRDILSGQKGGGPNF

SEQ ID NO: 8159 - protein, 64 aa, unidentified
TPINFDQLECHVSIQDSTKVWSEKISAYFFTADRLDPSEKTLLCTGWEYVTRCYEYWYGGVDVT

SEQ ID NO: 8160 - protein, 285 aa, unidentified; identical to SEQ ID NO: 8156

SEQ ID NO: 8161 - protein, 64 aa, unidentified; identical to SEQ ID NO: 8159

SEQ ID NO: 8162 - protein, 65 aa, unidentified
WTCKKVSCDLQNLSTNSLYFPVSCNKHNFSLNPWTSVLYSDGPNVGPGRYLALKLSNGSHVIGVT

SEQ ID NO: 8163 - protein, 126 aa, unidentified
YYESPLLNSGWLTIPPKDGTISGLINKAGRGDQFTVLPHVLTFAPRESSGNCYLPIQTSQIRDRDVLIESNIVVLPTQSIRYVIATYDISRSDHAIVYYVYDPIRTISYTHPFRLTTKGRPDFLRI

SEQ ID NO: 8164 - protein, 528 aa, unidentified
MALSAKIIALSWLAAICTLVENGIGSPLQTQSVFLKEPGILIEPKSLVLHHDSVVHTTVMIRLDSVLPESRAELFSNCKQHITREELKKDFKERTAKILQMLPSMSYNQEDSICSLPGTDCVESVNSSDRKLRRPKRFVNIPVAATIFGVVSLGMGLYTYLSQKSIREHVENVEAHISNDEKVIISNSEYSSISSSMFAKNYARSKIFETSLQNTLCSVEKGHTEDYLNLAITEYVDFLTYNVQQAVNGHVTDFLVTRDLINGTLLNRTEFADSVYKSDIGLFYSASTSFLTHVNRKTKALYFLIVTPKSYTKDLTTIYSVSNFGWREDEYHVKYEIPTSFYQVTWENSTYSVETQKEDCLSRSGLLICHSRASTSSPKSKCLHQLLNKSSPVDCRIQREYAPHESCSVKYTLSGLFARNCNSITLVKEVRGILMEEHIPKAGIKSRFFPYTSFETAVIDERSYSSRDTIYQTEIRKVTPTSEVIIPELPSLYSQSELSDLMAFVQKKKKEESERMIHEKVSHMLVSH

SEQ ID NO: 8165 - protein, 64 aa, unidentified; identical to SEQ ID NO: 8159

SEQ ID NO: 8166 - protein, 293 aa, unidentified; identical to SEQ ID NO: 8158

SEQ ID NO: 8167 - protein, 64 aa, unidentified; identical to SEQ ID NO: 8159

SEQ ID NO: 8168 - protein, 285 aa, unidentified; identical to SEQ ID NO: 8156

SEQ ID NO: 8169 - protein, 126 aa, unidentified; identical to SEQ ID NO: 8163

SEQ ID NO: 8170 - protein, 617 aa, unidentified
MSPQRDRINAFYKDNPHPKGSRIVINREHLMIDRPYVLLAVLFVMFLSLIGLLAIAGIRLHRAAIYTAEIHKSLSTNLDVTNSIEHQVKDVLTPLFKIIGDEVGLRTPQRFTDLVKFISDKIKFLNPDREYDFRDLTWCINPPERIKLDYDQYCADVAAEELMNALVNSTLLEARATNQFLAVSKGNCSGPTTIRGQFSNMSLSLLDLYLSRGYNVSSIVTMTSQGMYGGTYLVGKPNLSSKGSELSQLSMHRVFEVGVIRNPGLGAPVFHMTNYFEQPVSNDFSNCMVALGELKFAALCHREDSITIPYQGSGKGVSFQLVKLGVWKSPTDMRSWVPLSTDDPVIDRLYLSSHRGVIADNQAKWAVPTTRTDDKLRMETCFQQACKGKNQALCENPEWAPLKDNRIPSYGVLSVNLSLTVELKIKIASGFGPLITHGSGMDLYKTNHNNVYWLTIPPMKNLALGVINTLEWIPRFKVSPNLFTVPIKEAGEDCHAPTYLPAEVDGDVKLSSNLVILPGQDLQYVLATYDTSRVEHAVVYYVYSPSRSFSYFYPFRLPIKGVPIELQVECFTWDKKLWCRHFCVLADSESGGHITHSGMVGMGVSCTVTREDGTNRR

SEQ ID NO: 8171 - protein, 229 aa, unidentified
DTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCSHHFHELFLRDGRKLIVPCRDQHELVGRSMVSQGGSSGVAGTACLAKAYAQMWLMSY

SEQ ID NO: 8172 - protein, 62 aa, unidentified
IKILLIIVILKSLHAHIEFVPHDLSKWRDISIEHLDCPIYGDLSNQATETTPVKYSSVQWGL

SEQ ID NO: 8173 - protein, 73 aa, unidentified
SVPYKVKFIPVGRELYTHPPEHGTDHPCRVYAHDAQKRGAYVEMHLPGSEVDSTLLSMSGGAVQVNPPAGTNV

SEQ ID NO: 8174 - protein, 84 aa, unidentified
EAIKRLKIEANKSINLITSAVNSLINDQLIIKNHLRDLMGIPYCNYSKFWFLNHTMSNRTSLPRCWLISNGSYLNETEFSSDIE

SEQ ID NO: 8175 - protein, 617 aa, unidentified; identical to SEQ ID NO: 8170

SEQ ID NO: 8176 - protein, 96 aa, unidentified
DTAGWDTRVTQADLEDERELLHFMEGEHKRLAEAIFKLTYENKVALCPRPGSKGGTVMDVISRKDQRGSGQVVTYALNTLTNIKVQLVRMAESEGI

SEQ ID NO: 8177 - protein, 84 aa, unidentified; identical to SEQ ID NO: 8174

SEQ ID NO: 8178 - protein, 152 aa, unidentified
IRIQTSSQYGLDPSGGVKSRTMRYNLQGNIEEIPLHEVSLHTSRPCHIIDGHGYFLLARCPEGDSLTMEFKKDTVTHSCSVPYKVKFIPVGRELYTHPPEHGTDHPCRVYAHDAQKRGAYVEMHLPGSEVDSTLLSMSGGAVQVNPPAGTNV

SEQ ID NO: 8179 - protein, 57 aa, unidentified
LSSNQMILSDQVTIDQSTIENILSDLTEHGLRLNEAEKSFNNSHLCIVRNETHDVNH

SEQ ID NO: 8180 - protein, 57 aa, unidentified; identical to SEQ ID NO: 8179

SEQ ID NO: 8181 - protein, 42 aa, unidentified
RCIRPPMIITQVKGYPLTIINRNLCTELSVDNLILNIETNHN

SEQ ID NO: 8182 - protein, 86 aa, unidentified
RCIRPPMIITQVKGYPLTIINRNLCTELSVDNLILNIETNHNFSLNPTIIDSQSRLIATSPLEIDALIQDAQHHAAAALLKVEESN

SEQ ID NO: 8183 - protein, 59 aa, unidentified
ANLSSNQMILSDQVTIDQSTIENILSDLTEHGLRLNEAEKSFNNSHLCIVRNETHDVNH

SEQ ID NO: 8184 - protein, 57 aa, unidentified; identical to SEQ ID NO: 8179

SEQ ID NO: 8185 - protein, 57 aa, unidentified; identical to SEQ ID NO: 8179

SEQ ID NO: 8186 - protein, 76 aa, unidentified
KNLIRTQESLNILEKIVANLSSNQMILSDQVTIDQSTIENILSDLTEHGLRLNEAEKSFNNSHLCIVRNETHDVNH

SEQ ID NO: 8187 - protein, 57 aa, unidentified; identical to SEQ ID NO: 8179

SEQ ID NO: 8188 - protein, 213 aa, unidentified
DTAGWDTRITEADLDDECILCDYMEDEHKQLALSLFELCYKNKVALCPRPGRHGGTVMDVIFRRDQRGSGQVVTYALNTLTNIKVQLIRLAESEGVLDEDFNDHGIETWLNHYGEERLSRLLISGDDCLVNAFDERFGKALTWLNTMEKIRKDIDLCAPSNGYENFEKVEFCSNHFHELMLKDGRQLVVPCRSQNELVGRASVNQGGSATVAG

SEQ ID NO: 8189 - protein, 57 aa, unidentified; identical to SEQ ID NO: 8179

SEQ ID NO: 8190 - protein, 59 aa, unidentified; identical to SEQ ID NO: 8183

SEQ ID NO: 8191 - protein, 57 aa, unidentified; identical to SEQ ID NO: 8179

SEQ ID NO: 8192 - protein, 57 aa, unidentified; identical to SEQ ID NO: 8179

SEQ ID NO: 8193 - protein, 96 aa, unidentified; identical to SEQ ID NO: 8176

SEQ ID NO: 8194 - protein, 57 aa, unidentified; identical to SEQ ID NO: 8179

SEQ ID NO: 8195 - protein, 174 aa, unidentified
DTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCSH

SEQ ID NO: 8196 - protein, 229 aa, unidentified; identical to SEQ ID NO: 8171

SEQ ID NO: 8197 - protein, 528 aa, unidentified; identical to SEQ ID NO: 8164

SEQ ID NO: 8198 - protein, 506 aa, unidentified
IERYHPIFFEKYGVLIEPNGVVTSYDKVKYVTLIYHFPGLQKAVTPSHCNRNASEQLYRNTLKHQIKIMYDLIPSSTHTIMSNYCSKHHALCLDLEKKDRPKRQIIAAIAALSGIAGLAISAYDWISSSELKNHLDKVSEHITKIDNKLIIQENLDYKLTKLSNDIIKKTSMSFENYHKFVKEYVCQSSQFNNFLSHHVATTHLEMELQALQRLINGEPDSYIINAETLESILSSDTEVERSIYSSDPSLFYQVVRSNLIHSDIEKSLFAFILEVPIIQETMISPLYKVYNGGWESKGILHKIDLPDSFYLYSSLDDVDYHAISLGKSNCWKRNEVVVCDNSKHMMTEDMICLNSILKREYYDSCDIKFSKFTRRKFVVKALSGVLVCGDLEVKIITSAGSQFHYIKNNKQENNYTKYYSYNEFKQIIVGNTIVSTNINKMPIVRRNDTISVNFDYDLKWADKILHERPWTSLKEINLLKDSGFEQYHGTISHNLNQWSVFLWVTI

SEQ ID NO: 8199 - protein, 96 aa, unidentified; identical to SEQ ID NO: 8176

SEQ ID NO: 8200 - protein, 240 aa, unidentified
KGSRTIWYMWLGSRFLEFEALGFLNEERWASRDISGGGVEGIGINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCSHHF

SEQ ID NO: 8201 - protein, 506 aa, unidentified; identical to SEQ ID NO: 8198

SEQ ID NO: 8202 - protein, 170 aa, unidentified
CHSPIAIEEVRSDGHDGYIRIQTSSQYGLDPSGGVKSRTMRYNLQGNIEEIPLHEVSLHTSRPCHIIDGHGYFLLARCPEGDSLTMEFKKDTVTHSCSVPYKVKFIPVGRELYTHPPEHGTDHPCRVYAHDAQKRGAYVEMHLPGSEVDSTLLSMSGGAVQVNPPAGTNV

SEQ ID NO: 8203 - protein, 88 aa, unidentified
NTHPPVHVSDGGGPQDKVREIIVEKKLEEIQKSLFPELSYHPLALPETRGKEMIDPQTFEILTTVHSLLNATKPDLAQDCWLCLRSGT

SEQ ID NO: 8204 - protein, 104 aa, unidentified
IDRWLQEHGEDRVERMLVSGDDCVVNAIDERFGSSLNWLNAMEKVRKDIDLWKPSPSFRNWERVEFCSNHFHEMTMKDGRVIVAPCRGQTELIARGTVNQGGCV

SEQ ID NO: 8205 - protein, 131 aa, unidentified
RGDNLYVNNFMIDQHHRVYKFEGACRMRFCGKDGIKFLRGDWIEKQGEIVKLYENIPNCADGTLVSGHRPGVDLIDTVFNLENILEFTLCEGTKGKINRQETLTSVDLSYLAPRIGGFGSIFRVRNGTLEK

SEQ ID NO: 8206 - protein, 104 aa, unidentified; identical to SEQ ID NO: 8204

SEQ ID NO: 8207 - protein, 285 aa, unidentified; identical to SEQ ID NO: 8156

SEQ ID NO: 8208 - protein, 572 aa, unidentified
MEYWKHTNHGKDAGNELETSTTTHGNKLTNKITYILWTITLVLLSIVFIIVLTNSIKSEKARESLLQDINNELMEVTEKIQVASDNTNDLIQSGVNTRLLTIQSHVQNYIPISLTQQISDLRKFISEITIRNDNQEVPPQRITHDVGIKPLNPDDFWRCTSGLPSLMKTPKIRLMPGPGLLAMPTTVDGCVRTPSLVINDLIYAYTSNLITRGCQDIGKSYQVLQIGIITVNSDLVPDLNPRISHTFNINDNRKSCSLALLNTDVYQLCSTPKVDERSDYASSGIEDIVLDIVNYDGSISTTRFKNNNISFDQPYAALYPSVGPGIYYKGKIIFLGYGGLEHPINENAICNTTGCPGKTQRDCNQASHSPWFSDRRMVNSIIVVDKGLNSVPKLKVWTISMRQNYWGSEGRLLLLGNKIYIYTRSTSWHSKLQLGIIDITDYSDIRIKWTWHNVLSRPGNNECPWGHSCPDGCITGVYTDAYPLNPTGSIVSSVILDSQKSRVNPVITYSTATERVNELAIRNKTLSAGYTTTSCITHYNKGYCFHIVEINHKSLNTFQPMLFKTEIPKSCS

SEQ ID NO: 8209 - protein, 285 aa, unidentified; identical to SEQ ID NO: 8156

SEQ ID NO: 8210 - protein, 572 aa, unidentified; identical to SEQ ID NO: 8208

SEQ ID NO: 8211 - protein, 285 aa, unidentified; identical to SEQ ID NO: 8156

SEQ ID NO: 8212 - protein, 337 aa, unidentified
KPGDFGVAKGSRTIWYMWLGSRFLEFESFGFLNEEHWASRELCGGGVEGIPLFYLGYHLEKMAEKAGILYADDTAGWDTRITMADLEDEYTLTELMEGEHKKLAETLFNFAYKNKVALCPRPGKNGGTVLDVISRTDQRGSGQVVTYALNTLTNIKVQLIRMAESEGVLDEEFHDNGMLKWLEKHGRDRLQRLMVSGDDCVVNAIDERFGKSLVWLNEMQKIRKDIDLWKPSAGHCNWEEVEFCSNHFHKLVMRDGRTLVVPCRHEVELVGRASVNQGGSTGISGTACLAKAYAQMWLLLYFHRRDLRILGMAICSAVPANWVPTGRTTWSLHATKD

SEQ ID NO: 8213 - protein, 319 aa, unidentified
KGSRTIWYMWLGSRFLEFESFGFLNEEHWASRELSGGGVESIPLFYLGYHLREMAKKPGKLYADDTAGWDTRITEADLDDECILCDYMEDEHKQLALSLFELCYKNKVALCPRPGRHGGTVMDVIFRRDQRGSGQVVTYALNTLTNIKVQLIRLAESEGVLDEDFNDHGIETWLNHYGEERLSRLLISGDDCLVNAFDERFGKALTWLNTMEKIRKDIDLCAPSNGYENFEKVEFCSNHFHELMLKDGRQLVVPCRSQNELVGRASVNQGGSATVAGTACLAKAYAQMWNLLYFHRRDLRLLGFAIMSATPSNWIPTGR

SEQ ID NO: 8214 - protein, 55 aa, unidentified
CGNLNRGLVFIGGYYYYRGDQRCKLVNGCTINKYTFSCNDGRYLWTRCYSESAWI

SEQ ID NO: 8215 - protein, 156 aa, unidentified
RTQHPNVFVIERGNYDFNIKYNPSSLSPRSINLDTHLGMKLSYLQYDTGSQIDQLYLLLKGEICEINAKTVRNSLSLAKLDPKDFGYLYYGKPGFLGLVRGEVIYLKECVPQIVNIRLSENCYQDLPILYNNESYFLTPRSKLIVKEGHEIECSNL

SEQ ID NO: 8216 - protein, 285 aa, unidentified; identical to SEQ ID NO: 8156

SEQ ID NO: 8217 - protein, 285 aa, unidentified; identical to SEQ ID NO: 8156

SEQ ID NO: 8218 - protein, 617 aa, unidentified; identical to SEQ ID NO: 8170

SEQ ID NO: 8219 - protein, 617 aa, unidentified; identical to SEQ ID NO: 8170

SEQ ID NO: 8220 - protein, 27 aa, unidentified
LPSWKDLSTNSTMIPWLSWDGSTPWWL

SEQ ID NO: 8221 - protein, 152 aa, unidentified
DSSISQITSSSSVDYQFPQSGISRARQTPFPLLKDGIIYTADSERLYGLNPNAPAITVAMSSSHTSFSLVSETVCPKYVSHSISGCYNCPQGFTITFNAFSACRPGSVSVVVEGNFLCTTSFVTLNTTSLPSILYCISQQKQIEGTIKLLGD

SEQ ID NO: 8222 - protein, 501 aa, unidentified
FNCLGMGNRDFVEGVSGATWIDVVLEGDSCVTIMSKEKPTLDVRMMKMEASNMAIVREYCYEASVSDISTESRCPTMGEAHNQKRGSDKYVCKSGVVDRGWGNGCGLFGKGSYDTCAKFECKKKAQGRLLQQENIKFEVGIFVHGPTNVENHGNYFAHVASGTASRYTVSPQAPSFTAKMGEYGEVTVDCEPRSGVDLASYYVMSVGNKHWLVHREWFNDLSLPWTGASANTWRNSELLVEFEEAHATKQSVTVLGSQEGSLHQALAGAIPVDVSSETVTLTSGYLKCRLKMEKLALKGTTYGMCAQSFSFAKNPVDTGHGTVVLELTYSGSDGPCKIPITMVTSLNDLEPVGRIVTANPYVAGSTSNTKVLIELEPPFGDSYIVVGRGNKQINYHWHKDGSSLGKAFTTTLKGAQRLAALGDTAWDFGSVGGVFSSVGKAIHQVFGGAFRTLFGGMSWITQGLIGALLLWLGVNTRDRSIALTFLAVGGVLLFLAVNVHA

SEQ ID NO: 8223 - protein, 501 aa, unidentified; identical to SEQ ID NO: 8222

SEQ ID NO: 8224 - protein, 501 aa, unidentified; identical to SEQ ID NO: 8222

SEQ ID NO: 8225 - protein, 501 aa, unidentified; identical to SEQ ID NO: 8222

SEQ ID NO: 8226 - protein, 501 aa, unidentified; identical to SEQ ID NO: 8222

SEQ ID NO: 8227 - protein, 501 aa, unidentified; identical to SEQ ID NO: 8222

SEQ ID NO: 8228 - protein, 293 aa, unidentified; identical to SEQ ID NO: 8158

SEQ ID NO: 8229 - protein, 488 aa, unidentified
ISMLSPGLFIERYHPIFFEKYGVLIEPNGVVTSYDKVKYVTLIYHFPGLQKAVTPSHCNRNASEQLYRNTLKHQIKIMYDLIPSSTHTIMSNYCSKHHALCLDLEKKDRPKRQIIAAIAALSGIAGLAISAYDWISSSELKNHLDKVSEHITKIDNKLIIQENLDYKLTKLSNDIIKKTSMSFENYHKFVKEYVCQSSQFNNFLSHHVATTHLEMELQALQRLINGEPDSYIINAETLESILSSDTEVERSIYSSDPSLFYQVVRSNLIHSDIEKSLFAFILEVPIIQETMISPLYKVYNGGWESKGILHKIDLPDSFYLYSSLDDVDYHAISLGKSNCWKRNEVVVCDNSKHMMTEDMICLNSILKREYYDSCDIKFSKFTRRKFVVKALSGVLVCGDLEVKIITSAGSQFHYIKNNKQENNYTKYYSYNEFKQIIVGNTIVSTNINKMPIVRRNDTISVNFDYDLKWADKILHERPWTSLKEINLL

SEQ ID NO: 8230 - protein, 293 aa, unidentified; identical to SEQ ID NO: 8158

SEQ ID NO: 8231 - protein, 488 aa, unidentified; identical to SEQ ID NO: 8229

SEQ ID NO: 8232 - protein, 293 aa, unidentified; identical to SEQ ID NO: 8158

SEQ ID NO: 8233 - protein, 488 aa, unidentified; identical to SEQ ID NO: 8229

SEQ ID NO: 8234 - protein, 537 aa, unidentified
ILIIFISMLSPGLFIERYHPIFFEKYGVLIEPNGVVTSYDKVKYVTLIYHFPGLQKAVTPSHCNRNASEQLYRNTLKHQIKIMYDLIPSSTHTIMSNYCSKHHALCLDLEKKDRPKRQIIAAIAALSGIAGLAISAYDWISSSELKNHLDKVSEHITKIDNKLIIQENLDYKLTKLSNDIIKKTSMSFENYHKFVKEYVCQSSQFNNFLSHHVATTHLEMELQALQRLINGEPDSYIINAETLESILSSDTEVERSIYSSDPSLFYQVVRSNLIHSDIEKSLFAFILEVPIIQETMISPLYKVYNGGWESKGILHKIDLPDSFYLYSSLDDVDYHAISLGKSNCWKRNEVVVCDNSKHMMTEDMICLNSILKREYYDSCDIKFSKFTRRKFVVKALSGVLVCGDLEVKIITSAGSQFHYIKNNKQENNYTKYYSYNEFKQIIVGNTIVSTNINKMPIVRRNDTISVNFDYDLKWADKILHERPWTSLKEINLLKDSGFEQYHGTISHNLNQWSVFLWVTIILCLIILIYLLIASRRK

SEQ ID NO: 8235 - protein, 488 aa, unidentified; identical to SEQ ID NO: 8229

SEQ ID NO: 8236 - protein, 488 aa, unidentified; identical to SEQ ID NO: 8229

SEQ ID NO: 8237 - protein, 546 aa, unidentified
IERYHPIFFEKYGVLIEPNGVVTSYDKVKYVTLIYHFPGLQKAVTPSHCNRNASEQLYRNTLKHQIKIMYDLIPSSTHTIMSNYCSKHHALCLDLEKKDRPKRQIIAAIAALSGIAGLAISAYDWISSSELKNHLDKVSEHITKIDNKLIIQENLDYKLTKLSNDIIKKTSMSFENYHKFVKEYVCQSSQFNNFLSHHVATTHLEMELQALQRLINGEPDSYIINAETLESILSSDTEVERSIYSSDPSLFYQVVRSNLIHSDIEKSLFAFILEVPIIQETMISPLYKVYNGGWESKGILHKIDLPDSFYLYSSLDDVDYHAISLGKSNCWKRNEVVVCDNSKHMMTEDMICLNSILKREYYDSCDIKFSKFTRRKFVVKALSGVLVCGDLEVKIITSAGSQFHYIKNNKQENNYTKYYSYNEFKQIIVGNTIVSTNINKMPIVRRNDTISVNFDYDLKWADKILHERPWTSLKEINLLKDSGFEQYHGTISHNLNQWSVFLWVTIILCLIILIYLLIASRRKITSLEDRLKLTNGIIKLSNKRSI

SEQ ID NO: 8238 - protein, 546 aa, unidentified; identical to SEQ ID NO: 8237

SEQ ID NO: 8239 - protein, 546 aa, unidentified; identical to SEQ ID NO: 8237

SEQ ID NO: 8240 - protein, 506 aa, unidentified; identical to SEQ ID NO: 8198

SEQ ID NO: 8241 - protein, 546 aa, unidentified; identical to SEQ ID NO: 8237

SEQ ID NO: 8242 - protein, 293 aa, unidentified; identical to SEQ ID NO: 8158

SEQ ID NO: 8243 - protein, 285 aa, unidentified; identical to SEQ ID NO: 8156

SEQ ID NO: 8244 - protein, 293 aa, unidentified; identical to SEQ ID NO: 8158

SEQ ID NO: 8245 - protein, 285 aa, unidentified; identical to SEQ ID NO: 8156

SEQ ID NO: 8246 - protein, 293 aa, unidentified; identical to SEQ ID NO: 8158

SEQ ID NO: 8247 - protein, 488 aa, unidentified; identical to SEQ ID NO: 8229

SEQ ID NO: 8248 - protein, 488 aa, unidentified; identical to SEQ ID NO: 8229

SEQ ID NO: 8249 - protein, 546 aa, unidentified; identical to SEQ ID NO: 8237

SEQ ID NO: 8250 - protein, 546 aa, unidentified; identical to SEQ ID NO: 8237

SEQ ID NO: 8251 - protein, 488 aa, unidentified; identical to SEQ ID NO: 8229

SEQ ID NO: 8252 - protein, 528 aa, unidentified; identical to SEQ ID NO: 8164

SEQ ID NO: 8253 - protein, 488 aa, unidentified; identical to SEQ ID NO: 8229

SEQ ID NO: 8254 - protein, 260 aa, unidentified
YESCAEWKIFYEGVVFSPYMRQACTGTNGEWSRMKEQFYTKFYEMATRFQCFKFVRVPYIRPAESTQEVAPGCGAGGTINGVEYITDPRNGTIITSVVTDLKITGEYLMPFCYFVYRSRDIWLAENRGYDSDPFLKVYNEQGETLFDWNQLTDGYGEPKAEKMIKCSFIIVEKTSKITIQSWSASQFITRAAYYFNETIPRRPIQVIESKWAQSRMSDPITQESACRRLGDYCIYFRIGTYLGIFDDELGDLQVRDILSG

SEQ ID NO: 8255 - protein, 260 aa, unidentified; identical to SEQ ID NO: 8254

SEQ ID NO: 8256 - protein, 260 aa, unidentified; identical to SEQ ID NO: 8254

SEQ ID NO: 8257 - protein, 89 aa, unidentified
HHKIPIRTVFTEAEIIYGLNQLSDLTEKAIQQVYLEVCKLTRTIWQLAVQTWKTNPTFVAQLISKSNNVIGENRNGTLLIHHSVPAGPL

SEQ ID NO: 8258 - protein, 89 aa, unidentified; identical to SEQ ID NO: 8257

SEQ ID NO: 8259 - protein, 89 aa, unidentified; identical to SEQ ID NO: 8257

SEQ ID NO: 8260 - protein, 73 aa, unidentified
LLGEDWYQISSRGLIRHSKPATMQQDDVNYEFSVLSGLGNGGLYNDETIALYQEALVSGITSEIVKTRVADSI

SEQ ID NO: 8261 - protein, 89 aa, unidentified; identical to SEQ ID NO: 8257

SEQ ID NO: 8262 - protein, 293 aa, unidentified; identical to SEQ ID NO: 8158

SEQ ID NO: 8263 - protein, 260 aa, unidentified; identical to SEQ ID NO: 8254

SEQ ID NO: 8264 - protein, 57 aa, unidentified
WNDWIPVKENLKQGFNGIMSDHGRIIYPIRYLLGDEWNPEMHALQYVKFMPHPLLHP

SEQ ID NO: 8265 - protein, 57 aa, unidentified; identical to SEQ ID NO: 8179

SEQ ID NO: 8266 - protein, 54 aa, unidentified
LSSNQMILSDQVTIDQSTIENILSDLTEHGLRLNEAEKSFNNSHLCIVRNETHD

SEQ ID NO: 8267 - protein, 74 aa, unidentified
DTCKEVYVDGIYITLGKKTLPRAMYAEDVALGGPISVDPIDLGNDVSAIQDAINKSKEHLDEANHLLDKVNPNI

SEQ ID NO: 8268 - protein, 606 aa, unidentified
LLLLSLSRLIQVSAIIGFDCTDPSSNVTAVSLTQIGDCVVRNRNVTTTTTNIRVYQSLDFTMTTVYSCLIEMSHIISRCGKSIDQFHSGGFYSEIPSITRATCLDMIDTGKINLHGNSMEGIEVGVPYSVALMTYGTIDQDGSCTTPGDLIVNGRVFTRAIRNTNIKILVTKYQANVDIDQSELKLSTGIVCPFLKRECFSAQTGYNYWNSFLENIVCEGTRPLVQLYEGPATKAIESINSHPIQTYMFKRDKSDFAIGANNPGQFCGYNDIIQTDHPNLYIVEEKNWNLVKLKTRKLMTTDIDITAYMNSKMLYIVNHVTNQVNNLYDAYLKDRCKTEESVLRQTLTLAYMSPNDFAYDFMKGPGYTATVSGEVIYIIKCQAKSVNYRPVSETCYKELPVLIDNKPGFVMPKTHLITMIGTEIPCNPLLPPVFLLGEYWYSPSHQLIRSTPPLVLKPSEPHVWQFEQISNLISSGIYSAEDLHLYRKAFLAPDGEKAFIGTFAKKTIRWNGDDYTGNVVNSFNEHDIDLLNERLGNWFHNMYRKLGNFGSFMVSIFIIGRFLLWIINLFLNCVKLRMEGRPMTDGLFVWWDRMLDFMQVRRMYVQ

SEQ ID NO: 8269 - protein, 70 aa, unidentified
QESLNILEKIVANLSSNQMILSDQVTIDQSTIENILSDLTEHGLRLNEAEKSFNNSHLCIVRNETHDVNH

SEQ ID NO: 8270 - protein, 57 aa, unidentified; identical to SEQ ID NO: 8179

SEQ ID NO: 8271 - protein, 96 aa, unidentified
PPLYLLGEDWYQISSRGLIRHSKPATMQQDDVNYEFSVLSGLGNGGLYNDETIALYQEALVSGITSEIVKTRVADSIGGRSDLPTGYSVIKAMSDG

SEQ ID NO: 8272 - protein, 293 aa, unidentified; identical to SEQ ID NO: 8158

SEQ ID NO: 8273 - protein, 293 aa, unidentified; identical to SEQ ID NO: 8158

SEQ ID NO: 8274 - protein, 488 aa, unidentified; identical to SEQ ID NO: 8229

SEQ ID NO: 8275 - protein, 293 aa, unidentified; identical to SEQ ID NO: 8158

SEQ ID NO: 8276 - protein, 488 aa, unidentified; identical to SEQ ID NO: 8229

SEQ ID NO: 8277 - protein, 546 aa, unidentified; identical to SEQ ID NO: 8237

SEQ ID NO: 8278 - protein, 293 aa, unidentified; identical to SEQ ID NO: 8158

SEQ ID NO: 8279 - protein, 488 aa, unidentified; identical to SEQ ID NO: 8229

SEQ ID NO: 8280 - protein, 528 aa, unidentified; identical to SEQ ID NO: 8164

SEQ ID NO: 8281 - protein, 293 aa, unidentified; identical to SEQ ID NO: 8158

SEQ ID NO: 8282 - protein, 285 aa, unidentified; identical to SEQ ID NO: 8156

SEQ ID NO: 8283 - protein, 488 aa, unidentified; identical to SEQ ID NO: 8229

SEQ ID NO: 8284 - protein, 537 aa, unidentified; identical to SEQ ID NO: 8234

SEQ ID NO: 8285 - protein, 546 aa, unidentified; identical to SEQ ID NO: 8237

SEQ ID NO: 8286 - protein, 488 aa, unidentified; identical to SEQ ID NO: 8229

SEQ ID NO: 8287 - protein, 488 aa, unidentified; identical to SEQ ID NO: 8229

SEQ ID NO: 8288 - protein, 546 aa, unidentified; identical to SEQ ID NO: 8237

SEQ ID NO: 8289 - protein, 546 aa, unidentified; identical to SEQ ID NO: 8237

SEQ ID NO: 8290 - protein, 488 aa, unidentified; identical to SEQ ID NO: 8229

SEQ ID NO: 8291 - protein, 546 aa, unidentified; identical to SEQ ID NO: 8237

SEQ ID NO: 8292 - protein, 506 aa, unidentified; identical to SEQ ID NO: 8198

SEQ ID NO: 8293 - protein, 546 aa, unidentified; identical to SEQ ID NO: 8237

SEQ ID NO: 8294 - protein, 488 aa, unidentified; identical to SEQ ID NO: 8229

SEQ ID NO: 8295 - protein, 488 aa, unidentified; identical to SEQ ID NO: 8229

SEQ ID NO: 8296 - protein, 285 aa, unidentified; identical to SEQ ID NO: 8156

SEQ ID NO: 8297 - protein, 293 aa, unidentified; identical to SEQ ID NO: 8158

SEQ ID NO: 8298 - protein, 572 aa, unidentified; identical to SEQ ID NO: 8208

SEQ ID NO: 8299 - protein, 293 aa, unidentified; identical to SEQ ID NO: 8158

SEQ ID NO: 8300 - protein, 293 aa, unidentified; identical to SEQ ID NO: 8158

SEQ ID NO: 8301 - protein, 575 aa, unidentified
  VARIANT 178: note = Any amino acid
  VARIANT 179: note = Any amino acid
  VARIANT 180: note = Any amino acid
  VARIANT 181: note = Any amino acid
  VARIANT 182: note = Any amino acid
  VARIANT 183: note = Any amino acid
  VARIANT 184: note = Any amino acid
  VARIANT 185: note = Any amino acid
  VARIANT 186: note = Any amino acid
  VARIANT 187: note = Any amino acid
  VARIANT 188: note = Any amino acid
  VARIANT 189: note = Any amino acid
  VARIANT 190: note = Any amino acid
  VARIANT 509: note = Any amino acid
  VARIANT 510: note = Any amino acid
  VARIANT 511: note = Any amino acid
  VARIANT 512: note = Any amino acid
MAEKGKTNSSYWSTTRNDNSTVNTHINTPAGRTHIWLLIATTMHTVLSFIIMILCIDLIIKQDTCMKTNIMTVSSMNESAKIIKETITELIRQEVISRTINIQSSVQSGIPILLNKQSRDLTQLIEKSCNRQELAQICENTIAIHHADGISPLDPHDFWRCPVGEPLLSNNPNISLLXXXXXXXXXXXXXGCVRLPSLSIGDAIYAYSSNLITQGCADIGKSYQVLQLGYISLNSDMYPDLNPVISHTYDINDNRKSCSVIAAGTRGYQLCSLPTVNETTDYSSEGIEDLVFDILDLKGKTKSHRYKNEDITFDHPFSAMYPSVGSGIKIENTLIFLGYGGLTTPLQGDTKCVINRCTNVNQSVCNDALKITWLKKRQVVNVLIRINNYLSDRPKIVVETIPITQNYLGAEGRLLKLGKKIYIYTRSSGWHSNLQIGSLDINNPMTIKWAPHEVLSRPGNQDCNWYNRCPRECISGVYTDAYPLSPDAVNVATTTLYANTSRVNPTIMXXXXSEIINMLRLKNVQLEAAYTTTSCITHFGKGYCFHIVEINQASLNTLQPMLFKTSIPKICKITS

SEQ ID NO: 8302 - protein, 285 aa, unidentified; identical to SEQ ID NO: 8156

SEQ ID NO: 8303 - protein, 293 aa, unidentified; identical to SEQ ID NO: 8158

SEQ ID NO: 8304 - protein, 293 aa, unidentified; identical to SEQ ID NO: 8158

SEQ ID NO: 8305 - protein, 293 aa, unidentified; identical to SEQ ID NO: 8158

SEQ ID NO: 8306 - protein, 575 aa, unidentified; identical to SEQ ID NO: 8301
  VARIANT 178: note = Any amino acid
  VARIANT 179: note = Any amino acid
  VARIANT 180: note = Any amino acid
  VARIANT 181: note = Any amino acid
  VARIANT 182: note = Any amino acid
  VARIANT 183: note = Any amino acid
  VARIANT 184: note = Any amino acid
  VARIANT 185: note = Any amino acid
  VARIANT 186: note = Any amino acid
  VARIANT 187: note = Any amino acid
  VARIANT 188: note = Any amino acid
  VARIANT 189: note = Any amino acid
  VARIANT 190: note = Any amino acid
  VARIANT 509: note = Any amino acid
  VARIANT 510: note = Any amino acid
  VARIANT 511: note = Any amino acid
  VARIANT 512: note = Any amino acid

SEQ ID NO: 8307 - protein, 613 aa, unidentified
MASSSDMRQSQATLYEGDPNSKRTWRTVYRVITILLDITVLCVGIVAVVRMSTITTKDIDNSISSSITSLSADYQPIWSDTHQKVNSIFKEVGITIPVTLDKMQVEMGTAVNIITDAVRQLQGVNGSAGFSITNSPEYSGGIDTLIYPLNSLNGKALAVSDLLEHPSFIPAPTTSHGCTRIPTFHLGYRHWCYSHNTIESGCHDAEESIMYVSMGAVGVGHRGRPVFTTSAATILDDGRNRKSCSIIANPNGCDVLCSLVKQTENEDYADPTPTPMIHGRLHFNGTYTESELNPGLFNNHWVAQYPAVGSGVVSHGKLFFPLYGGISPKSKLFNELKSFAYFTHNAELKCENLTERQKEDLYNAYRPGKIAGSLWAQGVVTCNLTNLADCKVAIANTSTMMMAAEGRLQLVQDRIVFYQRSSSWWPVLIYYDIPISDLISADHLGIVNWTPYPQSKFPRPTWTKGVCEKPAICPAVCVTGVYQDIWVVSIGSQSNETVVVGGYLDAAAARQDPWIAAANQYNWLVRRRLFTSQTEAAYSSTTCFRNTKQDRVFCLTIMEVTDNLLGDWRIAPLLYEVTVADKQQGNRNYAPMRRMGTDKFQYYTPGDKYTPQH

SEQ ID NO: 8308 - protein, 21 aa, unidentified
LDRSSGDRKKRWIPLISGILG

SEQ ID NO: 8309 - protein, 258 aa, unidentified
DTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCSHHFHELFLRDGRKLIVPCRDQHELVGRSMVSQGGSSGVAGTACLAKAYAQMWLMSYFHRRDLRTLGFGIMSSVPKDWFPTGRTTW

SEQ ID NO: 8310 - protein, 258 aa, unidentified; identical to SEQ ID NO: 8309

SEQ ID NO: 8311 - protein, 258 aa, unidentified; identical to SEQ ID NO: 8309

SEQ ID NO: 8312 - protein, 258 aa, unidentified; identical to SEQ ID NO: 8309

SEQ ID NO: 8313 - protein, 325 aa, unidentified
GDFGVAKGSRTIWYMWLGSRFLEFESFGFLNEEHWASRELSGGGVEGIPLNYLGYHLREMAQKPGVLYADDTAGWDTRITMADLEDEGILLDMMSGEHKKLASALFSKAYKVKVALCPRPGPKGGTLMDVISRTDQRGSGQVVTYALNTLTNIKVQLIRMAEAEGVLGATFEDFGIDRWLQEHGEDRVERMLVSGDDCVVNAIDERFGSSLNWLNAMEKVRKDIDLWKPSPSFRNWERVEFCSNHFHEMTMKDGRVIVAPCRGQTELIARGTVNQGGCVGVESTGCLAKAYAQMWLLLYFHRRDLRTLALAVMSAVPSNWIPTGR

SEQ ID NO: 8314 - protein, 325 aa, unidentified; identical to SEQ ID NO: 8313

SEQ ID NO: 8315 - protein, 250 aa, unidentified
SRTIWYMWLGSRFLEFESFGFLNEEHWASRELSGGGVEGIPLNYLGYHLREMAQKPGVLYADDTAGWDTRITMADLEDEGILLDMMSGEHKKLASALFSKAYKVKVALCPRPGPKGGTLMDVISRTDQRGSGQVVTYALNTLTNIKVQLIRMAEAEGVLGATFEDFGIDRWLQEHGEDRVERMLVSGDDCVVNAIDERFGSSLNWLNAMEKVRKDIDLWKPSPSFRNWERVEFCSNHFHEMTMKDGRVIV

SEQ ID NO: 8316 - protein, 210 aa, unidentified
LGSRFLEFESFGFLNEEHWASRELSGGGVEGIPLNYLGYHLREMAQKPGVLYADDTAGWDTRITMADLEDEGILLDMMSGEHKKLASALFSKAYKVKVALCPRPGPKGGTLMDVISRTDQRGSGQVVTYALNTLTNIKVQLIRMAEAEGVLGATFEDFGIDRWLQEHGEDRVERMLVSGDDCVVNAIDERFGSSLNWLNAMEKVRKDIDL

SEQ ID NO: 8317 - protein, 34 aa, unidentified
TVTLLLPAAAALVGYDCNKKGMGHPYAIGSMSEC

SEQ ID NO: 8318 - protein, 325 aa, unidentified; identical to SEQ ID NO: 8313

SEQ ID NO: 8319 - protein, 272 aa, unidentified
VESIPLFYLGYHLREMAKKPGKLYADDTAGWDTRITEADLDDECILCDYMEDEHKQLALSLFELCYKNKVALCPRPGRHGGTVMDVIFRRDQRGSGQVVTYALNTLTNIKVQLIRLAESEGVLDEDFNDHGIETWLNHYGEERLSRLLISGDDCLVNAFDERFGKALTWLNTMEKIRKDIDLCAPSNGYENFEKVEFCSNHFHELMLKDGRQLVVPCRSQNELVGRASVNQGGSATVAGTACLAKAYAQMWNLLYFHRRDLRLLGFAIMSAT

SEQ ID NO: 8320 - protein, 269 aa, unidentified
IPLFYLGYHLREMAKKPGKLYADDTAGWDTRITEADLDDECILCDYMEDEHKQLALSLFELCYKNKVALCPRPGRHGGTVMDVIFRRDQRGSGQVVTYALNTLTNIKVQLIRLAESEGVLDEDFNDHGIETWLNHYGEERLSRLLISGDDCLVNAFDERFGKALTWLNTMEKIRKDIDLCAPSNGYENFEKVEFCSNHFHELMLKDGRQLVVPCRSQNELVGRASVNQGGSATVAGTACLAKAYAQMWNLLYFHRRDLRLLGFAIMSAT

SEQ ID NO: 8321 - protein, 446 aa, unidentified
GYDCNKKGMGHPYAIGSMSECRKFDKGAISSSAWAGTILQVPKQTQTPHKTCKLLLRSYSMYCTYYNNPTMLEKYSDDVDLTPYIMDEQDCIDAWDKRVFYYQGTQISVNPGGVTKILIGADIDENGFCRTSKGTSTVVKGHIELVWAEVMEVTDLRGQPKRRELDGEGLRWSLTRKSSTTVTGVTVLTNSPPTAMCSWQSIYQGAGELLEYPGSETYVTIPKLSSGFKLITVVTVCGLRVSVTDDPSIFLVNTTAVDVTPANDEFSGRYSSYFKSGLLGLQLILQSGMTTTTRDLLKNQCILEQMIQQNVVHQASKHPGLAAYTLTGVRGWTIILSGAGVILKQCTEVAVVLRPQDECYTDIPITINSTSSPLFLDPTTHIIKISSHTIECDDDSNPIFQVRNQYYRMTPKLVPVRGLPNLPSVLSDLNTTLLSPGTGLYPNEVL

SEQ ID NO: 8322 - protein, 446 aa, unidentified; identical to SEQ ID NO: 8321

SEQ ID NO: 8323 - protein, 446 aa, unidentified; identical to SEQ ID NO: 8321

SEQ ID NO: 8324 - protein, 446 aa, unidentified; identical to SEQ ID NO: 8321

SEQ ID NO: 8325 - protein, 285 aa, unidentified; identical to SEQ ID NO: 8156

SEQ ID NO: 8326 - protein, 51 aa, unidentified
GLDFTKTDIEELRASWAQSKSSVSQKSSEFDANKNVTATHLDGNVLMWPGL

SEQ ID NO: 8327 - protein, 285 aa, unidentified; identical to SEQ ID NO: 8156

SEQ ID NO: 8328 - protein, 285 aa, unidentified; identical to SEQ ID NO: 8156

SEQ ID NO: 8329 - protein, 285 aa, unidentified; identical to SEQ ID NO: 8156

SEQ ID NO: 8330 - protein, 285 aa, unidentified; identical to SEQ ID NO: 8156

SEQ ID NO: 8331 - protein, 270 aa, unidentified
KPGEFGVAKGSRTIWYMWLGSRFLEFEALGFLNEERWASRDISGGGVEGIGINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCSHHFHELFLRDGRKLIVPCRDQHELV

SEQ ID NO: 8332 - protein, 278 aa, unidentified
KPGEFGVAKGSRTIWYMWLGSRFLEFEALGFLNEERWASRDISGGGVEGIGINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCSHHFHELFLRDGRKLIVPCRDQHELVGRSMVSQG

SEQ ID NO: 8333 - protein, 239 aa, unidentified
LNEERWASRDISGGGVEGIGINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCSHHFHELFLRDGRKLIVPCRDQHELV

SEQ ID NO: 8334 - protein, 504 aa, unidentified
IRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 8335 - protein, 501 aa, unidentified
CIGIGNRDFIEGMSGGTWVDIVLEHGGCVTVMSNDKPTLDFELVTTTASNMAEVRSYCYEANISEMASDSRCPTQGEAYLDKMADSQFVCKRGYVDRGWGNGCGLFGKGSIVTCAKFTCVKKLTGKSIQPENLEYRVLVSVHASQHGGMINNDTNHQHDKENRARIDITASAPRVEVELGSFGSFSMECEPRSGLNFGDLYYLTMNNKHWLVNRDWFHDLSLPWHTGATSNNHHWNNKEALVEFREAHAKKQTAVVLGSQEGAVHAALAGALEAESDGHKATIYSGHLKCRLKLDKLRLKGMSYALCTGAFTFARTPSETIHGTATVELQYAGEDGPCKVPIVITSDTNSMASTGRLITANPVVTESGANSKMMVEIDPPFGDSYIIVGTGTTKITHHWHRAGSSIGRAFEATMRGAKRMAVLGDTAWDFGSVGGMFNSVGKFVHQVFGSAFKALFGGMSWFTQLLIGFLLIWMGLNARGGTVAMSFMGIGAMLIFLATSV

SEQ ID NO: 8336 - protein, 263 aa, unidentified
GILYADDTAGWDTRITMADLEDEYTLTELMEGEHKKLAETLFNFAYKNKVALCPRPGKNGGTVLDVISRTDQRGSGQVVTYALNTLTNIKVQLIRMAESEGVLDEEFHDNGMLKWLEKHGRDRLQRLMVSGDDCVVNAIDERFGKSLVWLNEMQKIRKDIDLWKPSAGHCNWEEVEFCSNHFHKLVMRDGRTLVVPCRHEVELVGRASVNQGGSTGISGTACLAKAYAQMWLLLYFHRRDLRILGMAICSAVPANWVPTGRTT

SEQ ID NO: 8337 - protein, 504 aa, unidentified; identical to SEQ ID NO: 8334

SEQ ID NO: 8338 - protein, 329 aa, unidentified
KPGDFGVAKGSRTIWYMWLGSRFLEFESFGFLNEEHWASRELCGGGVEGIPLFYLGYHLEKMAEKAGILYADDTAGWDTRITMADLEDEYTLTELMEGEHKKLAETLFNFAYKNKVALCPRPGKNGGTVLDVISRTDQRGSGQVVTYALNTLTNIKVQLIRMAESEGVLDEEFHDNGMLKWLEKHGRDRLQRLMVSGDDCVVNAIDERFGKSLVWLNEMQKIRKDIDLWKPSAGHCNWEEVEFCSNHFHKLVMRDGRTLVVPCRHEVELVGRASVNQGGSTGISGTACLAKAYAQMWLLLYFHRRDLRILGMAICSAVPANWVPTGRTT

SEQ ID NO: 8339 - protein, 337 aa, unidentified
KPGEFGVAKGSRTIWYMWLGSRFLEFEALGFLNEERWASRDISGGGVEGIGINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCSHHFHELFLRDGRKLIVPCRDQHELVGRSMVSQGGSSGVAGTACLAKAYAQMWLMSYFHRRDLRTLGFGIMSSVPKDWFPTGRTTWSVHANHE

SEQ ID NO: 8340 - protein, 262 aa, unidentified
GILYADDTAGWDTRITMADLEDEYTLTELMEGEHKKLAETLFNFAYKNKVALCPRPGKNGGTVLDVISRTDQRGSGQVVTYALNTLTNIKVQLIRMAESEGVLDEEFHDNGMLKWLEKHGRDRLQRLMVSGDDCVVNAIDERFGKSLVWLNEMQKIRKDIDLWKPSAGHCNWEEVEFCSNHFHKLVMRDGRTLVVPCRHEVELVGRASVNQGGSTGISGTACLAKAYAQMWLLLYFHRRDLRILGMAICSAVPANWVPTGRT

SEQ ID NO: 8341 - protein, 143 aa, unidentified
GVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERF

SEQ ID NO: 8342 - protein, 174 aa, unidentified; identical to SEQ ID NO: 8195

SEQ ID NO: 8343 - protein, 258 aa, unidentified; identical to SEQ ID NO: 8309

SEQ ID NO: 8344 - protein, 127 aa, unidentified
DTAGWDTRITEADLDDECILCDYMEDEHKQLALSLFELCYKNKVALCPRPGRHGGTVMDVIFRRDQRGSGQVVTYALNTLTNIKVQLIRLAESEGVLDEDFNDHGIETWLNHYGEERLSRLLISGDD

SEQ ID NO: 8345 - protein, 258 aa, unidentified; identical to SEQ ID NO: 8309

SEQ ID NO: 8346 - protein, 258 aa, unidentified; identical to SEQ ID NO: 8309

SEQ ID NO: 8347 - protein, 258 aa, unidentified; identical to SEQ ID NO: 8309

SEQ ID NO: 8348 - protein, 258 aa, unidentified; identical to SEQ ID NO: 8309

SEQ ID NO: 8349 - protein, 258 aa, unidentified; identical to SEQ ID NO: 8309

SEQ ID NO: 8350 - protein, 504 aa, unidentified; identical to SEQ ID NO: 8334

SEQ ID NO: 8351 - protein, 333 aa, unidentified
KPGDFGVAKGSRTIWYMWLGSRFLEFESFGFLNEEHWASRELCGGGVEGIPLFYLGYHLEKMAEKAGILYADDTAGWDTRITMADLEDEYTLTELMEGEHKKLAETLFNFAYKNKVALCPRPGKNGGTVLDVISRTDQRGSGQVVTYALNTLTNIKVQLIRMAESEGVLDEEFHDNGMLKWLEKHGRDRLQRLMVSGDDCVVNAIDERFGKSLVWLNEMQKIRKDIDLWKPSAGHCNWEEVEFCSNHFHKLVMRDGRTLVVPCRHEVELVGRASVNQGGSTGISGTACLAKAYAQMWLLLYFHRRDLRILGMAICSAVPANWVPTGRTTWSLH

SEQ ID NO: 8352 - protein, 322 aa, unidentified
KPGEFGVAKGSRTIWYMWLGSRFLEFEALGFLNEERWASRDISGGGVEGIGINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCSHHFHELFLRDGRKLIVPCRDQHELVGRSMVSQGGSSGVAGTACLAKAYAQMWLMSYFHRRDLRTLGFGIMSSVPKDW

SEQ ID NO: 8353 - protein, 337 aa, unidentified; identical to SEQ ID NO: 8339

SEQ ID NO: 8354 - protein, 337 aa, unidentified; identical to SEQ ID NO: 8339

SEQ ID NO: 8355 - protein, 504 aa, unidentified; identical to SEQ ID NO: 8334

SEQ ID NO: 8356 - protein, 313 aa, unidentified
KGSRTIWYMWLGSRFLEFESFGFLNEEHWASRELSGGGVESIPLFYLGYHLREMAKKPGKLYADDTAGWDTRITEADLDDECILCDYMEDEHKQLALSLFELCYKNKVALCPRPGRHGGTVMDVIFRRDQRGSGQVVTYALNTLTNIKVQLIRLAESEGVLDEDFNDHGIETWLNHYGEERLSRLLISGDDCLVNAFDERFGKALTWLNTMEKIRKDIDLCAPSNGYENFEKVEFCSNHFHELMLKDGRQLVVPCRSQNELVGRASVNQGGSATVAGTACLAKAYAQMWNLLYFHRRDLRLLGFAIMSATPSN

SEQ ID NO: 8357 - protein, 504 aa, unidentified; identical to SEQ ID NO: 8334

SEQ ID NO: 8358 - protein, 491 aa, unidentified
QVDYGRLRKIGVFEKQTMNLKLSISASQRYMVIKTVPNLGTVSSCGDKEMAAYKESIRKLISPMHDMIEYIKGEVVVEAATSVALNGTQVRFFGLVVAIGALGLATSAQITAGIALHNSLENAKAIKGLSDAMKESNQAIQKLQDATAGTVIALNALQDQINTQIVPALNTLGCSVVSNTLGVALTRYYSELVQLFGPSLANPVEAPLSIQAISGAFNGDLKGMIRDYGYSPSDLEDIIRTGAITGRVIDVDMEDLTIILEISLPTLLVMRDTKVVNFGRITYNLNGSEWQTLSPDWIAIRNTLMSGVDLSTCVMSRQNLICKQDPTFAIDHTVSQCLRGEITSCPRGRVVNSIAPRFAIVNGNVLGNCVATTCLCGDPGTPVIQDASSSLTIMSIDKCELVSIDGYNFRPGPPVVNTTFHLSIDDIGPEVSVNPIDISGALGKIEQDLQSSKEHLANSDTILASINPKIINTNAAIGLIVVSSLGLIAAV

SEQ ID NO: 8359 - protein, 575 aa, unidentified
  VARIANT 178: note = Any amino acid
  VARIANT 179: note = Any amino acid
  VARIANT 180: note = Any amino acid
  VARIANT 181: note = Any amino acid
  VARIANT 182: note = Any amino acid
  VARIANT 183: note = Any amino acid
  VARIANT 184: note = Any amino acid
  VARIANT 185: note = Any amino acid
  VARIANT 186: note = Any amino acid
  VARIANT 187: note = Any amino acid
  VARIANT 188: note = Any amino acid
  VARIANT 189: note = Any amino acid
  VARIANT 190: note = Any amino acid
  VARIANT 191: note = Any amino acid
MDGDGRKRDSYWSTSLGGSATKLVSDLGRPGKVDTWLLILTFIQWVLSTATVIICIIIAARQGHDMRGYSITVEALNISSKEVKDSLTSLIRQEVITRAVNIQSSVQTGIPVLLNKNNRDVIQMIEKSCNKQELTHLCESTIAVHHAEGIAPLEPHSFWRCPAGEPYLSSDPEVSLLXXXXXXXXXXXXXXCVRLPSLSIGEVIYAYSSNLITQGCADIGKSYQVLQLGYISLNSDMFPDLNPVVSHTYDINDNRKSCSVVAAGARGYQLCSMPTVDERTDYSSDGIEDLVLDILDLKGRTKSHRYSSSEIDLDHPFSALYPGVGSGIATEGSLMFLGYGGLTTPLQGDTKCRTQGCQQVSQDTCNEALKITWLGGKQVVSVLIQVNDYLSERPKIKVTTIPITQNYLGAEGRLLKLGDQVYIYTRSSGWHSQLQIGVLDVSHPLTINWTPHEALSRPGNEACNWYNTCPKECISGVYTDAYPLSPDAANVATVTLYANTSRVNPTIMYSNTTNIINMLRIKDVQLEAAYTTTSCITHFGKGYCFHIIEINQKSLNTLQPMLFKTSIPKLCKAGS

SEQ ID NO: 8360 - protein, 266 aa, unidentified
GVEGIPLFYLGYHLEKMAEKAGILYADDTAGWDTRITMADLEDEYTLTELMEGEHKKLAETLFNFAYKNKVALCPRPGKNGGTVLDVISRTDQRGSGQVVTYALNTLTNIKVQLIRMAESEGVLDEEFHDNGMLKWLEKHGRDRLQRLMVSGDDCVVNAIDERFGKSLVWLNEMQKIRKDIDLWKPSAGHCNWEEVEFCSNHFHKLVMRDGRTLVVPCRHEVELVGRASVNQGGSTGISGTACLAKAYAQMWLLLYFHRRDLRILG

SEQ ID NO: 8361 - protein, 575 aa, unidentified; identical to SEQ ID NO: 8359
  VARIANT 178: note = Any amino acid
  VARIANT 179: note = Any amino acid
  VARIANT 180: note = Any amino acid
  VARIANT 181: note = Any amino acid
  VARIANT 182: note = Any amino acid
  VARIANT 183: note = Any amino acid
  VARIANT 184: note = Any amino acid
  VARIANT 185: note = Any amino acid
  VARIANT 186: note = Any amino acid
  VARIANT 187: note = Any amino acid
  VARIANT 188: note = Any amino acid
  VARIANT 189: note = Any amino acid
  VARIANT 190: note = Any amino acid
  VARIANT 191: note = Any amino acid

SEQ ID NO: 8362 - protein, 575 aa, unidentified; identical to SEQ ID NO: 8359
  VARIANT 178: note = Any amino acid
  VARIANT 179: note = Any amino acid
  VARIANT 180: note = Any amino acid
  VARIANT 181: note = Any amino acid
  VARIANT 182: note = Any amino acid
  VARIANT 183: note = Any amino acid
  VARIANT 184: note = Any amino acid
  VARIANT 185: note = Any amino acid
  VARIANT 186: note = Any amino acid
  VARIANT 187: note = Any amino acid
  VARIANT 188: note = Any amino acid
  VARIANT 189: note = Any amino acid
  VARIANT 190: note = Any amino acid
  VARIANT 191: note = Any amino acid

SEQ ID NO: 8363 - protein, 258 aa, unidentified; identical to SEQ ID NO: 8309

SEQ ID NO: 8364 - protein, 174 aa, unidentified; identical to SEQ ID NO: 8195

SEQ ID NO: 8365 - protein, 258 aa, unidentified; identical to SEQ ID NO: 8309

SEQ ID NO: 8366 - protein, 127 aa, unidentified; identical to SEQ ID NO: 8344

SEQ ID NO: 8367 - protein, 69 aa, unidentified
LILGESILYPSAEEYDCTWMQTNEKITDRFLITAISFQFNSTGSLINPQLGSECNVFNSSFCVHRNKAY

SEQ ID NO: 8368 - protein, 314 aa, unidentified
GCAKGSRTIWYMWLGSRFLEFESFGFLNEEHWASRELSGGGVESIPLFYLGYHLREMAKKPGKLYADDTAGWDTRITEADLDDECILCDYMEDEHKQLALSLFELCYKNKVALCPRPGRHGGTVMDVIFRRDQRGSGQVVTYALNTLTNIKVQLIRLAESEGVLDEDFNDHGIETWLNHYGEERLSRLLISGDDCLVNAFDERFGKALTWLNTMEKIRKDIDLCAPSNGYENFEKVEFCSNHFHELMLKDGRQLVVPCRSQNELVGRASVNQGGSATVAGTACLAKAYAQMWNLLYFHRRDLRLLGFAIMSATP

SEQ ID NO: 8369 - protein, 143 aa, unidentified
LGYHLREMAKKPGKLYADDTAGWDTRITEADLDDECILCDYMEDEHKQLALSLFELCYKNKVALCPRPGRHGGTVMDVIFRRDQRGSGQVVTYALNTLTNIKVQLIRLAESEGVLDEDFNDHGIETWLNHYGEERLSRLLISG

SEQ ID NO: 8370 - protein, 229 aa, unidentified; identical to SEQ ID NO: 8171

SEQ ID NO: 8371 - protein, 229 aa, unidentified; identical to SEQ ID NO: 8171

SEQ ID NO: 8372 - protein, 229 aa, unidentified; identical to SEQ ID NO: 8171

SEQ ID NO: 8373 - protein, 229 aa, unidentified; identical to SEQ ID NO: 8171

SEQ ID NO: 8374 - protein, 229 aa, unidentified; identical to SEQ ID NO: 8171

SEQ ID NO: 8375 - protein, 229 aa, unidentified; identical to SEQ ID NO: 8171

SEQ ID NO: 8376 - protein, 229 aa, unidentified; identical to SEQ ID NO: 8171

SEQ ID NO: 8377 - protein, 229 aa, unidentified; identical to SEQ ID NO: 8171

SEQ ID NO: 8378 - protein, 229 aa, unidentified; identical to SEQ ID NO: 8171

SEQ ID NO: 8379 - protein, 229 aa, unidentified; identical to SEQ ID NO: 8171

SEQ ID NO: 8380 - protein, 229 aa, unidentified; identical to SEQ ID NO: 8171

SEQ ID NO: 8381 - protein, 229 aa, unidentified; identical to SEQ ID NO: 8171

SEQ ID NO: 8382 - protein, 229 aa, unidentified; identical to SEQ ID NO: 8171

SEQ ID NO: 8383 - protein, 229 aa, unidentified; identical to SEQ ID NO: 8171

SEQ ID NO: 8384 - protein, 229 aa, unidentified; identical to SEQ ID NO: 8171

SEQ ID NO: 8385 - protein, 229 aa, unidentified; identical to SEQ ID NO: 8171

SEQ ID NO: 8386 - protein, 229 aa, unidentified; identical to SEQ ID NO: 8171

SEQ ID NO: 8387 - protein, 229 aa, unidentified; identical to SEQ ID NO: 8171

SEQ ID NO: 8388 - protein, 490 aa, unidentified
VLCVLVAIGGQTWGLVGYDCTSSVANITTISLFSVLPCELDQKPQSEYLSVIQVVQQRSVSRVHTFSCLVIRSSVIHHCGMHHHTSVGPMSIGEIMHTSNTQCADLHHFGKLAVGSGTLLTGFKVNETVQISITEHGYSDSEFKCRGTSFSHNGIAYHDAVMKSSYTVTLREEWASLDLDTGDLKMSTGYMHPFKTGQSFDASAGDVFWSTQDNQDCTPTSYLVLHEGAGIIYQGHRDTKTLVVNSSTHAMAVGILGPTLVCHQPALRTEHPKIFIVMKHPGSPSFFFKKSIVDPANVDMFLYINSKLVYLERHMGYQMSLVYEHFHKRTCNIKHQLLRHLIAIAVMNPEEFAWLYSKRPGVTAILRGELIYLMECQAVPVTIRKPSGRCYNELPVTFNNTPMFIKPRSRILVHYGSEIDCSPIVPAGFMIEGRWWALRPDSTQLPAPTTLSAEPEEGKWSYTSPHDLFKSGIYTLEELLAFQKRLLFSF

SEQ ID NO: 8389 - protein, 95 aa, unidentified
SQYNHVMINKILKRLDTVMYDSYKFDSESGSISYNKIVPIVREDNLQNAHRVDVIQYIKDKGSYIINGFTGWFSSLGKLMRWTIWGVGLFFSIFT

SEQ ID NO: 8390 - protein, 565 aa, unidentified
MVAEDAPVRATCRVLFRTTTLIFLCTLLALSISILYESLITQKQIMSQAGSTGSNSGLGSITDLLNNILSVANQIIYNSAVALPLQLDTLESTLLTAIKSLQTSDKLEQNCSWSAALINDNRYINGINQFYFSIAEGRNLTLGPLLNMPSFIPTATTPEGCTRIPSFSLTKTHWCYTHNVILNGCQDHVSSNQFVSMGIIEPTSAGFPFFRTLKTLYLSDGVNRKSCSISTVPGGCMMYCFVSTQPERDDYFSAAPPEQRIIIMYYNDTIVERIINPPGVLDVWATLNPGTGSGVYYLGWVLFPIYGGVIKGTSLWNNQANKYFIPQMVAALCSQNQATQVQNAKSSYYSSWFGNRMIQSGILACPLRQDLTNECLVLPFSNDQVLMGAEGRLYMYGDSVYYYQRSNSWWPMTMLYKVTITFTNGQPSAISAQNVPTQQVPRPGTGDCSATNRCPGFCLTGVYADAWLLTNPSSTSTFGSEATFTGSYLNTATQRINPTMYIANNTQIISSQQFGSSGQEAAYGHTTCFRDTGSVMVYCIYIIELSSSLLGQFQIVPFIRQVTLS

SEQ ID NO: 8391 - protein, 565 aa, unidentified; identical to SEQ ID NO: 8390

SEQ ID NO: 8392 - protein, 565 aa, unidentified; identical to SEQ ID NO: 8390

SEQ ID NO: 8393 - protein, 565 aa, unidentified; identical to SEQ ID NO: 8390

SEQ ID NO: 8394 - protein, 127 aa, unidentified; identical to SEQ ID NO: 8344

SEQ ID NO: 8395 - protein, 565 aa, unidentified; identical to SEQ ID NO: 8390

SEQ ID NO: 8396 - protein, 420 aa, unidentified
DDFTLTSPYLGFCPYCRHSTPCFSPIKIENVWDESDDGSIRIQVSAQFGYNQAGTADVTKFRYMSFDHDHDIKEDSMEKIAISTSGPCRRLGHKGYFLLAQCPPGDSVTVSITSGASENSCTVEKKIRRKFVGREEYLFPPVHGKLVKCHVYDHLKETSAGYITMHRPGPHAYKSYLEEASGEVYIKPPSGKNVTYECKCGDYSTGIVSTRTKMNGCTKAKQCIAYKSDQTKWVFNSPDLIRHTDHSVQGKLHIPFRLTPTVCPVPLAHTPTVTKWFKGITLHLTAMRPTLLTTRKLGLRADATAEWITGSTSRNFSVGREGLEYVWGNHEPVRVWAQESAPGDPHGWPHEIIIHYYHRHPVYTVIVLCGVALAILVGTASSAACIAKARRDCLTPYALAPNATVPTALAVLCCIRPTNA

SEQ ID NO: 8397 - protein, 337 aa, unidentified; identical to SEQ ID NO: 8339

SEQ ID NO: 8398 - protein, 565 aa, unidentified; identical to SEQ ID NO: 8390

SEQ ID NO: 8399 - protein, 565 aa, unidentified; identical to SEQ ID NO: 8390

SEQ ID NO: 8400 - protein, 565 aa, unidentified; identical to SEQ ID NO: 8390

SEQ ID NO: 8401 - protein, 304 aa, unidentified
AKGSRTIWYMWLGSRFLEFEALGFLNEERWASRDISGGGVEGIGINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCSHHFHELFLRDGRKLIVPCRDQHELVGRSMVSQGGSSGVAGTACLAKAYAQMWLMSYFHRRDLRTLG

SEQ ID NO: 8402 - protein, 316 aa, unidentified
CNIISDGRLSASADAYGSMDMHKRDYEFYKDKIVSRAGGALVANILRTRANTALGFYESCAEWKIFYEGVVFSPYMRQACTGTNGEWSRMKEQFYTKFYEMATRFQCFKFVRVPYIRPAESTQEVAPGCGAGGTINGVEYITDPRNGTIITSVVTDLKITGEYLMPFCYFVYRSRDIWLAENRGYDSDPFLKVYNEQGETLFDWNQLTDGYGEPKAEKMIKCSFIIVEKTSKITIQSWSASQFITRAAYYFNETIPRRPIQVIESKWAQSRMSDPITQESACRRLGDYCIYFRIGTYLGIFDDELGDLQVRDILSG

SEQ ID NO: 8403 - protein, 316 aa, unidentified; identical to SEQ ID NO: 8402

SEQ ID NO: 8404 - protein, 69 aa, unidentified; identical to SEQ ID NO: 8367

SEQ ID NO: 8405 - protein, 81 aa, unidentified
CKNSTCHASSSNLILGESILYPSAEEYDCTWMQTNEKITDRFLITAISFQFNSTGSLINPQLGSECNVFNSSFCVHRNKAY

SEQ ID NO: 8406 - protein, 69 aa, unidentified; identical to SEQ ID NO: 8367

SEQ ID NO: 8407 - protein, 69 aa, unidentified; identical to SEQ ID NO: 8367

SEQ ID NO: 8408 - protein, 69 aa, unidentified; identical to SEQ ID NO: 8367

SEQ ID NO: 8409 - protein, 69 aa, unidentified; identical to SEQ ID NO: 8367

SEQ ID NO: 8410 - protein, 236 aa, unidentified
GVEGIGINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCSHHFHELFLRDGRKLIVPCRDQHELVGRSMVSQGGSS

SEQ ID NO: 8411 - protein, 325 aa, unidentified
KPGDFGVAKGSRTIWYMWLGSRFLEFESFGFLNEEHWASRELCGGGVEGIPLFYLGYHLEKMAEKAGILYADDTAGWDTRITMADLEDEYTLTELMEGEHKKLAETLFNFAYKNKVALCPRPGKNGGTVLDVISRTDQRGSGQVVTYALNTLTNIKVQLIRMAESEGVLDEEFHDNGMLKWLEKHGRDRLQRLMVSGDDCVVNAIDERFGKSLVWLNEMQKIRKDIDLWKPSAGHCNWEEVEFCSNHFHKLVMRDGRTLVVPCRHEVELVGRASVNQGGSTGISGTACLAKAYAQMWLLLYFHRRDLRILGMAICSAVPANWVPT

SEQ ID NO: 8412 - protein, 325 aa, unidentified; identical to SEQ ID NO: 8411

SEQ ID NO: 8413 - protein, 174 aa, unidentified
FQVCQKDLTIVSDNMNSEITSSKLDLMKIFLLDKCQQVVARIKGGLSVTRYDLGFLSPQISGVGSGYVASNRSVLVGQYKYMLVHSYVANCHSCRSCVINAVTDEGVIPVHLTPDQCPCANFNGCYLPNGIKVYKDKVYNPLLDIDEEFYHQMTEVELNPNYISHPKDVKETFL

SEQ ID NO: 8414 - protein, 209 aa, unidentified
VDSGEYIEPFFPPHVCSWASTNKNSKEFVTVHEHSVVLDIYENKLMDPIFLAGKCFDKVCKTIHRNVLWVEANDNERDDFCVATAWEYSHVFADIDIDHNNNHPIYSIGKTIDSEIYGPRDLADACIIKICGIPGIRFSHGEWWGIKTLSDRIPLEDIIIKCHNGTSVGFVHNIWTPSELVGEITYRDHKCLDVLSSFLGQRKINPYEL

SEQ ID NO: 8415 - protein, 60 aa, unidentified
HCPTSETLKGHLFTRTHDHRVVKAIVAGHHPWGLTMACTVTFCGTEWIKTDLGDLIQVTG

SEQ ID NO: 8416 - protein, 42 aa, unidentified
GFLFRINDSHVVNLATRDFSPVPESYFAVDPVPVFHSHVFYS

SEQ ID NO: 8417 - protein, 209 aa, unidentified; identical to SEQ ID NO: 8414

SEQ ID NO: 8418 - protein, 313 aa, unidentified
KGSRTIWYMWLGSRFLEFESFGFLNEEHWASRELCGGGVEGIPLFYLGYHLEKMAEKAGILYADDTAGWDTRITMADLEDEYTLTELMEGEHKKLAETLFNFAYKNKVALCPRPGKNGGTVLDVISRTDQRGSGQVVTYALNTLTNIKVQLIRMAESEGVLDEEFHDNGMLKWLEKHGRDRLQRLMVSGDDCVVNAIDERFGKSLVWLNEMQKIRKDIDLWKPSAGHCNWEEVEFCSNHFHKLVMRDGRTLVVPCRHEVELVGRASVNQGGSTGISGTACLAKAYAQMWLLLYFHRRDLRILGMAICSAVPAN

SEQ ID NO: 8419 - protein, 106 aa, unidentified
NVSSIARSAIVMNVTASFHSVSDTQQMVGDIPLTFRFAKLGNAAMTCRLESEQLLLDYYHVTGSSHEGLFLRSQIDSWPGVHSTASGRHGMEKVVVWGDARSNEIL

SEQ ID NO: 8420 - protein, 55 aa, unidentified
DNVYHYRDNKGYWTMDETQPATTCDTFKQHESSEIEVKVWKSRMNNKSLIDLGGK

SEQ ID NO: 8421 - protein, 104 aa, unidentified
VKHGKAFNKGSIHGTHSSNDIKNLIGKKFEKGGVWGQTMFSDDGRASYTLSDDSLDTFHKMFHRILVELRLCQKNDFERVRVPTLDYERVMTEMFVESKLDQIE

SEQ ID NO: 8422 - protein, 121 aa, unidentified
QGSPVSKIFLPNRGEEVWCNSSIRVNFSLPDGSMEQQGWLESGYGRLFPLTRPCGKSQPLLEFYIPSYEKGDYELMSRSYPDMAISEPEEKMFRFSFVDFTPDSGLHRLHYLERIQSYAGE

SEQ ID NO: 8423 - protein, 58 aa, unidentified
GDDCVVNALDERFGRALTWLNTMEKTREDIEAWKPSRAYRTWQEVEFCSHHFHELFLR

SEQ ID NO: 8424 - protein, 258 aa, unidentified; identical to SEQ ID NO: 8309

SEQ ID NO: 8425 - protein, 174 aa, unidentified; identical to SEQ ID NO: 8195

SEQ ID NO: 8426 - protein, 258 aa, unidentified; identical to SEQ ID NO: 8309

SEQ ID NO: 8427 - protein, 258 aa, unidentified; identical to SEQ ID NO: 8309

SEQ ID NO: 8428 - protein, 258 aa, unidentified; identical to SEQ ID NO: 8309

SEQ ID NO: 8429 - protein, 258 aa, unidentified; identical to SEQ ID NO: 8309

SEQ ID NO: 8430 - protein, 258 aa, unidentified; identical to SEQ ID NO: 8309

SEQ ID NO: 8431 - protein, 558 aa, unidentified
MSSIVAIIVLFWFSLGCSFSKLVEKSVGPVASCEGELVPAGSVIKSCYHRCLMDPEPVDRTNLELYRVSKNIDGPTVIECAKVRQRQTFTLTWSFSYIKSPVTHEFLRVTKEECDKAITDNCPNRQCNHREADDLEEEYHYASDTVKEVITISLMSMPSSVQLVGESVNISPLSARTYSPLSDGMSKEDGKIYTWDSKYEVKGCPYEPVTTYGCDMYQDSDKRRYYMCSGGRFVVTAASVDEADLSPRCKGIRRSIEGFLYKHTEKEASSSDHSRLAISQTSEMKADVDYLRHKVQQIATHLDSEICQTQCEILAVESRLSRKDGSLVRIGMNYFKLFDNGTISGCLTLHGCRLTQPHIYCGNPPRMGVTCTENNGLWDPTTIELKRGGICSKPDRLEKLTVSLGSEHYVVDDSMRISINTSSRHGIYMTSFSDLHQSSMQWRITEIDDLKPEWVGQKEGKGGLSKSTEKSTTLNTPSFTIGSTVMKAYKYVSDYIMSVEHAVGLIVIVLMSIVGVLFALKMRLVFSSSNRKASSGKSYDAVPNNRKHEPSGSAEIWM

SEQ ID NO: 8432 - protein, 558 aa, unidentified; identical to SEQ ID NO: 8431

SEQ ID NO: 8433 - protein, 337 aa, unidentified; identical to SEQ ID NO: 8339

SEQ ID NO: 8434 - protein, 285 aa, unidentified; identical to SEQ ID NO: 8156

SEQ ID NO: 8435 - protein, 285 aa, unidentified; identical to SEQ ID NO: 8156

SEQ ID NO: 8436 - protein, 285 aa, unidentified; identical to SEQ ID NO: 8156

SEQ ID NO: 8437 - protein, 285 aa, unidentified; identical to SEQ ID NO: 8156

SEQ ID NO: 8438 - protein, 285 aa, unidentified; identical to SEQ ID NO: 8156

SEQ ID NO: 8439 - protein, 285 aa, unidentified; identical to SEQ ID NO: 8156

SEQ ID NO: 8440 - protein, 285 aa, unidentified; identical to SEQ ID NO: 8156

SEQ ID NO: 8441 - protein, 285 aa, unidentified; identical to SEQ ID NO: 8156

SEQ ID NO: 8442 - protein, 285 aa, unidentified; identical to SEQ ID NO: 8156

SEQ ID NO: 8443 - protein, 285 aa, unidentified; identical to SEQ ID NO: 8156

SEQ ID NO: 8444 - protein, 285 aa, unidentified; identical to SEQ ID NO: 8156

SEQ ID NO: 8445 - protein, 285 aa, unidentified; identical to SEQ ID NO: 8156

SEQ ID NO: 8446 - protein, 285 aa, unidentified; identical to SEQ ID NO: 8156

SEQ ID NO: 8447 - protein, 285 aa, unidentified; identical to SEQ ID NO: 8156

SEQ ID NO: 8448 - protein, 285 aa, unidentified; identical to SEQ ID NO: 8156

SEQ ID NO: 8449 - protein, 285 aa, unidentified; identical to SEQ ID NO: 8156

SEQ ID NO: 8450 - protein, 285 aa, unidentified; identical to SEQ ID NO: 8156

SEQ ID NO: 8451 - protein, 647 aa, unidentified
MQLFNSSRKSSITFVMLGLTTLFVLVVIRATAVFCLTAFDCNSKSINLTSISLVTTPSCDVSHKNITYEQINIAVTQSTERYELPFFRCHVESRSVMGRCGRTIDTFHNAGLFSEIVRVDRHECDVMHKKKVFRIVKEGAFSDIQLSPDGQTRYAYVSRGFVSPDGSCTPGADLVKNGREYDRPLINTELTITISTGTSIVSVEESQIRFPNGKSCKLQEESCFDADYGDVFWSVPTPSCDESESEKSLVYEGPGTLVRDVNGNSTIEYIHVHYSGYDFQVLLQSRQELICGYRSFYTEHPRLFVTLLSVNGPKFPLKRRVTAVDVSLLNFVNSKLVYSFRHIKQEVSRLFDLFNQDRCQSHNRITQNLLSIALLSPQEFAYTYGGPGHTAVSRGEVIYLAQCRPVAVVPDLNVTGCYNELPVVYNNETMFMTPRSRILINVGTPLKCLPDLLPKYYLNENWYVKTDHGLIETKPPQTIAPTTLDYEFRELSGISGGGLYRADIIQKYQAALISPMVEAVISTRVVDSLRGEVQLPSGYHYTSAFSPLDYESIKSKVGGFWDRFTESAVRAGGWFGFVLIVFGIYKFCLYVVTTVINFMHVRHDVGTLWAIPICLFDVLCNLVFHGRIWKGEPPAESVELEEILPNE

SEQ ID NO: 8452 - protein, 325 aa, unidentified; identical to SEQ ID NO: 8411

SEQ ID NO: 8453 - protein, 69 aa, unidentified; identical to SEQ ID NO: 8367

SEQ ID NO: 8454 - protein, 325 aa, unidentified; identical to SEQ ID NO: 8411

SEQ ID NO: 8455 - protein, 325 aa, unidentified; identical to SEQ ID NO: 8411

SEQ ID NO: 8456 - protein, 304 aa, unidentified
RFLEFESFGFLNEEHWASRELCGGGVEGIPLFYLGYHLEKMAEKAGILYADDTAGWDTRITMADLEDEYTLTELMEGEHKKLAETLFNFAYKNKVALCPRPGKNGGTVLDVISRTDQRGSGQVVTYALNTLTNIKVQLIRMAESEGVLDEEFHDNGMLKWLEKHGRDRLQRLMVSGDDCVVNAIDERFGKSLVWLNEMQKIRKDIDLWKPSAGHCNWEEVEFCSNHFHKLVMRDGRTLVVPCRHEVELVGRASVNQGGSTGISGTACLAKAYAQMWLLLYFHRRDLRILGMAICSAVPANWVPT

SEQ ID NO: 8457 - protein, 69 aa, unidentified; identical to SEQ ID NO: 8367

SEQ ID NO: 8458 - protein, 72 aa, unidentified
QRSALVPLNPPVKWLPASLDSLRCPTHTELGPDAGHTLERWLIKRPHNPKVPKVDGHLCHIAKWITRCEFTW

SEQ ID NO: 8459 - protein, 325 aa, unidentified; identical to SEQ ID NO: 8411

SEQ ID NO: 8460 - protein, 325 aa, unidentified; identical to SEQ ID NO: 8411

SEQ ID NO: 8461 - protein, 72 aa, unidentified
QHSVLVPLTSPVNWLPASLASLRCPTHTELGPDAGHTLERWLIQRPHNPDVPKVEGYLCHVAKWITRCEFTW

SEQ ID NO: 8462 - protein, 325 aa, unidentified; identical to SEQ ID NO: 8411

SEQ ID NO: 8463 - protein, 72 aa, unidentified; identical to SEQ ID NO: 8458

SEQ ID NO: 8464 - protein, 325 aa, unidentified; identical to SEQ ID NO: 8411

SEQ ID NO: 8465 - protein, 325 aa, unidentified; identical to SEQ ID NO: 8411

SEQ ID NO: 8466 - protein, 325 aa, unidentified; identical to SEQ ID NO: 8411

SEQ ID NO: 8467 - protein, 217 aa, unidentified
VLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCSHHFHELFLRDGRKLIVPCRDQHELVGRSMVSQGGSSGVA

SEQ ID NO: 8468 - protein, 240 aa, unidentified
ISQNRMSIILGQFFSFVQVAFGPVIQSPINSPITVQALNTLFGGDLSRFMEALGYSPGDLSDVLATGSATVRVIAVDPVLFTLTLEASFPTIIDYPGSSIIPIQAITFSTNGSEWLTQTPPWIHTKETQVSGFDPSMCKLTDTSMVCPRDTTYSLSDSVLTCLSGVTSTCPKIRVLNGLSPRYVVYKGVVIANCRATSCVCTDTGRPIAPLSGTLLTEINQEMCSVIGVDGVLIRAEQKL

SEQ ID NO: 8469 - protein, 68 aa, unidentified
CKEVYVDGIYITLGKKTLPRAMYAEDVALGGPISVDPIDLGNDVSAIQDAINKSKEHLDEANHLLDKV

SEQ ID NO: 8470 - protein, 137 aa, unidentified
LSHDGELILKSICPSWKYDKPTRRSRQVIQPPRSSSEVPLDLQTMTLEEEVAWIRARTEGHLSGLYNRTVKEIMLVHYNECQLRKSVLELAISLSPLDPRPYLSSILGHRFFEVIQRGKKRYYKTALPISEISFDLH

SEQ ID NO: 8471 - protein, 50 aa, unidentified
ATHQALNISNPSLAQNCWLCLNQGTSMPLAFPVNISSFNASQNNCTPSLP

SEQ ID NO: 8472 - protein, 76 aa, unidentified
DSAIYLAGSCHMQYCGQKGLRTASGQWIPYEGPTKYPDCPESWLTRSTEHSNELKVNLEVQEVESRRACIEATQRI

SEQ ID NO: 8473 - protein, 227 aa, unidentified
DTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCSHHFHELFLRDGRKLIVPCRDQHELVGRSMVSQGGSSGVAGTACLAKAYAQMWLM

SEQ ID NO: 8474 - protein, 565 aa, unidentified; identical to SEQ ID NO: 8390

SEQ ID NO: 8475 - protein, 565 aa, unidentified; identical to SEQ ID NO: 8390

SEQ ID NO: 8476 - protein, 565 aa, unidentified; identical to SEQ ID NO: 8390

SEQ ID NO: 8477 - protein, 285 aa, unidentified; identical to SEQ ID NO: 8156

SEQ ID NO: 8478 - protein, 285 aa, unidentified; identical to SEQ ID NO: 8156

SEQ ID NO: 8479 - protein, 285 aa, unidentified; identical to SEQ ID NO: 8156

SEQ ID NO: 8480 - protein, 285 aa, unidentified; identical to SEQ ID NO: 8156

SEQ ID NO: 8481 - protein, 285 aa, unidentified; identical to SEQ ID NO: 8156

SEQ ID NO: 8482 - protein, 285 aa, unidentified; identical to SEQ ID NO: 8156

SEQ ID NO: 8483 - protein, 285 aa, unidentified; identical to SEQ ID NO: 8156

SEQ ID NO: 8484 - protein, 285 aa, unidentified; identical to SEQ ID NO: 8156

SEQ ID NO: 8485 - protein, 285 aa, unidentified; identical to SEQ ID NO: 8156

SEQ ID NO: 8486 - protein, 285 aa, unidentified; identical to SEQ ID NO: 8156

SEQ ID NO: 8487 - protein, 285 aa, unidentified; identical to SEQ ID NO: 8156

SEQ ID NO: 8488 - protein, 285 aa, unidentified; identical to SEQ ID NO: 8156

SEQ ID NO: 8489 - protein, 285 aa, unidentified; identical to SEQ ID NO: 8156

SEQ ID NO: 8490 - protein, 285 aa, unidentified; identical to SEQ ID NO: 8156

SEQ ID NO: 8491 - protein, 285 aa, unidentified; identical to SEQ ID NO: 8156

SEQ ID NO: 8492 - protein, 285 aa, unidentified; identical to SEQ ID NO: 8156

SEQ ID NO: 8493 - protein, 258 aa, unidentified; identical to SEQ ID NO: 8309

SEQ ID NO: 8494 - protein, 501 aa, unidentified; identical to SEQ ID NO: 8222

SEQ ID NO: 8495 - protein, 501 aa, unidentified; identical to SEQ ID NO: 8222

SEQ ID NO: 8496 - protein, 501 aa, unidentified; identical to SEQ ID NO: 8222

SEQ ID NO: 8497 - protein, 501 aa, unidentified; identical to SEQ ID NO: 8222

SEQ ID NO: 8498 - protein, 501 aa, unidentified; identical to SEQ ID NO: 8222

SEQ ID NO: 8499 - protein, 419 aa, unidentified
LETHFTQYKLARPYIADCSNCGHGRCDSPIAIEDIRGDAHAGYIRIQTSAMFGLKSDGVDLAYMSFMNGKTLKAIKIEHLYARTSAPCSLVSYHGYYILAQCPPGDTVTVGFQDGANKHMCTIAHKVEFKPVGREKYRHPPEHGVELPCTKYTHKRADQGHYVEMHQPGLVADHSLLSMSSTKVKITVPSGSQVKYYCKCPDVKEGTTGSDYTTACTNLKQCRAYLIDNKKWVYNSGKLPRGEGETFKGKLHVPFVPVTSKCTATLAPEPLVEHKHRSLILHLHPEHPTLLTTRALGSNARPTRQWIEQPTTVNFTVTGEGFEYTWGNHPPKRVWAQESGEGNPHGWPHEIVIYYYNRYPMTTVIGLCTCVAIIMVSCVTSVWLLCRTRNLCITPYRLAPNAQVPILLAVLCCVKPTRA

SEQ ID NO: 8500 - protein, 419 aa, unidentified; identical to SEQ ID NO: 8499

SEQ ID NO: 8501 - protein, 422 aa, unidentified
STEELFKEYKLTRPYMAKCVRCAVGSCHSPIAIEAVRSDGHDGYIRIQTSSQYGLDPSGNVKSRVMRYNLYGKIVEVPLHQVSLHTSRPCHIIDGHGYFLLARCPEGDSITMEFKKDSVTHSCSVPYEVKFTPVGRELYSHPPEHGTEHPCRVYVHDAQQKDAYVEMHLPGSEVDSSLLSMSGRAVRVTPPSGQSVLVECNCGSAVSETINTAKSYSQCTKTSQCRAYRLQNDKWVYNSDKLPKASGETLKGKLHVPYLLSEAKCTVPLAPEPIVTFGFRFVSLKLHPRNPTYLTTRQLDGEPNYTHELISEPTTRNFTVTEHGWEYVWGNHPPQRYWAQETAPGNPHGLPHEVITHYYHRYPMSTIFGLSICAAVVTTSIAASTWLLCKSRVSCLTPYRLTPNAQLPVCLAFLCCARTARA

SEQ ID NO: 8502 - protein, 416 aa, unidentified
HFTQYKLARPYIADCSNCGHGRCDSPIAIEDIRGDAHAGYIRIQTSAMFGLKSDGVDLAYMSFMNGKTLKAIKIEHLYARTSAPCSLVSYHGYYILAQCPPGDTVTVGFQDGANKHMCTIAHKVEFKPVGREKYRHPPEHGVELPCTKYTHKRADQGHYVEMHQPGLVADHSLLSMSSTKVKITVPSGSQVKYYCKCPDVKEGTTGSDYTTACTNLKQCRAYLIDNKKWVYNSGKLPRGEGETFKGKLHVPFVPVTSKCTATLAPEPLVEHKHRSLILHLHPEHPTLLTTRALGSNARPTRQWIEQPTTVNFTVTGEGFEYTWGNHPPKRVWAQESGEGNPHGWPHEIVIYYYNRYPMTTVIGLCTCVAIIMVSCVTSVWLLCRTRNLCITPYRLAPNAQVPILLAVLCCVKPTRA

SEQ ID NO: 8503 - protein, 416 aa, unidentified; identical to SEQ ID NO: 8502

SEQ ID NO: 8504 - protein, 416 aa, unidentified; identical to SEQ ID NO: 8502

SEQ ID NO: 8505 - protein, 416 aa, unidentified; identical to SEQ ID NO: 8502

SEQ ID NO: 8506 - protein, 416 aa, unidentified; identical to SEQ ID NO: 8502

SEQ ID NO: 8507 - protein, 419 aa, unidentified; identical to SEQ ID NO: 8499

SEQ ID NO: 8508 - protein, 419 aa, unidentified; identical to SEQ ID NO: 8499

SEQ ID NO: 8509 - protein, 419 aa, unidentified; identical to SEQ ID NO: 8499

SEQ ID NO: 8510 - protein, 93 aa, unidentified
VSQEDKVKKYYGVETAEKVADSISGNKVFILMNTLLILTGAIITITLNITNLTAAKSQQNMLKIIQDDVNAKLEMFVNLDQLVKGEIKPKVSL

SEQ ID NO: 8511 - protein, 92 aa, unidentified
SQEDKVKKYYGVETAEKVADSISGNKVFILMNTLLILTGAIITITLNITNLTAAKSQQNMLKIIQDDVNAKLEMFVNLDQLVKGEIKPKVSL

SEQ ID NO: 8512 - protein, 93 aa, unidentified; identical to SEQ ID NO: 8510

SEQ ID NO: 8513 - protein, 93 aa, unidentified; identical to SEQ ID NO: 8510

SEQ ID NO: 8514 - protein, 93 aa, unidentified; identical to SEQ ID NO: 8510

SEQ ID NO: 8515 - protein, 93 aa, unidentified; identical to SEQ ID NO: 8510

SEQ ID NO: 8516 - protein, 49 aa, unidentified
DIGNLQMFGTNLVLNEEDGMKICHLNNECSLKLPVVRCMNSSLFRVTCG

SEQ ID NO: 8517 - protein, 206 aa, unidentified
EWIYTRSEILYDYTYTSVYFSVGSGVVVGDTVYFLIWGSLSSPIEETAYCFAPDCSNYNQRMCNEAQRPSKFGHRQMVNGILKFKTTSTGKPLLSVGTLSPSVVPFGSEGRLMYSEITKIIYLYLRSTSWHALPLTGLFVLGPPTSISWIVQRAVSRPGEFPCGASNRCPKDCVTGVYTDLFPLGSRYEYAATVYLNSETYRVNPT

SEQ ID NO: 8518 - protein, 575 aa, unidentified; identical to SEQ ID NO: 8301
  VARIANT 178: note = Any amino acid
  VARIANT 179: note = Any amino acid
  VARIANT 180: note = Any amino acid
  VARIANT 181: note = Any amino acid
  VARIANT 182: note = Any amino acid
  VARIANT 183: note = Any amino acid
  VARIANT 184: note = Any amino acid
  VARIANT 185: note = Any amino acid
  VARIANT 186: note = Any amino acid
  VARIANT 187: note = Any amino acid
  VARIANT 188: note = Any amino acid
  VARIANT 189: note = Any amino acid
  VARIANT 190: note = Any amino acid
  VARIANT 509: note = Any amino acid
  VARIANT 510: note = Any amino acid
  VARIANT 511: note = Any amino acid
  VARIANT 512: note = Any amino acid

SEQ ID NO: 8519 - protein, 572 aa, unidentified; identical to SEQ ID NO: 8208

SEQ ID NO: 8520 - protein, 575 aa, unidentified; identical to SEQ ID NO: 8301
  VARIANT 178: note = Any amino acid
  VARIANT 179: note = Any amino acid
  VARIANT 180: note = Any amino acid
  VARIANT 181: note = Any amino acid
  VARIANT 182: note = Any amino acid
  VARIANT 183: note = Any amino acid
  VARIANT 184: note = Any amino acid
  VARIANT 185: note = Any amino acid
  VARIANT 186: note = Any amino acid
  VARIANT 187: note = Any amino acid
  VARIANT 188: note = Any amino acid
  VARIANT 189: note = Any amino acid
  VARIANT 190: note = Any amino acid
  VARIANT 509: note = Any amino acid
  VARIANT 510: note = Any amino acid
  VARIANT 511: note = Any amino acid
  VARIANT 512: note = Any amino acid

SEQ ID NO: 8521 - protein, 572 aa, unidentified; identical to SEQ ID NO: 8208

SEQ ID NO: 8522 - protein, 565 aa, unidentified; identical to SEQ ID NO: 8390

SEQ ID NO: 8523 - protein, 565 aa, unidentified; identical to SEQ ID NO: 8390

SEQ ID NO: 8524 - protein, 565 aa, unidentified; identical to SEQ ID NO: 8390

SEQ ID NO: 8525 - protein, 565 aa, unidentified; identical to SEQ ID NO: 8390

SEQ ID NO: 8526 - protein, 565 aa, unidentified; identical to SEQ ID NO: 8390

SEQ ID NO: 8527 - protein, 572 aa, unidentified
MEYWKHTNHGKDAGNELEKSMATHGNKPTNKIIYILWTIILVLLSIVFIIVLINSIKSEKAHESLLQDINNEFMEVTEKIQMASDNTNDLIQSGVNTRLLTIQSHVQNYIPISLTQQMSDLRKFISEITIRNDNQEVPPQRITHDVGIKPLNPDDFWRCTSGLPSLMKTPKIRLMPGPGLLAMPTTVDGCVRTPSLVINDLIYAYTSNLITRGCQDIGKSYQVLQIGIITVNSDLVPDLNPRISHTFNINDNRKSCSLALLNTDVYQLCSTPKVDERSDYASSGIEDIVLDIVNHDGSISTTRFKNNNISFDQPYAALYPSVGPGIYYKGKIIFLGYGGLEHPINENAICNITGCPGKTQRDCNQASHSPWFSDRRMVNSIIVVDKGLNSIPKLKVWTISMRQNYWGSEGRLLLLGNKIYIYTRSTSWHSKLQLGIIDITDYSDIRIKWTWHNVLSRPGNNECPWGHSCPDGCITGVYTDAYPLNPTGSIVSSVILDSQKSRVNPVITYSTATERVNELAIQNRTLSAGYTTTSCITHYNKGYCFHIVEINQKSLNTFQPMLFKTEIPKSCS

SEQ ID NO: 8528 - protein, 572 aa, unidentified; identical to SEQ ID NO: 8527

SEQ ID NO: 8529 - protein, 572 aa, unidentified; identical to SEQ ID NO: 8527

SEQ ID NO: 8530 - protein, 55 aa, unidentified
SCLKKPDIGNLQMFGTNLVLNEEDGMKICHLNNECSLKLPVVRCMNSSLFRVTCG

SEQ ID NO: 8531 - protein, 501 aa, unidentified; identical to SEQ ID NO: 8222

SEQ ID NO: 8532 - protein, 337 aa, unidentified; identical to SEQ ID NO: 8339

SEQ ID NO: 8533 - protein, 501 aa, unidentified; identical to SEQ ID NO: 8222

SEQ ID NO: 8534 - protein, 430 aa, unidentified
VKGEFVEPLYTLKAEQMTMLQTIVRPEEGYVVATPNGLLEFKTGPAEIYGGQWLRELLADCHVNASYSTDVCPGGSQLNMADIMAKERVCSTQPYNRGWGTGCFKWGIGFVGTCVELHCDRGFNVSSIARSAIVMNVTASFHSVSDTQQMVGDIPLTFRFAKLGNAAMTCRLESEQLLLDYYHVTGSSHEGLFLRSQIDSWPGVHSTASGRHGMEKVVVWGDARSNEILVKNVIEPSLSWEDAIATHDGFRDISFVCQIMLDKLVSGAFRDCPGPKTSTFSQDGFGYSGVVITTLTASSNETCSLSLTCHGCLLQSTKMIFLAGKTTSRAFVKCGNHTSTLLVGSTSVSIECALNPISQGWRLARHVVDRYRRFGVSGVAGVWQDLVGKFSVGAFFSNTTLLVIFVLAALIDKRIAFLLVLGGYFYYVRA

SEQ ID NO: 8535 - protein, 337 aa, unidentified; identical to SEQ ID NO: 8339

SEQ ID NO: 8536 - protein, 571 aa, unidentified
MDRAVNRVVLENEEREAKNTWRLVFRIAVLLLMVMTLAISAAALAYSTGASTPHDLAGISTVISKTEDKVTSLLSSRQDVIDRIYKQVALESPLALLNTESIIMNAIPSLSYQINGAANNSGCGAPVHDPDYIGGIGKELIVGDISDVTSFYPSAYQEHLNFIPAPTTGSGCTRIPSFDMSTTHYCYTHNVILSGCRDHSHSHQYLALGVLRTSATGRVFFSTLRSINLDDTQNRKSCSVSATPLGCDMLCSKVTGTEEEDYKSVAPTSMVHGRLGFDGQYHEKDLDTTVLFKDWVANYPGAGGGSFIDDRVWFPVYGGLKPNSPSDTAQEGKYVIYKRHNNTCPDEQDYQIRMAKFSYKPGRFGGKRVQQAILSIKVSTSLGKDPVLTIPPNTITLMGAEGRILTVGTSHFLYQRGSSYFSPALLYPMTVNNKTATLHSPYTFNAFTRPGSVPCQASARCPNSCITGVYTDPYPLIFHRNHTLRGVFGTMLDDEQARLNPVSAVFDNISRSRVTRVSSSSTKAAYTTSTCFKVVKTNKAYCLSIAEISNTLFGEFRIVPLLVEILKDNRV

SEQ ID NO: 8537 - protein, 298 aa, unidentified
RDISGGGVEGIGINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCSHHFHELFLRDGRKLIVPCRDQHELVGRSMVSQGGSSGVAGTACLAKAYAQMWLMSYFHRRDLRTLGFGIMSSVPKDWFPTGRTTWSVHANHE

SEQ ID NO: 8538 - protein, 501 aa, unidentified; identical to SEQ ID NO: 8222

SEQ ID NO: 8539 - protein, 337 aa, unidentified; identical to SEQ ID NO: 8339

SEQ ID NO: 8540 - protein, 430 aa, unidentified; identical to SEQ ID NO: 8534

SEQ ID NO: 8541 - protein, 501 aa, unidentified; identical to SEQ ID NO: 8222

SEQ ID NO: 8542 - protein, 501 aa, unidentified; identical to SEQ ID NO: 8222

SEQ ID NO: 8543 - protein, 501 aa, unidentified; identical to SEQ ID NO: 8222

SEQ ID NO: 8544 - protein, 501 aa, unidentified; identical to SEQ ID NO: 8222

SEQ ID NO: 8545 - protein, 430 aa, unidentified; identical to SEQ ID NO: 8534

SEQ ID NO: 8546 - protein, 501 aa, unidentified; identical to SEQ ID NO: 8222

SEQ ID NO: 8547 - protein, 501 aa, unidentified; identical to SEQ ID NO: 8222

SEQ ID NO: 8548 - protein, 501 aa, unidentified; identical to SEQ ID NO: 8222

SEQ ID NO: 8549 - protein, 501 aa, unidentified; identical to SEQ ID NO: 8222

SEQ ID NO: 8550 - protein, 501 aa, unidentified; identical to SEQ ID NO: 8222

SEQ ID NO: 8551 - protein, 501 aa, unidentified; identical to SEQ ID NO: 8222

SEQ ID NO: 8552 - protein, 501 aa, unidentified; identical to SEQ ID NO: 8222

SEQ ID NO: 8553 - protein, 501 aa, unidentified; identical to SEQ ID NO: 8222

SEQ ID NO: 8554 - protein, 501 aa, unidentified; identical to SEQ ID NO: 8222

SEQ ID NO: 8555 - protein, 501 aa, unidentified; identical to SEQ ID NO: 8222

SEQ ID NO: 8556 - protein, 337 aa, unidentified; identical to SEQ ID NO: 8339

SEQ ID NO: 8557 - protein, 298 aa, unidentified; identical to SEQ ID NO: 8537

SEQ ID NO: 8558 - protein, 501 aa, unidentified; identical to SEQ ID NO: 8222

SEQ ID NO: 8559 - protein, 501 aa, unidentified; identical to SEQ ID NO: 8222

SEQ ID NO: 8560 - protein, 501 aa, unidentified; identical to SEQ ID NO: 8222

SEQ ID NO: 8561 - protein, 337 aa, unidentified; identical to SEQ ID NO: 8339

SEQ ID NO: 8562 - protein, 298 aa, unidentified; identical to SEQ ID NO: 8537

SEQ ID NO: 8563 - protein, 501 aa, unidentified; identical to SEQ ID NO: 8222

SEQ ID NO: 8564 - protein, 501 aa, unidentified; identical to SEQ ID NO: 8222

SEQ ID NO: 8565 - protein, 501 aa, unidentified; identical to SEQ ID NO: 8222

SEQ ID NO: 8566 - protein, 298 aa, unidentified; identical to SEQ ID NO: 8537

SEQ ID NO: 8567 - protein, 337 aa, unidentified; identical to SEQ ID NO: 8339

SEQ ID NO: 8568 - protein, 501 aa, unidentified; identical to SEQ ID NO: 8222

SEQ ID NO: 8569 - protein, 501 aa, unidentified; identical to SEQ ID NO: 8222

SEQ ID NO: 8570 - protein, 37 aa, unidentified
WTASHLKTIKRAHCQYVSGIENETGIWLETYHGGKPR

SEQ ID NO: 8571 - protein, 337 aa, unidentified; identical to SEQ ID NO: 8339

SEQ ID NO: 8572 - protein, 337 aa, unidentified; identical to SEQ ID NO: 8339

SEQ ID NO: 8573 - protein, 337 aa, unidentified; identical to SEQ ID NO: 8339

SEQ ID NO: 8574 - protein, 501 aa, unidentified; identical to SEQ ID NO: 8222

SEQ ID NO: 8575 - protein, 501 aa, unidentified; identical to SEQ ID NO: 8222

SEQ ID NO: 8576 - protein, 430 aa, unidentified; identical to SEQ ID NO: 8534

SEQ ID NO: 8577 - protein, 337 aa, unidentified; identical to SEQ ID NO: 8339

SEQ ID NO: 8578 - protein, 73 aa, unidentified
LETVLMSKSVSFRRLSHFRKLVPGFGKAYTIANGSLMETNVHYKRVDRWEEILPSKGCLKLNDKCLNPENGVF

SEQ ID NO: 8579 - protein, 73 aa, unidentified; identical to SEQ ID NO: 8578

SEQ ID NO: 8580 - protein, 65 aa, unidentified
WTRTPHTSSPLSNLRRHDAICPGLNPLLPYSSTEPLLRKPRRDPGDRWRERKRKISGGGPTAVLP

SEQ ID NO: 8581 - protein, 316 aa, unidentified
GCAKGSRTIWYMWLGSRFLEFESFGFLNEEHWASRELSGGGVESIPLFYLGYHLREMAKKPGKLYADDTAGWDTRITEADLDDECILCDYMEDEHKQLALSLFELCYKNKVALCPRPGRHGGTVMDVIFRRDQRGSGQVVTYALNTLTNIKVQLIRLAESEGVLDEDFNDHGIETWLNHYGEERLSRLLISGDDCLVNAFDERFGKALTWLNTMEKIRKDIDLCAPSNGYENFEKVEFCSNHFHELMLKDGRQLVVPCRSQNELVGRASVNQGGSATVAGTACLAKAYAQMWNLLYFHRRDLRLLGFAIMSATPSN

SEQ ID NO: 8582 - protein, 158 aa, unidentified
LGYHLREMAQKPGVLYADDTAGWDTRITMADLEDEGILLDMMSGEHKKLASALFSKAYKVKVALCPRPGPKGGTLMDVISRTDQRGSGQVVTYALNTLTNIKVQLIRMAEAEGVLGATFEDFGIDRWLQEHGEDRVERMLVSGDDCVVNAIDERFGSS

SEQ ID NO: 8583 - protein, 598 aa, unidentified
YLFVLCVLVAIGGQTWGLVGYDCTSSVANITTISLFSVLPCELDQKPQSEYLSVIQVVQQRSVSRVHTFSCLVIRSSVIHHCGMHHHTSVGPMSIGEIMHTSNTQCADLHHFGKLAVGSGTLLTGFKVNETVQISITEHGYSDSEFKCRGTSFSHNGIAYHDAVMKSSYTVTLREEWASLDLDTGDLKMSTGYMHPFKTGQSFDASAGDVFWSTQDNQDCTPTSYLVLHEGAGIIYQGHRDTKTLVVNSSTHAMAVGILGPTLVCHQPALRTEHPKIFIVMKHPGSPSFFFKKSIVDPANVDMFLYINSKLVYLERHMGYQMSLVYEHFHKRTCNIKHQLLRHLIAIAVMNPEEFAWLYSKRPGVTAILRGELIYLMECQAVPVTIRKPSGRCYNELPVTFNNTPMFIKPRSRILVHYGSEIDCSPIVPAGFMIEGRWWALRPDSTQLPAPTTLSAEPEEGKWSYTSPHDLFKSGIYTLEELLAFQKRLLFSFEKPAISHTLSSAAARQPADLSGIDGAGLFHPGQLEEIQKNFMSKIWGWYWNVSVVLGGLVGIYMVFQLIKSVINSIITCTCLYRAYGCGVEILTCCFSSCAKYLL

SEQ ID NO: 8584 - protein, 510 aa, unidentified
IFVNGTPIPRSDCSISQGSTTICNIPKFSRGLVVHDWRYKLITISIPKPTEIVKIALKTLDLSKTDEMRQAHTIVDGMAILLDKSMRQRLAAYSEEVYLTIEEQKSLISTRTKRSAWSVIAAFFRATLPQLGRSLATKGALKAMMKHSFMALVTSGITYGISQAQLPNVELIEEQIMLLKSGQKESTSVLSHLTLVNSMAIGDITEFSTSIRSAFLESRTGDSLTRTAYMLLREFLDDTYFSLDRLMSGHIPQFLMSPGTQKEWITTSTQTFGLIESISPHFKVKVLLIDDEKFNIYLSVRIPVFSGVQRKVFGEWDPKILHNRTCYTTPHSSWILSLNPDHDSRGITEVDVFDRRSCEMSGVPVCESEGKIDWLNEMKVDRTCTEWMRGNSRRKRHFEDIAAPSQREIEIGEKIGKALLDKFNRSMVSNENALKLKPFLVPPIEHSLNDLVRRMQEKHDQIDELHKKIGSNSWGIICVWIVAGLSATVLISSITVYIVLKCIEIKRSKR

SEQ ID NO: 8585 - protein, 199 aa, unidentified
KPGEFGVAKGSRTIWYMWLGSRFLEFEALGFLNEERWASRDISGGGVEGIGINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDD

SEQ ID NO: 8586 - protein, 59 aa, unidentified
LPTMPAESCGWNNVLTESKDYVTVTPHSVRLDPYGMVYVDSEFKDGRCSEQVCQTPNHR

SEQ ID NO: 8587 - protein, 47 aa, unidentified
KPDIGNLQMFGTNLVLNEEDGMKICHLNNECSLKLPVVRCMNSSLFR

SEQ ID NO: 8588 - protein, 34 aa, unidentified
CYFVYRSRDIWLAENRGYDSDPFLKVYNEQGETL

SEQ ID NO: 8589 - protein, 34 aa, unidentified; identical to SEQ ID NO: 8588

SEQ ID NO: 8590 - protein, 48 aa, unidentified
IGNLQMFGTNLVLNEEDGMKICHLNNECSLKLPVVRCMNSSLFRVTCG

SEQ ID NO: 8591 - protein, 48 aa, unidentified; identical to SEQ ID NO: 8590

SEQ ID NO: 8592 - protein, 55 aa, unidentified; identical to SEQ ID NO: 8530

SEQ ID NO: 8593 - protein, 248 aa, unidentified
DTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCSHHFHELFLRDGRKLIVPCRDQHELVGRSMVSQGGSSGVAGTACLAKAYAQMWLMSYFHRRDLRTLGFGIMSSVPK

SEQ ID NO: 8594 - protein, 127 aa, unidentified
DTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDD

SEQ ID NO: 8595 - protein, 127 aa, unidentified; identical to SEQ ID NO: 8594

SEQ ID NO: 8596 - protein, 293 aa, unidentified; identical to SEQ ID NO: 8158

SEQ ID NO: 8597 - protein, 328 aa, unidentified
PSTGCNIISDGRLSASADAYGSMDMHKRDYEFYKDKIVSRAGGALVANILRTRANTALGFYESCAEWKIFYEGVVFSPYMRQACTGTNGEWSRMKEQFYTKFYEMATRFQCFKFVRVPYIRPAESTQEVAPGCGAGGTINGVEYITDPRNGTIITSVVTDLKITGEYLMPFCYFVYRSRDIWLAENRGYDSDPFLKVYNEQGETLFDWNQLTDGYGEPKAEKMIKCSFIIVEKTSKITIQSWSASQFITRAAYYFNETIPRRPIQVIESKWAQSRMSDPITQESACRRLGDYCIYFRIGTYLGIFDDELGDLQVRDILSGQKGGGPNF

SEQ ID NO: 8598 - protein, 293 aa, unidentified; identical to SEQ ID NO: 8158

SEQ ID NO: 8599 - protein, 258 aa, unidentified; identical to SEQ ID NO: 8309

SEQ ID NO: 8600 - protein, 293 aa, unidentified; identical to SEQ ID NO: 8158

SEQ ID NO: 8601 - protein, 293 aa, unidentified; identical to SEQ ID NO: 8158

SEQ ID NO: 8602 - protein, 285 aa, unidentified; identical to SEQ ID NO: 8156

SEQ ID NO: 8603 - protein, 285 aa, unidentified; identical to SEQ ID NO: 8156

SEQ ID NO: 8604 - protein, 285 aa, unidentified; identical to SEQ ID NO: 8156

SEQ ID NO: 8605 - protein, 285 aa, unidentified; identical to SEQ ID NO: 8156

SEQ ID NO: 8606 - protein, 572 aa, unidentified; identical to SEQ ID NO: 8208

SEQ ID NO: 8607 - protein, 139 aa, unidentified
KIVSRAGGALVANILRTRANTALGFYESCAEWKIFYEGVVFSPYMRQACTGTNGEWSRMKEQFYTKFYEMATRFQCFKFVRVPYIRPAESTQEVAPGCGAGGTINGVEYITDPRNGTIITSVVTDLKITGEYLMPFCYF

SEQ ID NO: 8608 - protein, 285 aa, unidentified; identical to SEQ ID NO: 8156

SEQ ID NO: 8609 - protein, 565 aa, unidentified; identical to SEQ ID NO: 8390

SEQ ID NO: 8610 - protein, 565 aa, unidentified; identical to SEQ ID NO: 8390

SEQ ID NO: 8611 - protein, 194 aa, unidentified
KGSRTIWYMWLGSRFLEFESFGFLNEEHWASRELSGGGVESIPLFYLGYHLREMAKKPGKLYADDTAGWDTRITEADLDDECILCDYMEDEHKQLALSLFELCYKNKVALCPRPGRHGGTVMDVIFRRDQRGSGQVVTYALNTLTNIKVQLIRLAESEGVLDEDFNDHGIETWLNHYGEERLSRLLISGDDCLV

SEQ ID NO: 8612 - protein, 125 aa, unidentified
LARLDANSTGVPVNIPPTGISQVKGDCSTGDIQGMNETLSTRGTLGERTFLSIRPGGWFTNTTVWFCVHWPFGFIQRKENLSEGSAQVRNCLDPINVTEPRVANYSYCPLEYKGKNYINKGLKCV

SEQ ID NO: 8613 - protein, 44 aa, unidentified
EEMSKSICKRLILCGLYSGEKAREILKKPFTVSWEQSETNPDCF

SEQ ID NO: 8614 - protein, 310 aa, unidentified
IWYMWLGSRFLEFESFGFLNEEHWASRELCGGGVEGIPLFYLGYHLEKMAEKAGILYADDTAGWDTRITMADLEDEYTLTELMEGEHKKLAETLFNFAYKNKVALCPRPGKNGGTVLDVISRTDQRGSGQVVTYALNTLTNIKVQLIRMAESEGVLDEEFHDNGMLKWLEKHGRDRLQRLMVSGDDCVVNAIDERFGKSLVWLNEMQKIRKDIDLWKPSAGHCNWEEVEFCSNHFHKLVMRDGRTLVVPCRHEVELVGRASVNQGGSTGISGTACLAKAYAQMWLLLYFHRRDLRILGMAICSAVPANWV

SEQ ID NO: 8615 - protein, 318 aa, unidentified
KGSRTIWYMWLGSRFLEFESFGFLNEEHWASRELCGGGVEGIPLFYLGYHLEKMAEKAGILYADDTAGWDTRITMADLEDEYTLTELMEGEHKKLAETLFNFAYKNKVALCPRPGKNGGTVLDVISRTDQRGSGQVVTYALNTLTNIKVQLIRMAESEGVLDEEFHDNGMLKWLEKHGRDRLQRLMVSGDDCVVNAIDERFGKSLVWLNEMQKIRKDIDLWKPSAGHCNWEEVEFCSNHFHKLVMRDGRTLVVPCRHEVELVGRASVNQGGSTGISGTACLAKAYAQMWLLLYFHRRDLRILGMAICSAVPANWVPTG

SEQ ID NO: 8616 - protein, 229 aa, unidentified
GGVEGIPLFYLGYHLEKMAEKAGILYADDTAGWDTRITMADLEDEYTLTELMEGEHKKLAETLFNFAYKNKVALCPRPGKNGGTVLDVISRTDQRGSGQVVTYALNTLTNIKVQLIRMAESEGVLDEEFHDNGMLKWLEKHGRDRLQRLMVSGDDCVVNAIDERFGKSLVWLNEMQKIRKDIDLWKPSAGHCNWEEVEFCSNHFHKLVMRDGRTLVVPCRHEVELVGRA

SEQ ID NO: 8617 - protein, 310 aa, unidentified
KGSRTIWYMWLGSRFLEFESFGFLNEEHWASRELSGGGVESIPLFYLGYHLREMAKKPGKLYADDTAGWDTRITEADLDDECILCDYMEDEHKQLALSLFELCYKNKVALCPRPGRHGGTVMDVIFRRDQRGSGQVVTYALNTLTNIKVQLIRLAESEGVLDEDFNDHGIETWLNHYGEERLSRLLISGDDCLVNAFDERFGKALTWLNTMEKIRKDIDLCAPSNGYENFEKVEFCSNHFHELMLKDGRQLVVPCRSQNELVGRASVNQGGSATVAGTACLAKAYAQMWNLLYFHRRDLRLLGFAIMSAT

SEQ ID NO: 8618 - protein, 74 aa, unidentified
VHQFIRITTSVNGTEVIVQSPTQIMEQNEVMYELRSDHCSESVMNIYCPYIDAQLMPPTSTNCINGQLNDCTFS

SEQ ID NO: 8619 - protein, 195 aa, unidentified
AKGSRTIWYMWLGSRFLEFEALGFLNEERWASRDISGGGVEGIGINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVV

SEQ ID NO: 8620 - protein, 69 aa, unidentified
RLPSGVWFEFVDQDVYAAAKLPECPVGATISAPTQTSVDVSLILDVERILDYSLCQETWSKIRSKQPVS

SEQ ID NO: 8621 - protein, 323 aa, unidentified
GVAKGSRTIWYMWLGSRFLEFESFGFLNEEHWASRELSGGGVEGIPLNYLGYHLREMAQKPGVLYADDTAGWDTRITMADLEDEGILLDMMSGEHKKLASALFSKAYKVKVALCPRPGPKGGTLMDVISRTDQRGSGQVVTYALNTLTNIKVQLIRMAEAEGVLGATFEDFGIDRWLQEHGEDRVERMLVSGDDCVVNAIDERFGSSLNWLNAMEKVRKDIDLWKPSPSFRNWERVEFCSNHFHEMTMKDGRVIVAPCRGQTELIARGTVNQGGCVGVESTGCLAKAYAQMWLLLYFHRRDLRTLALAVMSAVPSNWIPTGRT

SEQ ID NO: 8622 - protein, 323 aa, unidentified
KGSRTIWYMWLGSRFLEFESFGFLNEEHWASRELSGGGVESIPLFYLGYHLREMAKKPGKLYADDTAGWDTRITEADLDDECILCDYMEDEHKQLALSLFELCYKNKVALCPRPGRHGGTVMDVIFRRDQRGSGQVVTYALNTLTNIKVQLIRLAESEGVLDEDFNDHGIETWLNHYGEERLSRLLISGDDCLVNAFDERFGKALTWLNTMEKIRKDIDLCAPSNGYENFEKVEFCSNHFHELMLKDGRQLVVPCRSQNELVGRASVNQGGSATVAGTACLAKAYAQMWNLLYFHRRDLRLLGFAIMSATPSNWIPTGRTTWS

SEQ ID NO: 8623 - protein, 32 aa, unidentified
ISRNKDISIKFWTGDVLSMKPPYTKPVWTIAN

SEQ ID NO: 8624 - protein, 522 aa, unidentified
MHPLESYIYWGGVIGVITTISHLEHYSKSTIAEENSPELKLNEKTCRGMYKLVPPEPPKTQIREQLAKGTLIWYDHSVKAYIYGRELYTNYQYYGTGIDSNSYPVKSWRNTFPHLDELSEWIKRGGCKVGRNICGPGDFWGTWSSECLKSSEVLLSTDSQWGGEKIEHECSGSEWIKFPYHTCQISWSCHLHEVSLPIRLDTEGRVYTSLPNGSRLELDKNIYTMGKSSQLYIPELPLRHQSEVLLDCLGGVGPGGLKCILREGPGDLIGSVYSGNVTFVANRRSNILVNLTTLNSTTAERIIVSDKSASLSDLYEVDSLVREVSMRSDLNDFELTKGLIELTGVVTRLLENLSQKDPLLLGKVLESKSSYRTLYTAGGLFTKCFGEAEHAVKGEFCTPEGLTMQSGVPVPWDGTSFCLKPSTEIAYISLLHDIHEIEGLERPASLEGASLQWSIYELVERERSELLESARRVKRYSSALMSDVLENPLNTWYGSIVSLCSISLTTIIMCSLLFLFLLKIVW

SEQ ID NO: 8625 - protein, 596 aa, unidentified
MALTDIRQWQLRNTLREKLYICFNMALLFTSCSSADIGLTDLSLLESLSVEALRCNGASRFLPIPRKPECYLNKNKGEYKTIGQIELEILREIPSHQRVSTWRCESFEVIKVCKETFFGFQHQFEYTRKAKNSTPLNFLEITALRNAPIKDETLSFGTQKDFVCHWMEENEVMYKKRVCYKNEHLINVTSQTTQIEIPNTSGVPLHLGYLMSQNGVEYVWNSSVNVSCPLEKYQTELCTVRADLSLSSPNPDLSNLIIVCPNNHHIFHLNKEYKPIGPLSICANNFTRIFYTSEGLLLRIFRRNSTEKEIWDMLPTTNALPSLAITLASSMLEFLQDNLQLSIERIWDSIQNQICSIKENEWFLARSLLSTTPTEAAKIFFNERDITASYIRGGIVVRNCFKTKVNLDPNPTRCGKFWPIKDSLEYLEISTNTISKGTTDDHCMLSEGHLIYVNATHYLGLDDQKLYILERPIISSMSHLVLHPLQFAPSDLYTLHELQEDELSRYSISKLNKRLEALTTTLLNYQMDEVPGVINPRAPWTPITKFFKDLWFKLTSPLPLFIITLVSFIIVAKIIHLVYLWKHHYRYTSTAHWRYN

SEQ ID NO: 8626 - protein, 522 aa, unidentified; identical to SEQ ID NO: 8624

SEQ ID NO: 8627 - protein, 79 aa, unidentified
SLKTSLEKSNQAIEEIRLANKETILAVQGVQDYINNELVPSVHRMSCELVGHKLGLKLLRYYTEILSIFGPSLRDPIAA

SEQ ID NO: 8628 - protein, 56 aa, unidentified
YNTRSTTAESIYSCKWMSTITKTITKTWVKKSSLYYNSDGSLFSEGIEWKTKISDN

SEQ ID NO: 8629 - protein, 583 aa, unidentified
SAGFIAYDCNGSRIQKTTVSLVETPSCTFELENVTESEVAVAVTQSALTQEIPFYRCLIVAYHHIWRCGSVIDTNVQGGDYAEVIRTTKSECEEMINHKKYKTIGGNSVSIDLPPGGRTSFSYTSWGQVKDSGSCVAGPILYSGGTSYDQHTRNTRLEILYTRGVGRVAVEKKSLIMPNGMQCNVALEECELADYGQVFWKQPVPSCQNEVEEQSLVYKGPATLITNQNTSERFIQVSFSGHHFQIKLEDRTTYICGFRSFFTEHPKLYITLLDLSYPDFPLKENTGTDVNMMNYINSKLVYSMRHIKEQVMTLYRLFELERCLMQNRITSNLLTLAILSPREFAYQYYGEPGYTAVVRGEVVHIARCTPVPVTPRKTELCYNELPVSFNNKSLFMTPRSRILMEIGTVVECATDVGPQFKTANRWITMVSHGLISVEKPKIITPDPITYHFETLEDMLTGGLYTKETIANYQQILTSPMEESILSSRVTTAIRGGESLPSGYPASNIFSSYDIERLRVKVTSGLVHTMDKLLVLGNWFSVFVMIGWAINTLISIINCGLNYYVVKPETSGIFALLTCCFSAI

SEQ ID NO: 8630 - protein, 42 aa, unidentified
VTAHILNSWDESRVNQDVLVDSTVIEAPEIGRIGIYDACQMT

SEQ ID NO: 8631 - protein, 337 aa, unidentified; identical to SEQ ID NO: 8339

SEQ ID NO: 8632 - protein, 116 aa, unidentified
GNLTGCARTRVVNTHVPKFALSGGVVFANCAPIVCKCQDPMANINQEPKVTNVMVSSDTCKEVYVDGIYITLGKKTLPRAMYAEDVALGGPISVDPIDLGNDVSAIQDAINKSKEH

SEQ ID NO: 8633 - protein, 108 aa, unidentified
NIKVQLVRMAESEGILTPELEDLGIEQWLKQNGEDRLSRLLVSGDDCVVNALDERFGRALTWLNTMEKTREDIEAWKPSRAYRTWQEVEFCSHHFHELFLRDGRKLIV

SEQ ID NO: 8634 - protein, 76 aa, unidentified
EELMNALVNSTLLEARATNQFLAVSKGNCSGPTTIRGQFSNMSLSLLDLYLSRGYNVSSIVTMTSQGMYGGTYLVG

SEQ ID NO: 8635 - protein, 57 aa, unidentified
WHSGIGHVGLVKNELVLFPMIGEVRSLQGACTLKFCGHIGYRLATGEFFKLDFYSLP

SEQ ID NO: 8636 - protein, 40 aa, unidentified
WIGGQKEPQLCKRQVEGTATLAYDPKGKTKDMTVFGAELR

SEQ ID NO: 8637 - protein, 337 aa, unidentified; identical to SEQ ID NO: 8339

SEQ ID NO: 8638 - protein, 522 aa, unidentified
MIHNSELLANAFLMIALISWTTCEDQSHNMKILFPTSSKIEWHDVSPSNLICSTARIHQNIAHGLSFVVNRPVIGKDPKISGTLCVAIELTTTCSKGFFGGVDVTLSTSPADLSEENCRKEIASQNQGEFSSAEHPQPVCSWMKTSSTSRTVIHLSKMDAHYDPYSDTLFSSIFLSGKCRASFCQTVFENRLWIPQESLTEYCSTEHLVESSMMIYNSSSNGSSLWSPDFDISEEEKPCIMNFCGQKGLRFASGEWVALSRQSIPKAPWVGEHFYHLKDCDGHTTVNLVEAHQDLRHMTKVVLEEFIDEQCEMTVNKLKEGNMISRIELQTLYPRTPGFHPIYRYTQGKFLMGMAHYSWVSIESSEIFPYISIRSSLNKSIEYSYWTMDNRTQIIDGPNGLYILDHQLIYGLEEEQKFRRILSKSSKHVFPILPEQKTNGQSFVRLLSHTSYSFSDDASLVDVIWHPVLTCLIITAILLPSMIGIIWCTKNQVFIKKLKSFAQRDVEPSEDISEAEGEYFNP

SEQ ID NO: 8639 - protein, 583 aa, unidentified
IAYDCNGSRIQKTTVSLVETPSCTFELENVTESEVAVAVTQSALTQEIPFYRCLIVAYHHIWRCGSVIDTNVQGGDYAEVIRTTKSECEEMINHKKYKTIGGNSVSIDLPPGGRTSFSYTSWGQVKDSGSCVAGPILYSGGTSYDQHTRNTRLEILYTRGVGRVAVEKKSLIMPNGMQCNVALEECELADYGQVFWKQPVPSCQNEVEEQSLVYKGPATLITNQNTSERFIQVSFSGHHFQIKLEDRTTYICGFRSFFTEHPKLYITLLDLSYPDFPLKENTGTDVNMMNYINSKLVYSMRHIKEQVMTLYRLFELERCLMQNRITSNLLTLAILSPREFAYQYYGEPGYTAVVRGEVVHIARCTPVPVTPRKTELCYNELPVSFNNKSLFMTPRSRILMEIGTVVECATDVGPQFKTANRWITMVSHGLISVEKPKIITPDPITYHFETLEDMLTGGLYTKETIANYQQILTSPMEESILSSRVTTAIRGGESLPSGYPASNIFSSYDIERLRVKVTSGLVHTMDKLLVLGNWFSVFVMIGWAINTLISIINCGLNYYVVKPETSGIFALLTCCFSAIFQVV

SEQ ID NO: 8640 - protein, 497 aa, unidentified
QSHNMKILFPTSSKIEWHDVSPSNLICSTARIHQNIAHGLSFVVNRPVIGKDPKISGTLCVAIELTTTCSKGFFGGVDVTLSTSPADLSEENCRKEIASQNQGEFSSAEHPQPVCSWMKTSSTSRTVIHLSKMDAHYDPYSDTLFSSIFLSGKCRASFCQTVFENRLWIPQESLTEYCSTEHLVESSMMIYNSSSNGSSLWSPDFDISEEEKPCIMNFCGQKGLRFASGEWVALSRQSIPKAPWVGEHFYHLKDCDGHTTVNLVEAHQDLRHMTKVVLEEFIDEQCEMTVNKLKEGNMISRIELQTLYPRTPGFHPIYRYTQGKFLMGMAHYSWVSIESSEIFPYISIRSSLNKSIEYSYWTMDNRTQIIDGPNGLYILDHQLIYGLEEEQKFRRILSKSSKHVFPILPEQKTNGQSFVRLLSHTSYSFSDDASLVDVIWHPVLTCLIITAILLPSMIGIIWCTKNQVFIKKLKSFAQRDVEPSEDISEAEGEYFNP

SEQ ID NO: 8641 - protein, 638 aa, unidentified
MKMEVHLLVFLSFVALSAGFIAYDCNGSRIQKTTVSLVETPSCTFELENVTESEVAVAVTQSALTQEIPFYRCLIVAYHHIWRCGSVIDTNVQGGDYAEVIRTTKSECEEMINHKKYKTIGGNSVSIDLPPGGRTSFSYTSWGQVKDSGSCVAGPILYSGGTSYDQHTRNTRLEILYTRGVGRVAVEKKSLIMPNGMQCNVALEECELADYGQVFWKQPVPSCQNEVEEQSLVYKGPATLITNQNTSERFIQVSFSGHHFQIKLEDRTTYICGFRSFFTEHPKLYITLLDLSYPDFPLKENTGTDVNMMNYINSKLVYSMRHIKEQVMTLYRLFELERCLMQNRITSNLLTLAILSPREFAYQYYGEPGYTAVVRGEVVHIARCTPVPVTPRKTELCYNELPVSFNNKSLFMTPRSRILMEIGTVVECATDVGPQFKTANRWITMVSHGLISVEKPKIITPDPITYHFETLEDMLTGGLYTKETIANYQQILTSPMEESILSSRVTTAIRGGESLPSGYPASNIFSSYDIERLRVKVTSGLVHTMDKLLVLGNWFSVFVMIGWAINTLISIINCGLNYYVVKPETSGIFALLTCCFSAIFQVVKNRQLGNPEETKTLSAVVQIDAEGREEPSHNKFYK

SEQ ID NO: 8642 - protein, 638 aa, unidentified; identical to SEQ ID NO: 8641

SEQ ID NO: 8643 - protein, 243 aa, unidentified
KPGEFGVAKGSRTIWYMWLGSRFLEFEALGFLNEERWASRDISGGGVEGIGINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEF

SEQ ID NO: 8644 - protein, 337 aa, unidentified; identical to SEQ ID NO: 8339

SEQ ID NO: 8645 - protein, 344 aa, unidentified
SITDDFTLTSPYLGHCPYCLHATPCFSPIKIENVWDESDDGTIRIQVSAQLGYNQAGTADPTKFRYMSYEQDHDIKEASMDKIAISTSGPCSRLGHKGYFLLARCPPGDSVTVSITSGASATSCTVEKKIRRKFVGREEYLLPPVHGKLIKCHVYDHLKETTAGYITMHRPGPHAYATYVEESSGEVYIRPPSGKNVTYECKCGDYSTGTVNTRTKMPGCTKKKQCIAYKSDQTKWVFNSPDLIRHSDHAVQGKLHIPFKLTATACPVPLAHTPTVEKWFKGVTLHLTASHPTLLTTRKLGPRAEPTSEWIVGTVSRNFSVGREGLEYTWGNHDPVRVWSQESA

SEQ ID NO: 8646 - protein, 197 aa, unidentified
GVAKGSRTIWYMWLGSRFLEFEALGFLNEERWASRDISGGGVEGIGINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVV

SEQ ID NO: 8647 - protein, 337 aa, unidentified; identical to SEQ ID NO: 8339

SEQ ID NO: 8648 - protein, 337 aa, unidentified; identical to SEQ ID NO: 8339

SEQ ID NO: 8649 - protein, 337 aa, unidentified; identical to SEQ ID NO: 8339

SEQ ID NO: 8650 - protein, 629 aa, unidentified
LVFLSFVALSAGFIAYDCNGSRIQKTTVSLVETPSCTFELENVTESEVAVAVTQSALTQEIPFYRCLIVAYHHIWRCGSVIDTNVQGGDYAEVIRTTKSECEEMINHKKYKTIGGNSVSIDLPPGGRTSFSYTSWGQVKDSGSCVAGPILYSGGTSYDQHTRNTRLEILYTRGVGRVAVEKKSLIMPNGMQCNVALEECELADYGQVFWKQPVPSCQNEVEEQSLVYKGPATLITNQNTSERFIQVSFSGHHFQIKLEDRTTYICGFRSFFTEHPKLYITLLDLSYPDFPLKENTGTDVNMMNYINSKLVYSMRHIKEQVMTLYRLFELERCLMQNRITSNLLTLAILSPREFAYQYYGEPGYTAVVRGEVVHIARCTPVPVTPRKTELCYNELPVSFNNKSLFMTPRSRILMEIGTVVECATDVGPQFKTANRWITMVSHGLISVEKPKIITPDPITYHFETLEDMLTGGLYTKETIANYQQILTSPMEESILSSRVTTAIRGGESLPSGYPASNIFSSYDIERLRVKVTSGLVHTMDKLLVLGNWFSVFVMIGWAINTLISIINCGLNYYVVKPETSGIFALLTCCFSAIFQVVKNRQLGNPEETKTLSAVVQIDAEGREEPSHNKF

SEQ ID NO: 8651 - protein, 337 aa, unidentified; identical to SEQ ID NO: 8339

SEQ ID NO: 8652 - protein, 319 aa, unidentified
LGSRFLEFEALGFLNEERWASRDISGGGVEGIGINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCSHHFHELFLRDGRKLIVPCRDQHELVGRSMVSQGGSSGVAGTACLAKAYAQMWLMSYFHRRDLRTLGFGIMSSVPKDWFPTGRTTWSVHANHE

SEQ ID NO: 8653 - protein, 337 aa, unidentified; identical to SEQ ID NO: 8339

SEQ ID NO: 8654 - protein, 522 aa, unidentified; identical to SEQ ID NO: 8638

SEQ ID NO: 8655 - protein, 420 aa, unidentified; identical to SEQ ID NO: 8396

SEQ ID NO: 8656 - protein, 337 aa, unidentified; identical to SEQ ID NO: 8339

SEQ ID NO: 8657 - protein, 280 aa, unidentified
SITDDFTLTSPYLGHCPYCLHATPCFSPIKIENVWDESDDGTIRIQVSAQLGYNQAGTADPTKFRYMSYEQDHDIKEASMDKIAISTSGPCSRLGHKGYFLLARCPPGDSVTVSITSGASATSCTVEKKIRRKFVGREEYLLPPVHGKLIKCHVYDHLKETTAGYITMHRPGPHAYATYVEESSGEVYIRPPSGKNVTYECKCGDYSTGTVNTRTKMPGCTKKKQCIAYKSDQTKWVFNSPDLIRHSDHAVQGKLHIPFKLTATACPVPLAHTPTVEKWF

SEQ ID NO: 8658 - protein, 337 aa, unidentified; identical to SEQ ID NO: 8339

SEQ ID NO: 8659 - protein, 420 aa, unidentified; identical to SEQ ID NO: 8396

SEQ ID NO: 8660 - protein, 337 aa, unidentified; identical to SEQ ID NO: 8339

SEQ ID NO: 8661 - protein, 243 aa, unidentified; identical to SEQ ID NO: 8643

SEQ ID NO: 8662 - protein, 647 aa, unidentified; identical to SEQ ID NO: 8451

SEQ ID NO: 8663 - protein, 251 aa, unidentified
KPGEFGVAKGSRTIWYMWLGSRFLEFEALGFLNEERWASRDISGGGVEGIGINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCSHHFHEL

SEQ ID NO: 8664 - protein, 68 aa, unidentified
CPIIHCKYSKAENCRLSMGVNSKSHYILRSGLLKYNLSLGGDIILQFIEIADNRLTIGSPSKIYNSLG

SEQ ID NO: 8665 - protein, 193 aa, unidentified
GYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCSHHF

SEQ ID NO: 8666 - protein, 70 aa, unidentified; identical to SEQ ID NO: 8269

SEQ ID NO: 8667 - protein, 323 aa, unidentified
GVAKGSRTIWYMWLGSRFLEFEALGFLNEERWASRDISGGGVEGIGINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCSHHFHELFLRDGRKLIVPCRDQHELVGRSMVSQGGSSGVAGTACLAKAYAQMWLMSYFHRRDLRTLGFGIMSSVPKDWFPTGRT

SEQ ID NO: 8668 - protein, 197 aa, unidentified
GCAKGSRTIWYMWLGSRFLEFESFGFLNEEHWASRELSGGGVESIPLFYLGYHLREMAKKPGKLYADDTAGWDTRITEADLDDECILCDYMEDEHKQLALSLFELCYKNKVALCPRPGRHGGTVMDVIFRRDQRGSGQVVTYALNTLTNIKVQLIRLAESEGVLDEDFNDHGIETWLNHYGEERLSRLLISGDDCLV

SEQ ID NO: 8669 - protein, 89 aa, unidentified
  VARIANT 81: note = Any amino acid
CYNGSVVLPVKLKTSIEPINSHSLICHSSLSTYNLDQINPILLDSIDPGEELNTVRGYLCSQIVTELTCFENFFGIESQTXNRTLMKPK

SEQ ID NO: 8670 - protein, 149 aa, unidentified
GVAKGSRTIWYMWLGSRFLEFEALGFLNEERWASRDISGGGVEGIGINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTN

SEQ ID NO: 8671 - protein, 73 aa, unidentified
KSPHCDIHTWDCIVVKTYVSWDEDHDTHKYLRNTTVWESPDIGRVGLYDACKKEFCGVEGIRLNNGEWWFLER

SEQ ID NO: 8672 - protein, 584 aa, unidentified
LVGYDCTSSVANITTISLFSVLPCELDQKPQSEYLSVIQVVQQRSVSRVHTFSCLVIRSSVIHHCGMHHHTSVGPMSIGEIMHTSNTQCADLHHFGKLAVGSGTLLTGFKVNETVQISITEHGYSDSEFKCRGTSFSHNGIAYHDAVMKSSYTVTLREEWASLDLDTGDLKMSTGYMHPFKTGQSFDASAGDVFWSTQDNQDCTPTSYLVLHEGAGIIYQGHRDTKTLVVNSSTHAMAVGILGPTLVCHQPALRTEHPKIFIVMKHPGSPSFFFKKSIVDPANVDMFLYINSKLVYLERHMGYQMSLVYEHFHKRTCNIKHQLLRHLIAIAVMNPEEFAWLYSKRPGVTAILRGELIYLMECQAVPVTIRKPSGRCYNELPVTFNNTPMFIKPRSRILVHYGSEIDCSPIVPAGFMIEGRWWALRPDSTQLPAPTTLSAEPEEGKWSYTSPHDLFKSGIYTLEELLAFQKRLLFSFEKPAISHTLSSAAARQPADLSGIDGAGLFHPGQLEEIQKNFMSKIWGWYWNVSVVLGGLVGIYMVFQLIKSVINSIITCTCLYRAYGCGVEILTCCFSSCAKYLLLKR

SEQ ID NO: 8673 - protein, 217 aa, unidentified
HWASRELSGGGVESIPLFYLGYHLREMAKKPGKLYADDTAGWDTRITEADLDDECILCDYMEDEHKQLALSLFELCYKNKVALCPRPGRHGGTVMDVIFRRDQRGSGQVVTYALNTLTNIKVQLIRLAESEGVLDEDFNDHGIETWLNHYGEERLSRLLISGDDCLVNAFDERFGKALTWLNTMEKIRKDIDLCAPSNGYENFEKVEFCSNHFHELM

SEQ ID NO: 8674 - protein, 584 aa, unidentified; identical to SEQ ID NO: 8672

SEQ ID NO: 8675 - protein, 250 aa, unidentified
GVAKGSRTIWYMWLGSRFLEFEALGFLNEERWASRDISGGGVEGIGINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCSHHFHELFLRD

SEQ ID NO: 8676 - protein, 66 aa, unidentified
LSKTQDYINTQIMPALSNLSCEIVGLKIGIQLSQYLTEVTAVFGNQITNPALQPLSMQALYQLCGG

SEQ ID NO: 8677 - protein, 581 aa, unidentified
LVGYDCTSSVANITTISLFSVLPCELDQKPQSEYLSVIQVVQQRSVSRVHTFSCLVIRSSVIHHCGMHHHTSVGPMSIGEIMHTSNTQCADLHHFGKLAVGSGTLLTGFKVNETVQISITEHGYSDSEFKCRGTSFSHNGIAYHDAVMKSSYTVTLREEWASLDLDTGDLKMSTGYMHPFKTGQSFDASAGDVFWSTQDNQDCTPTSYLVLHEGAGIIYQGHRDTKTLVVNSSTHAMAVGILGPTLVCHQPALRTEHPKIFIVMKHPGSPSFFFKKSIVDPANVDMFLYINSKLVYLERHMGYQMSLVYEHFHKRTCNIKHQLLRHLIAIAVMNPEEFAWLYSKRPGVTAILRGELIYLMECQAVPVTIRKPSGRCYNELPVTFNNTPMFIKPRSRILVHYGSEIDCSPIVPAGFMIEGRWWALRPDSTQLPAPTTLSAEPEEGKWSYTSPHDLFKSGIYTLEELLAFQKRLLFSFEKPAISHTLSSAAARQPADLSGIDGAGLFHPGQLEEIQKNFMSKIWGWYWNVSVVLGGLVGIYMVFQLIKSVINSIITCTCLYRAYGCGVEILTCCFSSCAKYLL

SEQ ID NO: 8678 - protein, 648 aa, unidentified
MRLVWMFLGIVATAFINECNALVAYDCNVGDLSMTSISLITTPECLTTTPNITTEKVNVAVTQGSSISNGRFISCLFEATSVISRCGATIDTRFESGLFTDIIALSSSECKGAHETGEVKIRYISTEVLVSLNAKGSFSFESHGYIRQGSCTAGTPYVRNGINYDKPVITTNIQHSLAKGEISIDFEKNLVTFPNGDTCKYTDGSCYTANYGNSFWEVKSPKCSEGNKILVYSGIGEIIKDLDNKESYIQVNHDGYDFQILLTTKKTYVCGYSSYRTEHPNLYVTIVDSSSPEFPIKSRGNIKELSLMNYLNSKLVYAMRHTKREVDRLFSVFSKDRCETRNKISRNMMSIAMLSPMEFAFTYGGSGHTAIARGEVIYLAKCSPTSVIPDVNRTGCYNEIPVINDNKMQFMSPRSRILVNIGTMIDCLPDMPPLYLLGEDWYQISSRGLIRHSKPATMQQDDVNYEFSVLSGLGNGGLYNDETIALYQEALVSGITSEIVKTRVADSIGGRSDLPTGYSVIKAMSDGDYHIIESKIGGFWTRFKSNAINSGSWFGFILLLFAVWKMLIYSVSCFVNFVGIKEEVGLLLAIPICFFESISNMILHGKIKTRKQGKSNENRSDFVELGEIEKESGLPILMGRNGKEIEQL

SEQ ID NO: 8679 - protein, 590 aa, unidentified
GLVGYDCTSSVANITTISLFSVLPCELDQKPQSEYLSVIQVVQQRSVSRVHTFSCLVIRSSVIHHCGMHHHTSVGPMSIGEIMHTSNTQCADLHHFGKLAVGSGTLLTGFKVNETVQISITEHGYSDSEFKCRGTSFSHNGIAYHDAVMKSSYTVTLREEWASLDLDTGDLKMSTGYMHPFKTGQSFDASAGDVFWSTQDNQDCTPTSYLVLHEGAGIIYQGHRDTKTLVVNSSTHAMAVGILGPTLVCHQPALRTEHPKIFIVMKHPGSPSFFFKKSIVDPANVDMFLYINSKLVYLERHMGYQMSLVYEHFHKRTCNIKHQLLRHLIAIAVMNPEEFAWLYSKRPGVTAILRGELIYLMECQAVPVTIRKPSGRCYNELPVTFNNTPMFIKPRSRILVHYGSEIDCSPIVPAGFMIEGRWWALRPDSTQLPAPTTLSAEPEEGKWSYTSPHDLFKSGIYTLEELLAFQKRLLFSFEKPAISHTLSSAAARQPADLSGIDGAGLFHPGQLEEIQKNFMSKIWGWYWNVSVVLGGLVGIYMVFQLIKSVINSIITCTCLYRAYGCGVEILTCCFSSCAKYLLLKRHTDPD

SEQ ID NO: 8680 - protein, 337 aa, unidentified; identical to SEQ ID NO: 8339

SEQ ID NO: 8681 - protein, 319 aa, unidentified
KGSRTIWYMWLGSRFLEFESFGFLNEEHWASRELSGGGVEGIPLNYLGYHLREMAQKPGVLYADDTAGWDTRITMADLEDEGILLDMMSGEHKKLASALFSKAYKVKVALCPRPGPKGGTLMDVISRTDQRGSGQVVTYALNTLTNIKVQLIRMAEAEGVLGATFEDFGIDRWLQEHGEDRVERMLVSGDDCVVNAIDERFGSSLNWLNAMEKVRKDIDLWKPSPSFRNWERVEFCSNHFHEMTMKDGRVIVAPCRGQTELIARGTVNQGGCVGVESTGCLAKAYAQMWLLLYFHRRDLRTLALAVMSAVPSNWIPTGR

SEQ ID NO: 8682 - protein, 319 aa, unidentified; identical to SEQ ID NO: 8681

SEQ ID NO: 8683 - protein, 68 aa, unidentified
TSYPISSELTRCLRGDTSSCPRTPVVNSRAPTFALSGGHIYANCAKAACRCEKPPMAIVQPATSTLTF

SEQ ID NO: 8684 - protein, 303 aa, unidentified
KGSRTIWYMWLGSRFLEFEALGFLNEERWASRDISGGGVEGIGINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCSHHFHELFLRDGRKLIVPCRDQHELVGRSMVSQGGSSGVAGTACLAKAYAQMWLMSYFHRRDLRTLG

SEQ ID NO: 8685 - protein, 643 aa, unidentified
MRNFNKIFFVTSLQLSILVLLNINYGNSLSNHSLVIKSSSDCLPYPQPDLTWRIFKFDFHSPLFRAIPAKPVCRKPSDIQREQKTAIISLYSPRFSEFTRLAYRIDKVRLTSRCKKGFFGANEKDSPSRKRLILEDNDIKDMSNFCKNSTCHASSSNLILGESILYPSAEEYDCTWMQTNEKITDRFLITAISFQFNSTGSLINPQLGSECNVFNSSFCVHRNKAYMLSFKTVTIDPCSVDLKLIAPGIVSWTDNRMEVDEKVYVTIPDHKLTFWFRQDYYSLPIRCTKYETNIRESSDGYLIGISSESKSNMDYRVDTLNLSSPQSLSLTLLRENLPRRATRDSTPSSFYDRSQRSYSRAELQFGLMQLHTEIQNMKRDLVYEQCKVRSQMWDIAFGSLLTNPNLMTQYLFPLEITKGVLINNKLQVSFGQRVSDICIPRKFDFIGFYLIVHLHGQPFWLRSSSGELLNTAPQFNKVPKINSFVIPTFPNGYYDIIDGSYISDDLPPLFEQGSNMSYLFDTSEMYSIQETLVWNTNFQQYETSIINSLDSITQDSLDPETTFEEYIINPISNGWHSLSSEVKSFFQWTGSVSILIILGFILYALGGILIPLIKMKKKESYHKAKINLKEKKLQTEQYQLKPF

SEQ ID NO: 8686 - protein, 650 aa, unidentified
MNRHSFMAPSKRTTLVLPFVVGILSIFIQPASSRPMTTGSEDMANSRGKTDCFALPESAEDWDIKVYDMSMSVDHPIPSRPQCKKPSEPLRTQIPAIISVFSPDFSEYSKVAYKFDKILIVTSCKGALLGSDDRMIIQKRKLLLTADDENTISKACGPVGCQLYLKSINPGESKIWPEPEEYSCKLFSTTKVESIRFIISSISMQINSDGSVVNPGVGSACRVTGRNHCIHQRKQFGLAFHNITINECAAKLKLIAPGVLSLPPSNLSDIHDEDSYVTLPEQMLSFWFRGRVSETKVRCNISGVPVRESADGYLIGISSVNNATRFPKSGELDKGMLTALEQEPFRSLIHQTPKARKVRDTHLDKLQRSYSRAELQYGLDQIWSELKFLRKDINYEFCKVKAQLWDNAFIHLWDNPDIFANYLYPLEKVKGIFHNNMLKIIHGKRLSNACIPRPPVIEGVYMKLMIKGQPHWLRASTGELLSTNPKESKAMAVASFVIPTLPQEGYDIIQDLVVNDHAGTYLHPMSNQSLYFSRDEMHTVQELSWTVTLQESEDKRIQDLSSRISSASVSGSFDEYVATPLKETWHSFSNSSKDLVHWTLLGIGALVFLYLISHIVIPLYGIISRASLKRKSNALKEEKIKLNKVDLKAF

SEQ ID NO: 8687 - protein, 293 aa, unidentified; identical to SEQ ID NO: 8158

SEQ ID NO: 8688 - protein, 85 aa, unidentified
GGFGSIFRVRNGTLEKGSTVYMRIDVDGPVIPELEGFDPRLNRSRVFWDDWELDGAIYQGFNGIYKGQDQMIHIPLNMIESGLVD

SEQ ID NO: 8689 - protein, 132 aa, unidentified
ADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVV

SEQ ID NO: 8690 - protein, 501 aa, unidentified; identical to SEQ ID NO: 8222

SEQ ID NO: 8691 - protein, 501 aa, unidentified; identical to SEQ ID NO: 8222

SEQ ID NO: 8692 - protein, 501 aa, unidentified; identical to SEQ ID NO: 8222

SEQ ID NO: 8693 - protein, 501 aa, unidentified; identical to SEQ ID NO: 8222

SEQ ID NO: 8694 - protein, 285 aa, unidentified; identical to SEQ ID NO: 8156

SEQ ID NO: 8695 - protein, 575 aa, unidentified; identical to SEQ ID NO: 8301
  VARIANT 178: note = Any amino acid
  VARIANT 179: note = Any amino acid
  VARIANT 180: note = Any amino acid
  VARIANT 181: note = Any amino acid
  VARIANT 182: note = Any amino acid
  VARIANT 183: note = Any amino acid
  VARIANT 184: note = Any amino acid
  VARIANT 185: note = Any amino acid
  VARIANT 186: note = Any amino acid
  VARIANT 187: note = Any amino acid
  VARIANT 188: note = Any amino acid
  VARIANT 189: note = Any amino acid
  VARIANT 190: note = Any amino acid
  VARIANT 509: note = Any amino acid
  VARIANT 510: note = Any amino acid
  VARIANT 511: note = Any amino acid
  VARIANT 512: note = Any amino acid

SEQ ID NO: 8696 - protein, 572 aa, unidentified; identical to SEQ ID NO: 8208

SEQ ID NO: 8697 - protein, 310 aa, unidentified
KGSRTIWYMWLGSRFLEFEALGFLNEERWASRDISGGGVEGIGINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCSHHFHELFLRDGRKLIVPCRDQHELVGRSMVSQGGSSGVAGTACLAKAYAQMWLMSYFHRRDLRTLGFGIMSSV

SEQ ID NO: 8698 - protein, 578 aa, unidentified
MCRFVVALSLAFSASEALVGYDCRTPGLSRPYLTTSPHECSELGHPLTRSTPEAGFVAQIPVKGTTTGKMCMVQETSRRFYCSYERNLQHRLDATMFSGYTPSTVSITDCRIWWAKGSAKGPWGERRIGNGETVIAIKDDLMTDDGWCKNWKETIEVKGWRITKAEVQVTSVYDESGLAQNYLSQEQDLILMAGPGQGTTAAGATIFWDTHDLVPCKLEIIREGEFNISTTASGTKWAVASTAGSALRIGAPVTVCGQHLYSTSEPFTFYGNLRGENSESYSAAKVGRISTALNSRVNYALLALLSGDHSSQRSSVESLCRLEAEIRRIHLTDAGVTPAQLAYRTFGSPGKALHRAGEGFRLASCESIDIKIAPQPICYDLIPVKRTNSSVLEFLDPTVMSLHSTAKKIECNDPSLPIISFGGASHELSPDLKLIPSPSHLPSSVRIANSTADVPLLRLYKPHVLMNTDLRVTMVEAAKQRSDFLANSWERVAQITQIGREASPGDSLLTTFRNGVLGHIGWTSAWLIILTISQVLMWWRARQTIRTPVYTHVSPSAPSPRSEFELLAEISRTRSPHE

SEQ ID NO: 8699 - protein, 579 aa, unidentified
VSGVQLFHDPEEWEKEIIGGWWLNGLRKHNWNQQGFFLRQLAKTRGIVSRRTRRSTSQSSGPILPLCPRLSEFKNTRVDDLDCNVILQNVSGLLNRRVKLKVVKREVVRVSEPWCACKYMESVRGCKKEFFLWDQKWGYDREVTGSLEECRVACSLLKTKITDGLPHVYQSKPIKYPVCWWMKGTEERTEYIVAVPIPAVLDKMRQSVSSSYVQSGICFINGPPCKKSNGLGSVVPLSTEHLSPPITEDVICMQPKLVPSGWIYCKVPTTGEVHIASKECGFHAFNKTYVETLNGVYIEETVPSVCERSSPSGRLPSMVDFPRPEGITNDLYQQFVSCNLHKAVIGHAIQLGTRIHSSLFDPFISPLGRVEEETTVIINGLKSLIKATCIGKRVTGLVHKGGDTWEVTGEEGPIGCIMAKLQIMMEGGCIRERGPPTVPVIMKSFLVITGPNGSSYEAVPTSVPMLEFLHGISNISVQLGIIDSILNRPTIVDYLPEISGENIITSGNSTGYLADLRINLLNLLGLSWVRPVGITILILISLWLCWGLIKKIRVWRFHYLLKQGEIVHYHKRHHHHAIH

SEQ ID NO: 8700 - protein, 491 aa, unidentified
VLFLSSLLLISTISPSHGINQPALRRIGAIVSSVKQLKFYSKTKPNYIIVKLLPTINLSKSNCNLTSINRYKESVIEIIKPLADNIDNLNQKLLPKNRRKRMAGVAIGLAALGVAAAAQATAAVALVEARKNTQMIQSLADSIQDTNAAVQAVNIGLQNSAVAIQAIQNQINNVINPALDRLNCEVLDAQIASILNLYLIKSVTIFQNQLTNPALQQLSIQMLSIVMQDTAKILGNFTIGDKFDQHDLLGSGLITGQVVGVNLTNLQLIIAAFIPSIAPLPQAYIIDLISITISVNDTEAVIQIPERIMEHGSSIYQFGGKQCVYGQFSAYCPFSDAVLMTQDLQLCMKGNIEHCIFSSVLGSFPNRFASVDGVFYANCKYMSCACSDPLQVIHQDDSVNLMVIDSSVCRSLTLGHVTFPIIAFSNVSYQMKTNISIEQMIVTSPLDLSTELKQINNSVNIANTFLDSSNRALKTSIFGTSSQIILIVLLI

SEQ ID NO: 8701 - protein, 318 aa, unidentified
KGSRTIWYMWLGSRFLEFESFGFLNEEHWASRELSGGGVEGIPLNYLGYHLREMAQKPGVLYADDTAGWDTRITMADLEDEGILLDMMSGEHKKLASALFSKAYKVKVALCPRPGPKGGTLMDVISRTDQRGSGQVVTYALNTLTNIKVQLIRMAEAEGVLGATFEDFGIDRWLQEHGEDRVERMLVSGDDCVVNAIDERFGSSLNWLNAMEKVRKDIDLWKPSPSFRNWERVEFCSNHFHEMTMKDGRVIVAPCRGQTELIARGTVNQGGCVGVESTGCLAKAYAQMWLLLYFHRRDLRTLALAVMSAVPSNWIPTG

SEQ ID NO: 8702 - protein, 33 aa, unidentified
WTFVAIIVCLVVGICSVKKLLPCIRKRRQRPER

SEQ ID NO: 8703 - protein, 109 aa, unidentified
RTRVVNTHVPKFALSGGVVFANCAPIVCKCQDPMANINQEPKVTNVMVSSDTCKEVYVDGIYITLGKKTLPRAMYAEDVALGGPISVDPIDLGNDVSAIQDAINKSKEH

SEQ ID NO: 8704 - protein, 586 aa, unidentified
SAIIGFDCTDPSSNVTAVSLTQIGDCVVRNRNVTTTTTNIRVYQSLDFTMTTVYSCLIEMSHIISRCGKSIDQFHSGGFYSEIPSITRATCLDMIDTGKINLHGNSMEGIEVGVPYSVALMTYGTIDQDGSCTTPGDLIVNGRVFTRAIRNTNIKILVTKYQANVDIDQSELKLSTGIVCPFLKRECFSAQTGYNYWNSFLENIVCEGTRPLVQLYEGPATKAIESINSHPIQTYMFKRDKSDFAIGANNPGQFCGYNDIIQTDHPNLYIVEEKNWNLVKLKTRKLMTTDIDITAYMNSKMLYIVNHVTNQVNNLYDAYLKDRCKTEESVLRQTLTLAYMSPNDFAYDFMKGPGYTATVSGEVIYIIKCQAKSVNYRPVSETCYKELPVLIDNKPGFVMPKTHLITMIGTEIPCNPLLPPVFLLGEYWYSPSHQLIRSTPPLVLKPSEPHVWQFEQISNLISSGIYSAEDLHLYRKAFLAPDGEKAFIGTFAKKTIRWNGDDYTGNVVNSFNEHDIDLLNERLGNWFHNMYRKLGNFGSFMVSIFIIGRFLLWIINLFLNCVKLRMEGRPMTDGLFVWWDRMLDFM

SEQ ID NO: 8705 - protein, 179 aa, unidentified
YLLQLTTTFQPQIQNPALQPLSIQALHRIMQGTSIVLSNLTDSSKYGLNDALSAGLITGQIVSVDLRLMQITIAANVPTLSRLENAIAHDIMRITTNVNNTEVIVQLPETIMEHAGRLYQFNKDHCLSSTQRFFCPYSDAKLLTSKISSCLSGIRGDCIFSPVVGNFATRFISVKGVII

SEQ ID NO: 8706 - protein, 285 aa, unidentified; identical to SEQ ID NO: 8156

SEQ ID NO: 8707 - protein, 285 aa, unidentified; identical to SEQ ID NO: 8156

SEQ ID NO: 8708 - protein, 496 aa, unidentified
SRCTHLENRDFVTGTQGTTRVTLVLELGGCVTITAEGKPSMDVWLDAIYQENPAKTREYCLHAKLSETKVAARCPTMGPAVLAEEHQIGTVCKRDQSDRGWGNHCGLFGKGSIVACVKAACEAKKKATGYVYDANKIVYTVKVEPHTGDYVAANETHKGRKTATFTVSSEKTILTLGEYGDVSLLCRVASGVDLAQTIVLELDKTAEHLPTAWQVHRDWFNDLALPWKHDGGPRWNNAERLVEFGAPHAVKMDVYNLGDQTGVLLKALAGVPVAHIEGNKYHLKSGHVTCEVGLEKLKMKGLTYTMCDKSKFAWKRVPTDSGHDTVVMEVTFSGSKPCRIPVRAVAHGSPEVNVAMLITPNPTIENDGGGFIEMQLPPGDNIIYVGELSHQWFQKGSSIGRVFQTTRKGIERLTVIGEHAWDFGSAGGFLSSIGKAVHTVLGGAFNSIFGGVGFLPKLLMGVALAWLGLNTRNPTMSMSFLLAGGLVLAMTLGVGA

SEQ ID NO: 8709 - protein, 496 aa, unidentified; identical to SEQ ID NO: 8708

SEQ ID NO: 8710 - protein, 495 aa, unidentified
RCTHLENRDFVTGTQGTTRVTLVLELGGCVTITAEGKPSMDVWLDAIYQENPAKTREYCLHAKLSETKVAARCPTMGPAVLAEEHQIGTVCKRDQSDRGWGNHCGLFGKGSIVACVKAACEAKKKATGYVYDANKIVYTVKVEPHTGDYVAANETHKGRKTATFTVSSEKTILTLGEYGDVSLLCRVASGVDLAQTIVLELDKTAEHLPTAWQVHRDWFNDLALPWKHDGGPRWNNAERLVEFGAPHAVKMDVYNLGDQTGVLLKALAGVPVAHIEGNKYHLKSGHVTCEVGLEKLKMKGLTYTMCDKSKFAWKRVPTDSGHDTVVMEVTFSGSKPCRIPVRAVAHGSPEVNVAMLITPNPTIENDGGGFIEMQLPPGDNIIYVGELSHQWFQKGSSIGRVFQTTRKGIERLTVIGEHAWDFGSAGGFLSSIGKAVHTVLGGAFNSIFGGVGFLPKLLMGVALAWLGLNTRNPTMSMSFLLAGGLVLAMTLGVGA

SEQ ID NO: 8711 - protein, 496 aa, unidentified; identical to SEQ ID NO: 8708

SEQ ID NO: 8712 - protein, 495 aa, unidentified; identical to SEQ ID NO: 8710

SEQ ID NO: 8713 - protein, 133 aa, unidentified
QRGSGQVVTYALNTLTNIKVQLIRLAESEGVLDEDFNDHGIETWLNHYGEERLSRLLISGDDCLVNAFDERFGKALTWLNTMEKIRKDIDLCAPSNGYENFEKVEFCSNHFHELMLKDGRQLVVPCRSQNELV

SEQ ID NO: 8714 - protein, 496 aa, unidentified; identical to SEQ ID NO: 8708

SEQ ID NO: 8715 - protein, 496 aa, unidentified; identical to SEQ ID NO: 8708

SEQ ID NO: 8716 - protein, 496 aa, unidentified; identical to SEQ ID NO: 8708

SEQ ID NO: 8717 - protein, 496 aa, unidentified; identical to SEQ ID NO: 8708

SEQ ID NO: 8718 - protein, 496 aa, unidentified; identical to SEQ ID NO: 8708

SEQ ID NO: 8719 - protein, 496 aa, unidentified; identical to SEQ ID NO: 8708

SEQ ID NO: 8720 - protein, 297 aa, unidentified
SRDISGGGVEGIGINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCSHHFHELFLRDGRKLIVPCRDQHELVGRSMVSQGGSSGVAGTACLAKAYAQMWLMSYFHRRDLRTLGFGIMSSVPKDWFPTGRTTWSVHAN

SEQ ID NO: 8721 - protein, 496 aa, unidentified; identical to SEQ ID NO: 8708

SEQ ID NO: 8722 - protein, 335 aa, unidentified
KPGEFGVAKGSRTIWYMWLGSRFLEFEALGFLNEERWASRDISGGGVEGIGINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCSHHFHELFLRDGRKLIVPCRDQHELVGRSMVSQGGSSGVAGTACLAKAYAQMWLMSYFHRRDLRTLGFGIMSSVPKDWFPTGRTTWSVHAN

SEQ ID NO: 8723 - protein, 496 aa, unidentified; identical to SEQ ID NO: 8708

SEQ ID NO: 8724 - protein, 496 aa, unidentified; identical to SEQ ID NO: 8708

SEQ ID NO: 8725 - protein, 496 aa, unidentified; identical to SEQ ID NO: 8708

SEQ ID NO: 8726 - protein, 565 aa, unidentified; identical to SEQ ID NO: 8390

SEQ ID NO: 8727 - protein, 644 aa, unidentified
MRTLWLLSLISSGLCQPMGGLDGISRSITALELGPDSAEDNELSTSLPAPKVSSPDNSINPITGEVHAPGIKGTLYSDDHGHWLPVFPRPPLPCAPEQLDDSTPFPVVVTIWGPSTRDHTRQVTLYQRWFTRSACTVYFWGSKWERVLEDTIAPMDINSRPETQFPSNQREIWTDGTRPEVSCRWTGEVISEGFYYKQLKTKAHLGPTGGLTFPHGFPHCRSDNHAPCMSEDKTTLIIFENPAPPPKLCSSLEAKLVAHGTRSLGPSKDLIQLPAHHLEFSLVHVTSFFRCNSSNANELILLPSGYIISVHANLSHASLFLRNKMDSFWSNLNETHDPHTALSESGWLIVHGIPLRPDYSEAEMLRGLELLSDQSKQIFSTMRYLNCRRHEEAWALATAISPLNPTPLAQLASRSPQVLGAIHQGVLFAILPQPVLNISLTLPLQGSGSWAKIQFVLPSGEGGEGWMESFTGRIRPVRPAAHEDTSLTNFWVPLHDGRFWNPMSHLHLLNVSSADETSPWKSLDLSSISLGAIYSPSHLLPTPAYVGAAASVHFILAHMTGHGVWRTQGADASASVGELSGFLSSAFGWWDVIKWTLVAIVVIILLALGAVIVSKIIRHVSLSRPSPPTSPGLSLDQLKELMRQ

SEQ ID NO: 8728 - protein, 716 aa, unidentified
  VARIANT 146: note = Any amino acid
  VARIANT 147: note = Any amino acid
  VARIANT 148: note = Any amino acid
  VARIANT 149: note = Any amino acid
  VARIANT 150: note = Any amino acid
  VARIANT 151: note = Any amino acid
  VARIANT 152: note = Any amino acid
  VARIANT 153: note = Any amino acid
  VARIANT 154: note = Any amino acid
  VARIANT 155: note = Any amino acid
  VARIANT 156: note = Any amino acid
  VARIANT 157: note = Any amino acid
MTSLKNFSILLLVAVPLVLSKKEGWVGYLKDPLTPGEIRLEQPPLGAHQKLSTAEMVTEGLVNSTHFLVQFPSVGRWFYLPRVLAPPPLPPSVTVVHSHALVLDSRDKVSSVRGPNSLFLPSTEALRFFPFSPQLTSSPQLIPPIXXXXXXXXXXXXGVLRVWGPPAHSSTLEGTLVTCKTKSENCTKYFFGAEQISLDWDKPTSCNQFHKSLISQHKSKLKTEQTLTIPLVQAPCLWTGTQTKSEDYLFSQRVKVILSADGYVSYPPGFSLCRAFNDSACSSSFQVLMLDHLIDDPSSCKSLEVKLISKSFVQVDKTKNGTLHLIGIKDPQHQLGFSLEGAKKVCTKEGHQYTHQLLLTKSSYLISLFLLPDNSTTLNISNTPNVVRDLPEDLTYWKDLKSKNQPSPSSHHSISMAIHQWKLHHKIPLRTHYSESEMIYGLSELSEKTSRAMYALFSELCRMSSQIWKLAFQSWTLNPTLMAQVLTKDPTVIGENRAGRLIIHHSLPSGPILIPKDTTCRGDWMFVQMFNVTDQTYAPVWLQKVSGFIVPFTPKIPISVHPENFLIPFNQTHFFDILQKDFLMSLPQNTFKWNHTLPFFSSDLTLERSEITSLEYVSRILDEISLPPTSNDLPQKKDRDQGVDISRHWKNFADWISDFFLSWRVVVFFIIVFILYALFRVGKRALTCCTGKEVPPPPASPLHGPWFSTGRQASPV

SEQ ID NO: 8729 - protein, 582 aa, unidentified
MEPSKLFTMSDNATFAPGPVINAADKKTFRTCFRILVLSVQAVTLILVIVTLGELVRMINDQGLSNQLSSIADKIRESATMIASAVGVMNQVIHGVTVSLPLQIEGNQNQLLSTLATICTGKKQVSNCSTNIPLVNDLRFINGINKFIIEDYATHDFSIGHPLNMPSFIPTATSPNGCTRIPSFSLGKTHWCYTHNVINANCKDHTSSNQYISMGILVQTASGYPMFKTLKIQYLSDGLNRKSCSIATVPDGCAMYCYVSTQLETDDYAGSSPPTQKLTLLFYNDTVTERTISPTGLEGNWATLVPGVGSGIYFENKLIFPAYGGVLPNSSLGVKSAREFFRPVNPYNPCSGPQQDLDQRALRSYFPSYFSNRRVQSAFLVCAWNQILVTNCELVVPSNNQTLMGAEGRVLLINNRLLYYQRSTSWWPYELLYEISFTFTNSGQSSVNMSWIPIYSFTRPGSGNCSGENVCPTACVSGVYLDPWPLTPYSHQSGINRNFYFTGALLNSSTTRVNPTLYVSALNNLKVLAPYGNQGLFASYTTTTCFQDTGDASVYCVYIMELASNIVGEFQILPVLTRLTIT

SEQ ID NO: 8730 - protein, 310 aa, unidentified; identical to SEQ ID NO: 8697

SEQ ID NO: 8731 - protein, 102 aa, unidentified
ILLVIFIMILTNLIQENNHNKLMLQEIRKEFAAIDTKIQRTSDDIGTSIQSGINTRLLTIQSHVQNYIPLSLTQQMSDLRKFINDLTNKREHQEVPIQRMTH

SEQ ID NO: 8732 - protein, 316 aa, unidentified
GVAKGSRTIWYMWLGSRFLEFESFGFLNEEHWASRELCGGGVEGIPLFYLGYHLEKMAEKAGILYADDTAGWDTRITMADLEDEYTLTELMEGEHKKLAETLFNFAYKNKVALCPRPGKNGGTVLDVISRTDQRGSGQVVTYALNTLTNIKVQLIRMAESEGVLDEEFHDNGMLKWLEKHGRDRLQRLMVSGDDCVVNAIDERFGKSLVWLNEMQKIRKDIDLWKPSAGHCNWEEVEFCSNHFHKLVMRDGRTLVVPCRHEVELVGRASVNQGGSTGISGTACLAKAYAQMWLLLYFHRRDLRILGMAICSAVPAN

SEQ ID NO: 8733 - protein, 569 aa, unidentified
MNRLTLLVCLFHIAYGLEAYDCHDQTPINRLTLPQPEQCQKQSTDLIDLPLPQVSLVQLPLFVRVNGLKFSKITLDRTYYCSMTRLMTPVVDYYGLMGFSGAQTSLQDLGLESISPPLLYDEAKRVSLSPEWTFTVDDQLIDQEGYCSQRSTRFNLHVQGLSMTPVVLNLHSSDNGIVDHVKFWDETITGPLSLGYGHSIDGDLFIWDAQNTTYCGLELLYSGVPSGYYSVNNESVMVFDDFSTGFRVTNYTHICGIPARLTSIPYLFVLTQEAASSLSLPSSFEVRPSISSLSMANSISISLVASLRGVRKILVEQICKIDTRLSSLILGDSSISPDLAAYLLTTKKGYSVVRHGGEILLTKCNLTSVVIRPTNTCYSMVPVNHVESNTSSFWNPLTSVLSSTAEPLHCSSPYIPSFEYRGTWYRLTPHLSVIPAPMEYNLGARRTLEIPSGVIHPSHGMSLYHFQDQQRLATLARTDPLAELPQDHNIPVVHRPHLRPLYKSYKEVMSRMEGHSLHFQYGFSLVTGVLIWLVMITIIVLFLAWKVRIVLLRENAFAPAVHVTLGDLN

SEQ ID NO: 8734 - protein, 469 aa, unidentified
  VARIANT 205: note = Any amino acid
  VARIANT 206: note = Any amino acid
  VARIANT 207: note = Any amino acid
  VARIANT 208: note = Any amino acid
  VARIANT 209: note = Any amino acid
MTKREILSCDKLREMISSTSVSGPLSSQGNDINMLSPLDQQILNELRGSESLPPSTILPVRRSRTVEDLTNIPTSQPIEQRLVFSSPIESTKRKITEDNSPMSSGTDQLISKLTELPLRPYTPLTELLPISDILDPQPAATSTTRSSPFKKRSTRASSVHTKISYVPTLPSEIQESETDTDIEVDDAHSLSVPMSRFLQASTPPXXXXXTSHNLNTYNLASAYLAQSDPIEPTGNYTVSSKMMAFLSGESKTVDSDMDLELKRWATDRWDQLINPPKGLKCEHFALCLKYISGNSNRHKAYHIAKGNFHMACATEQVWSDLPKLTKTTSNLKSALSTPHMTIELQSLITQHTQLLQDNNRLITTLQEYGGSLINQYQDHTNQLKNITQEVSNTLSSKISSLVSAIEKLSGLSDKEQGKLLKRKSLGTELLDSSLSSVGPSASATRSQSSRRGSTVSTYPYYYSNVTSLP

SEQ ID NO: 8735 - protein, 533 aa, unidentified
MGAFSSLCLLFILIGTSLSGTKTPVLLGLNHGLLLEPYGAYMSHYGFNYIPISFSIPTELPAGINPCVNKSMIELHHKSVLQFISNLVPNSTLDRSSGDRKKRWIPLISGILGSGIAIWNRVSIQSMEKNMDTINRNIQNIYNHVKTLTSTTNRIIDDNNRIHHLVSEIISAINKVSDDVQCVKSSYLSLSLWESSWTSLIVNLFVRASNAALTGKVTPDLLSASNLQVLLQEEATLHESLYTKDPTLVYELSSFVPTIITSSPPVIIGIMVLPKISLISSGHVYTVNSVPWLSGEHAYKIDRSGTVVISHAYDVWIPDPIECISHPGLLICPKKFFTERPDLCIKNILSQNKTDDCNILVKSRPLTPIALQLKTGVLLSAFDQGTASKIVQYKNKELRTSPLAKSDHPNYFFADSGHMLMVEDKIYQLTELSHPYDFSVQPIDLANSSIDISQHLVVPDWTEISHVKDPPNLLTTLSSHDLILYIIIVFFFSTFLVIYGKRTIKGYCMRKKNIRKRGEVSNFSNAHQMMSLH

SEQ ID NO: 8736 - protein, 52 aa, unidentified
YTHPSNCRKNSFVPIRPDQLRCPHEFEDTNKGLVSVPAQIIHLPLSVTSVSA

SEQ ID NO: 8737 - protein, 383 aa, unidentified
MSLTDVLSAPGVFSRTTRVVTGTASQTIDKGVNIVLPLLIPVEINPYTTTTICSTSLRLIMNPDIDSRYAVGGFFSFLFFNLDIQYETYRDTLRLAGCKILPIDVSADGIPETEDPVIRDAFSQPIGLEISVMSIAAVSSVLFPMIGKQPTEQGFGLWWASRCRAAEGKFNIPATSMVMLQPSKKHANAIYSQTMGHASLRKSLFMTLADYRKTHSDKMADAIDMTMILLKNTGLTHMVLIDKYLVTPYHPALFCEKAKPDLNALIQAYLFLKGVPDEQKNYLRFLRSEDELSVLNRMKFRNLTAIAYHLAIKKEPSLSNYNPALNESLKPEEKTLIDRLDQTFGKSVDVTHADIYRQRYGNNAFEEVQRVLNEYTPAAGARL

SEQ ID NO: 8738 - protein, 611 aa, unidentified
MRCKRLWLVVTIVSFLTGCHTQSWLDDPFGPVQHHSNPIWDCKTAGPGIVNPIPQRPNCAAIITSPLRRSDVVIQKWKVDLSSWTVAACECFTEIIHARCDNPLFGVPIKTHWVEFTTTSLEECINVCNDRSDKKMTQSGTVGVLTEDIKPEYKCPFLMGTSITTTKILSVSKLRLIVDHIELTVTGPVGFSRICKYTDEVCKTTKLGYVTWRKTLNLTSHCNLVPAYDPELCTIYGADNHLVQCPLSKSLYHLSDTSASMKTICMFKSTPAVVVKSLEGTWLSAYNQSITAILKLHSNTSRNLVRVDPNVEGLFAEVNSHLSWLAKEWLSRSREERIRVELGLCLDAQRLWDAAWNIRELVPQAAAAIWTGNQNAVATVFSGFILSWPCKQIYQYRFLMNPNCSENWPIEYATGISIETGFVEPVSFKITYQPGRMSCRVSPGFLLPINETHSLNLASRQFTPKPKSYFSIELSDADKSEIYSAPSLYTVSELGGTSRLEELVMLHHNHLRQAVKAVSGSYEIAIEEHIDQLAAVKSTYSLFGHWIGSTADSIVNSIAGIVSLCILIYITGLIVAMCVSRATWCRTVLMCWKSKSATGLGQSCNADTKFL

SEQ ID NO: 8739 - protein, 659 aa, unidentified
MFILKLLFNYILFVHYSYALIAFDCESKISERRTFSLVETNPCIPIVHNITTSIEKIQVVQPRVFDKLEYIQCMITISHQIFRCGKTIDTFQAGGIYSEVVEVSRSQCEDLHKLRTFNYFGVQIKLEKGNSVTKLSTETFGSIDSDGSCTPGNGQLHANNRVYSRAVRTSNIEITLIKSLGTIDIDEKKFILEDTTKCRYEDFECFSVNNGYSYWEEANDKIHCPESQEYTVLFEGACTKIIETKDGFSITSYLMNIDDYDFQITRRDKQIRLCGQLGWATEHPKLSIIEEQQNLGFNLKPDKTLFNKEVNLMTYFNSKLLYIMKHTKDQVDSLYQKISHDRCNSETRIVNSMMTLALISPLEFAYEYFQSPGYTATVRGEVIHVGKCQPVHVNYTSSIDKCYNELPVTYDGNLAFMLPRTRILSKIGTEVDCSGLINIMYKLTDSWYSVSRDLIHTHKPEIISITPNDIWEFKMISGLAESGIYSQRDLDQVQKILMNPVEKEILSSRILRTLDGASSLPTGYSLYNTFTPQDLERLTKNTVSTFFMVFYGKMTTIGNFFSFLLALFMILRFIKFILNSIINWTYLYRTVGLSWKLIFCWWENLVHHWVRDSKTQSTKQTDQELVHIEVPIEDNDNTPNTPPKNFLTSKYIKINPNIN

SEQ ID NO: 8740 - protein, 623 aa, unidentified
  VARIANT 575: note = Any amino acid
  VARIANT 576: note = Any amino acid
  VARIANT 577: note = Any amino acid
  VARIANT 578: note = Any amino acid
  VARIANT 579: note = Any amino acid
  VARIANT 580: note = Any amino acid
  VARIANT 581: note = Any amino acid
  VARIANT 582: note = Any amino acid
  VARIANT 583: note = Any amino acid
  VARIANT 584: note = Any amino acid
MPNRDMYGIKIVIILTLTAFSFKLVKGLLPGDPFGPVRARDYALWDCRSSGPGLSSPIPKRPNCTAISHRDKTRVEGQVTIWKIDTSLWKVEACECFSETVTATCVSPLFGLESKSTKREFSPANYTYCLQSCLDIDSGSLTQSEIHGVIVSGKDPEYDCPMWGTRSVIVTITSVMRLTLIVDHDSDVMTGAVNFARPCKYNETKCPTVKGGFVFWKQLMKPSDRCNLKATGLSEICSLHGDTELSIHCPLTKAIYHLGHHQIIPTVACSWVGNESKIDVYKTLEGVWISGRSKAGGNLVDWIKTHQQGDQSVVFTQSSPKTNGSHILGLTGPQLAWLEDSWVKKSSEERSYLELQLCREAQHSWDLAWNLRHIAPMAAASIWTKTPHTISTLFSGFVLSWPCKEVYQYRFLKNENCSENWPIEYSDGIAIHTGFLEPVSYRITQRRGRMSCRISPGFLFRINDSHVVNLATRDFSPVPESYFAVDPVPVFHSHVFYSPSLYSVEELGGQSQYETLVELHHDHLRQAIYALSNSHEISTDEKLDALAPIDKATSIIGHYLGSTMDKILNSITLVXXXXXXXXXXVYVAKCFCTCYFTPFNCIKYARRPKSSSNENIPLRRRYL

SEQ ID NO: 8741 - protein, 605 aa, unidentified
MAHTLHCKPTERSKTRQADTPSVINSKFLAALGLTLCCLPAFTYQLAEELDLSLLDNLPVQALRCNGASRFLPIPKKPSCYLDINKNTYKTIGQIELEILRQIPSHQRVSAWRCEMFEIIKVCKETFFGFQHQFEFTRKSKKTVPLNFLEIAALKSVKTIEDTFSFGTKRDFECHWMEENEVTYSKRVCYRNDHLLNVTGSNVHIEIPNTKGIPLHLGYLMTADGVEYVWNANINISCPLEHFQTELCTVRADLSPNVPSRDLSNLIIVCPNNHHIFHLNQEYRPVGPLEVCATNTSRIFYTSEGLMLRIFRKNMTEKAFWDLLPVTETMPSLALTLASSMLEFLQDNLQISIERIWDSIQNQICTIKENEWFLARSLLGVTPTESAKIFFNEREITASYLRGGLIVRNCIKVRVYLDSNPTRCGKFWPIKNSLDFLEIATNTISRGTTDDHCSLSEGHLIYINETHYLGLDNHKLYILDRPVLSSMSHLVMHPLQFAPSDLYSLHELQEDEFSRYSISKINKRLEALTTTLLNYQMDEIPGVINPRDPWTPISKFFVGIWHKITSPLPLFIITLAILLIVAKVIHLIFVWKFRSRYTRPGQWQY

SEQ ID NO: 8742 - protein, 571 aa, unidentified; identical to SEQ ID NO: 8536

SEQ ID NO: 8743 - protein, 154 aa, unidentified
GVEGIPLFYLGYHLEKMAEKAGILYADDTAGWDTRITMADLEDEYTLTELMEGEHKKLAETLFNFAYKNKVALCPRPGKNGGTVLDVISRTDQRGSGQVVTYALNTLTNIKVQLIRMAESEGVLDEEFHDNGMLKWLEKHGRDRLQRLMVSGDD

SEQ ID NO: 8744 - protein, 293 aa, unidentified; identical to SEQ ID NO: 8158

SEQ ID NO: 8745 - protein, 293 aa, unidentified; identical to SEQ ID NO: 8158

SEQ ID NO: 8746 - protein, 101 aa, unidentified
FCHIEHVDRGWDSGCFIFGKGEVVTCAAVTYSKPFYAWMVDSEQITWEVEVNFGGDSNRKKTAEISMDSEYEEFEDPKNTGSKIRLYCKTPRQEWDNYYMV

SEQ ID NO: 8747 - protein, 318 aa, unidentified; identical to SEQ ID NO: 8615

SEQ ID NO: 8748 - protein, 79 aa, unidentified
FISITVSSNQSEVMLQLPSRILEVGNNIYTFKGDQCTLTETTAYCLYSDAVPVNEKISDCMKGIQSSCIFTRIIGSFAN

SEQ ID NO: 8749 - protein, 188 aa, unidentified
KKPGKLYADDTAGWDTRITEADLDDECILCDYMEDEHKQLALSLFELCYKNKVALCPRPGRHGGTVMDVIFRRDQRGSGQVVTYALNTLTNIKVQLIRLAESEGVLDEDFNDHGIETWLNHYGEERLSRLLISGDDCLVNAFDERFGKALTWLNTMEKIRKDIDLCAPSNGYENFEKVEFCSNHFHEL

SEQ ID NO: 8750 - protein, 447 aa, unidentified
ALVGYDCNKKGMGHPYAIGSMSECRKFDKGAISSSAWAGTILQVPKQTQTPHKTCKLLLRSYSMYCTYYNNPTMLEKYSDDVDLTPYIMDEQDCIDAWDKRVFYYQGTQISVNPGGVTKILIGADIDENGFCRTSKGTSTVVKGHIELVWAEVMEVTDLRGQPKRRELDGEGLRWSLTRKSSTTVTGVTVLTNSPPTAMCSWQSIYQGAGELLEYPGSETYVTIPKLSSGFKLITVVTVCGLRVSVTDDPSIFLVNTTAVDVTPANDEFSGRYSSYFKSGLLGLQLILQSGMTTTTRDLLKNQCILEQMIQQNVVHQASKHPGLAAYTLTGVRGWTIILSGAGVILKQCTEVAVVLRPQDECYTDIPITINSTSSPLFLDPTTHIIKISSHTIECDDDSNPIFQVRNQYYRMTPKLVPVRGLPNLPSVLSDLNTTLLSPGTGLYPNE

SEQ ID NO: 8751 - protein, 447 aa, unidentified; identical to SEQ ID NO: 8750

SEQ ID NO: 8752 - protein, 552 aa, unidentified
MNRAMVCLTALLASIMVLGGVLSDLATLHHTVAPVAVCDPSRLINPHKKIDECHLLCNKDPKNYGKARIYLYKDVSGSEGPAAVRCEKVMLKQVFTETWTFSRFQGPLTRQKLPVTSEECEKVIQNLCPNLRCDINPPAELKPEYFYAADHEVRETHMKVRSVPSTLINQVGTLMIVFATESSYVEYQPGKVAAEDGTHMYYWDNTTTKASCPFEESISFGCDKWNLDGSVNYVCSHGRFAFESSGSIDVRNCPKARMSPEGIIYREEDTDMATLYTSQRIAMIPGNKFASDLETVRTLTAKGLAHLDADICSLECEIANLELRTSRHYSSLVRKGAGYVLVNPSGHAYDCSKVTQCSVIKPYTFCGSPPRIHIKCDGRDYYWSPEFSHIMTGDGCPSPMPEEQFKIHLGNHLYYLEDDMTIKVPANYTNSLRTRSYTLNKGSLIELEDLRELRASWKAYKTRGNLSYFLDSSTKISTHSLLNMRWIPDVGKFVDYVRNSFMTWERVCLISVIIVLSVYVSKPIIYYILNKKKVQVPRQVSYQRPEYQMEFI

SEQ ID NO: 8753 - protein, 525 aa, unidentified
MYSMGLFETYLYWMSVIIFIVTLSHLEHYRRYSYAFPKQDSSDSSGVDCRGIFKLQPPMPPKTMIKEQTAVGMLSWYDHTVQGYLYKRELYTNYQYYGTALDANSYPMKRWQTFLPDTSELEEWIRTKKCQVGRNLCGESDFWGSWSQECLKSPRDLLTTNPQWVNDEVRHECSGGEWIKFPYHTCLISWSCFIREIDLPVRVLEDGKIYSSFSNGTMFELTKHIYTMEKGAQLYIPTLPLKHQSEVILDCLGSENSGGLKCILRSGPKELIGGVYSGNSTYVANRHSNILVNLTSLNMTASERVIISDKSASLSDLYEVDSLVREVSLRSDLNDFELTKGLTELTGVVTRLIENLSQKDPLLLSKVLQGEELYRTVYTSGGLFTKCLIARPYKPVSEFCVPQGLTMQSGIPVPWDGKSVCLKPNAEVTPIVLLHEIHEIEGLEKGVSIEGASFQWSIYEFIELERLNMEESMNRVKKYSSALMSDVLENPLNTWCGSILSLTSVSFVSALLCSLLFLLLLKVIW

SEQ ID NO: 8754 - protein, 37 aa, unidentified; identical to SEQ ID NO: 8570

SEQ ID NO: 8755 - protein, 76 aa, unidentified
EKHSFKLVEHPLELLDTGEDDLHTLYKFYNRSNSTSVVPLVTRWFKGIGSSVSSFFTGTKNLIWWIVTLLISGLAT

SEQ ID NO: 8756 - protein, 44 aa, unidentified
GWKAGGTYTLGKNPKPECWWLMISDVSNLKTVCSPATLVLSKEE

SEQ ID NO: 8757 - protein, 587 aa, unidentified
MALSAKIIALSWLAAICTLVENGIGSPLQTQSVFLKEPGILIEPKSLVLHHDSVVHTTVMIRLDSVLPESRAELFSNCKQHITREELKKDFKERTAKILQMLPSMSYNQEDSICSLPGTDCVESVNSSDRKLRRPKRFVNIPVAATIFGVVSLGMGLYTYLSQKSIREHVENVEAHISNDEKVIISNSEYSSISSSMFAKNYARSKIFETSLQNTLCSVEKGHTEDYLNLAITEYVDFLTYNVQQAVNGHVTDFLVTRDLINGTLLNRTEFADSVYKSDIGLFYSASTSFLTHVNRKTKALYFLIVTPKSYTKDLTTIYSVSNFGWREDEYHVKYEIPTSFYQVTWENSTYSVETQKEDCLSRSGLLICHSRASTSSPKSKCLHQLLNKSSPVDCRIQREYAPHESCSVKYTLSGLFARNCNSITLVKEVRGILMEEHIPKAGIKSRFFPYTSFETAVIDERSYSSRDTIYQTEIRKVTPTSEVIIPELPSLYSQSELSDLMAFVQKKKKEESERMIHEKVSHMLVSHVVWLVVLMFIIGCCMVFIYMKVSTLTKANSVYTHMMREVATPESTQIRMRSRRGRNTDS

SEQ ID NO: 8758 - protein, 662 aa, unidentified
MHKGIPKSSKTQTHTQQDRPPQPSTELEETRTSRARHSTTSAQRSTHYDPRTSDRPVSYTMNRTRSRKQTSHRLKNIPVHGNHEATIQHIPESVSKGARSQIERRQPNAINSGSQCTWLVLWCLGMASLFLCSKAQIHWNNLSTIGIIGTDSVHYKIMTRPSHQYLVIKLMPNVSLIENCTKAELGEYEKLLNSVLEPINQALTLMTKNVKPLQSLGSGRRQRRFAGVVLAGVALGVATAAQITAGIALHQSNLNAQAIQSLRTSLEQSNKAIEEIREATQETVIAVQGVQDYVNNELVPAMQHMSCELVGQRLGLRLLRYYTELLSIFGPSLRDPISAEISIQALIYALGGEIHKILEKLGYSGSDMIAILESRGIKTKITHVDLPGKFIILSISYPTLSEVKGVIVHRLEAVSYNIGSQEWYTTVPRYIATNGYLISNFDESSCVFVSESAICSQNSLYPMSPLLQQCIRGDTSSCARTLVSGTMGNKFILSKGNIVANCASILCKCYSTSTIINQSPDKLLTFIASDTCPLVEIDGATIQVGGRQYPDMVYEGKVALGPAISLDRLDVGTNLGNALKKLDDAKVLIDSSNQILETVRRSSFNFGSLLSVPILSCTALALLLLIYCCKRRYQQTLKQHTKVDPAFKPDLTGTSKSYVRSL

SEQ ID NO: 8759 - protein, 576 aa, unidentified
MDRAVSQVALENDEREAKNTWRLIFRIAILFLTVVTLAISVASLLYSMGASTPSDLVGIPTRISRAEEKITSTLGSNQDVVDRIYKQVALESPLALLNTETTIMNAITSLSYQINGAANNSGWGAPIHDPDYIGGIGKELIVDDASDVTSFYPSAFQEHLNFIPAPTTGSGCTRIPSFDMSATHYCYTHNVILSGCRDHSHSYQYLALGVLRTSATGRVFFSTLRSINLDDTQNRKSCSVSATPLGCDMLCSKATETEEEDYNSAVPTRMVHGRLGFDGQYHEKDLDVTTLFGDWVANYPGVGGGSFIDSRVWFSVYGGLKPNSPSDTVQEGKYVIYKRYNDTCPDEQDYQIRMAKSSYKPGRFGGKRIQQAILSIKVSTSLGEDPVLTVPPNTVTLMGAEGRILTVGTSHFLYQRGSSYFSPALLYPMTVSNKTATLHSPYTFNAFTRPGSIPCQASARCPNSCVTGVYTDPYPLIFYRNHTLRGVFGTMLDGEQARLNPASAVFDSTSRSRITRVSSSSIKAAYTTSTCFKVVKTNKTYCLSIAEISNTLFGEFRIVPLLVEILKDDGVREARS

SEQ ID NO: 8760 - protein, 147 aa, unidentified
TQHYSELTNIFGDNIGSLQEKGIKLQGIASLYRTNITEIFTTSTVDKYDIYDLLFTESIKVRVIDVDLNDYSITLQVRLPLLTRLLNTQIYKVDSISYNIQNREWYIPLPSHIMTKGAFLGGADVKECIEAFSSYICPSDPGFVLNH

SEQ ID NO: 8761 - protein, 147 aa, unidentified; identical to SEQ ID NO: 8760

SEQ ID NO: 8762 - protein, 502 aa, unidentified
CIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 8763 - protein, 609 aa, unidentified
MSAQRERINAFYKDNPHNKNHRVILDRERLVIERPYILLGVLLVMFLSLIGLLAIAGIRLHRATVGTSEIQSRLNTNIELTESIDHQTKDVLTPLFKIIGDEVGIRIPQKFSDLVKFISDKIKFLNPDREYDFRDLRWCMNPPERVKINFDQFCEYKAAVKSIEHIFESPLNKSKKLQSLTLGPGTGCLGRTVTRAHFSELTLTLMDLDLEMKHNVSSVFTVVEEGLFGRTYTVWRSDARDPSTDLGIGHFLRVFEIGLVRDLGLGPPVFHMTNYLTVNMSDDYRRCLLAVGELKLTALCSSSETVTLGERGVPKREPLVVVILNLAGPTLGGELYSVLPTSDLMVEKLYLSSHRGIIKDDEANWVVPSTDVRDLQNKGECLVEACKTRPPSFCNGTGSGPWSEGRIPAYGVIRVSLDLASDPGVVITSVFGPLIPHLSGMDLYNNPFSRAVWLAVPPYEQSFLGMINTIGFPNRAEVMPHILTTEIRGPRGRCHVPIELSRRVDDDIKIGSNMVILPTIDLRYITATYDVSRSEHAIVYYIYDTGRSSSYFYPVRLNFKGNPLSLRIECFPWRHKVWCYHDCLIYNTITDEEVHTRGLTGIEVTCNPV

SEQ ID NO: 8764 - protein, 609 aa, unidentified; identical to SEQ ID NO: 8763

SEQ ID NO: 8765 - protein, 50 aa, unidentified
IRILAGVPISAIRIPNQPYNWCNGSLGIEYEDTDTHHWVRGWLRHGTGLI

SEQ ID NO: 8766 - protein, 50 aa, unidentified; identical to SEQ ID NO: 8765

SEQ ID NO: 8767 - protein, 37 aa, unidentified; identical to SEQ ID NO: 8570

SEQ ID NO: 8768 - protein, 165 aa, unidentified
QEEIEVQAARLYEDTGEGYAVIFIIKDVAYPMSERSGHCSMIRPDAKGTFECSPVECKEVPLRIHTCTAKQASFLLFQPDYQSLAEEKEKLPSPSLTNSLPPGSTLNETQIRCSVSWVIQLASQHKHIGHKHSDGTVTITIEKAMHRSSMDGGKVQAVVNGVQYE

SEQ ID NO: 8769 - protein, 97 aa, unidentified
NYAKISDNELSFVTISPLKALLDPYLMVYVSPIFKGGKCYSQTCSAVEHQGLWMSAQPPSQICKLTKTASSHINPNSASTRVTALSFLVTEHHRQVP

SEQ ID NO: 8770 - protein, 97 aa, unidentified; identical to SEQ ID NO: 8769

SEQ ID NO: 8771 - protein, 50 aa, unidentified; identical to SEQ ID NO: 8765

SEQ ID NO: 8772 - protein, 50 aa, unidentified; identical to SEQ ID NO: 8765

SEQ ID NO: 8773 - protein, 50 aa, unidentified; identical to SEQ ID NO: 8765

SEQ ID NO: 8774 - protein, 74 aa, unidentified
CKEVYVDGIYITLGKKTLPRAMYAEDVALGGPISVDPIDLGNDVSAIQDAINKSKEHLDEANHLLDKVNPNIVN

SEQ ID NO: 8775 - protein, 81 aa, unidentified
EDNPRFTTMNGELTPRYNWDTHKVYQVHLPGVTTSILDASCGFLHGGYVYYQLMSGRIVSVSVGTLQFGDKVKPPICTEWK

SEQ ID NO: 8776 - protein, 313 aa, unidentified; identical to SEQ ID NO: 8356

SEQ ID NO: 8777 - protein, 62 aa, unidentified
GHTNSWMTKRDYIILGELCTSGSQDKVMSDLKSQISEGKTINITFWTGDILSLTPPYKSPKW

SEQ ID NO: 8778 - protein, 53 aa, unidentified
DRWRERKRKISRGGPTAVLPADTFTYASEWPQPERMHSGGLGTVPILVQTMQS

SEQ ID NO: 8779 - protein, 88 aa, unidentified
SLEVCGQNLVHIPDIGNFVGDDRFVRKLKKCKSLPSLRNAIENNSEDIVGNEKCLDFRLKMLDNPDKSIKYHDIRNLHPRSPGINRVY

SEQ ID NO: 8780 - protein, 166 aa, unidentified
LMCLEKVAKMRNSQSVNFLDISYLTPKKPGPGLAYYIVEEPLMSGQTKVKVSNCQYKFVEILGSDKSGIVNVTEIGSQQIFKLLETGQVFNMSELGIPICEDHTQDNETRNITCETDFGISANRGVKGLSGKPLWTVRSFKGSNISNLRGLRIGSNGITYDMTKKI

SEQ ID NO: 8781 - protein, 166 aa, unidentified; identical to SEQ ID NO: 8780

SEQ ID NO: 8782 - protein, 152 aa, unidentified
LYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTME

SEQ ID NO: 8783 - protein, 54 aa, unidentified
FMPRSPGRHPVYILINSTLMCGSAKYKEYTGSLDNDNLWTLLKNSLWVHWADDN

SEQ ID NO: 8784 - protein, 53 aa, unidentified; identical to SEQ ID NO: 8778

SEQ ID NO: 8785 - protein, 478 aa, unidentified
LSLAFSASEALVGYDCRTPGLSRPYLTTSPHECSELGHPLTRSTPEAGFVAQIPVKGTTTGKMCMVQETSRRFYCSYERNLQHRLDATMFSGYTPSTVSITDCRIWWAKGSAKGPWGERRIGNGETVIAIKDDLMTDDGWCKNWKETIEVKGWRITKAEVQVTSVYDESGLAQNYLSQEQDLILMAGPGQGTTAAGATIFWDTHDLVPCKLEIIREGEFNISTTASGTKWAVASTAGSALRIGAPVTVCGQHLYSTSEPFTFYGNLRGENSESYSAAKVGRISTALNSRVNYALLALLSGDHSSQRSSVESLCRLEAEIRRIHLTDAGVTPAQLAYRTFGSPGKALHRAGEGFRLASCESIDIKIAPQPICYDLIPVKRTNSSVLEFLDPTVMSLHSTAKKIECNDPSLPIISFGGASHELSPDLKLIPSPSHLPSSVRIANSTADVPLLRLYKPHVLMNTDLRVTMVEAAKQRSDFL

SEQ ID NO: 8786 - protein, 478 aa, unidentified; identical to SEQ ID NO: 8785

SEQ ID NO: 8787 - protein, 95 aa, unidentified
LTPIDLSYLSPQRPGPGLGFLLINGTMHMSHLTYKALELANDSVWVLDRADRDNPSQVMWSRWERMAGVMVGPNGIVKQGSKIIFPMAMIQQGRI

SEQ ID NO: 8788 - protein, 95 aa, unidentified; identical to SEQ ID NO: 8787

SEQ ID NO: 8789 - protein, 95 aa, unidentified; identical to SEQ ID NO: 8787

SEQ ID NO: 8790 - protein, 148 aa, unidentified
DLLDDILKPCASGLTVRTHAPTMGLVKATWDTDRMLMYTLCHHTWDKIQRGDPLTPIDLSYLSPQRPGPGLGFLLINGTMHMSHLTYKALELANDSVWVLDRADRDNPSQVMWSRWERMAGVMVGPNGIVKQGSKIIFPMAMIQQGRI

SEQ ID NO: 8791 - protein, 148 aa, unidentified; identical to SEQ ID NO: 8790

SEQ ID NO: 8792 - protein, 82 aa, unidentified
LTPIDLSYLSPQRPGPGLGFLLINGTMHMSHLTYKALELANDSVWVLDRADRDNPSQVMWSRWERMAGVMVGPNGIVKQGSK

SEQ ID NO: 8793 - protein, 95 aa, unidentified; identical to SEQ ID NO: 8787

SEQ ID NO: 8794 - protein, 95 aa, unidentified; identical to SEQ ID NO: 8787

SEQ ID NO: 8795 - protein, 95 aa, unidentified; identical to SEQ ID NO: 8787

SEQ ID NO: 8796 - protein, 95 aa, unidentified; identical to SEQ ID NO: 8787

SEQ ID NO: 8797 - protein, 83 aa, unidentified
PQGNLKCPTTGCPNLQYSTCDQFSRTQVSNHRHKFLTLIQVNLTQYPLPVHNLLVIPRSYYSIISHGNLYYRNSNDSVLFQLY

SEQ ID NO: 8798 - protein, 125 aa, unidentified
IGQLFDGSYVYINESEFSRPDYLNNSDNASRDGWFLLSLNGMIKYGNSVYLPHGVSTGLSGIQDIVERGTLMLLDHPKSIAISNQMDLAKNIYTSYFQMNTTSIGSKIENMIIRAKNAVSSYFSQ

SEQ ID NO: 8799 - protein, 95 aa, unidentified; identical to SEQ ID NO: 8787

SEQ ID NO: 8800 - protein, 125 aa, unidentified; identical to SEQ ID NO: 8798

SEQ ID NO: 8801 - protein, 83 aa, unidentified; identical to SEQ ID NO: 8797

SEQ ID NO: 8802 - protein, 125 aa, unidentified; identical to SEQ ID NO: 8798

SEQ ID NO: 8803 - protein, 83 aa, unidentified; identical to SEQ ID NO: 8797

SEQ ID NO: 8804 - protein, 125 aa, unidentified; identical to SEQ ID NO: 8798

SEQ ID NO: 8805 - protein, 83 aa, unidentified; identical to SEQ ID NO: 8797

SEQ ID NO: 8806 - protein, 125 aa, unidentified; identical to SEQ ID NO: 8798

SEQ ID NO: 8807 - protein, 571 aa, unidentified
  VARIANT 462: note = Any amino acid
  VARIANT 463: note = Any amino acid
  VARIANT 464: note = Any amino acid
  VARIANT 465: note = Any amino acid
  VARIANT 466: note = Any amino acid
MQDSHGNTQILNQANSMVKRTWRLLFGIATLILLVSIFVLSLIIVLQSTPGNLQNDINIIRKELNELMENFETTSKSLLSVSNQITYDVSVLTPIRQEAIETNIISKIKDHCKDRVIKEGSTCTLNGSPLHDVSFLNGFNKFYFTYKDNMQIKFKSLLDYPNFIPTATTPHGCIRIPSFSLGQTHWCYTHNINLLGCADPASSNQYVSLGTLQVLKMGDPYFKVEHSHYLNDGRNRKGCSVVAVPDGCLRNCVTMTKNETENFKDLNWQHNYLHTYHIMVPLKTRIINPPGSSRDWVHIAPGVGSGLLYAKLLIFPLYGGLTEKSVIHNNQSGKYFFPNSTKLQCRNSTMEKIKGAKDSYTITYFSGRLIQSAFLVCDLRQFLSEDCEILIPSNDYMMVGAEGRLYNIENNIFYYQRGSSWWPYPSLYRIRLNLSKKYPRITEIKFTKIEIAPRPGNKDCPXXXXXPKECITGVYQDILPLSYPNTAFPHLKQAYYTGFYLNNSLERRNPTFYTADNLDYHQQERLGKFNLTAGYSTTTCFKQTTTARLYCLYIIEVGDSVIGDFQITLFL

SEQ ID NO: 8808 - protein, 499 aa, unidentified
MPQAPLLLLLLLPTITPFKTLRCDTSSSPSAIKYVPPKVDLGLQNATCTVKAKKRITEGMQVEIHACYKITTYTSWGVFQDCDAKEEITRQYPGCIVGDEIPSDPCTAWWWRGNGPDIWKLASQRYKTEVCICLPSVSATVAVSNHPPPIYCSFDDCSTCTVRDLAAGLCTLRSMKDIKFVPKVLEAEEQETDESGVFHFHTRHIELPTFHSSYPLTADLKYSDANIKIECKLVQRPRRRKRDDVQQYVFDALAPHLAESKMTSWTISTLQDTILSQPLIDYTKYVQAILKRNDIVGTVNSGLVLYWSCDQVNADFLPWTNDTFYPPVTVNGSLQYLHPYTGILFSSSPPAPHGLYSLIYVDTKHYLGSVGSGTTPHTISTTHVLSSAYENVELDALQDFRLGSHYIDPTSVAIGPLQDPLAAAHESSKRLLDAAALHSVGLGYVYQYDPMYLIKDLLVKVATIGGVMYFCYCMFICFKYLYHFIVWGQLILKPPALIP

SEQ ID NO: 8809 - protein, 499 aa, unidentified; identical to SEQ ID NO: 8808

SEQ ID NO: 8810 - protein, 499 aa, unidentified; identical to SEQ ID NO: 8808

SEQ ID NO: 8811 - protein, 499 aa, unidentified; identical to SEQ ID NO: 8808

SEQ ID NO: 8812 - protein, 499 aa, unidentified; identical to SEQ ID NO: 8808

SEQ ID NO: 8813 - protein, 499 aa, unidentified; identical to SEQ ID NO: 8808

SEQ ID NO: 8814 - protein, 499 aa, unidentified; identical to SEQ ID NO: 8808

SEQ ID NO: 8815 - protein, 499 aa, unidentified; identical to SEQ ID NO: 8808

SEQ ID NO: 8816 - protein, 575 aa, unidentified
  VARIANT 177: note = Any amino acid
  VARIANT 178: note = Any amino acid
  VARIANT 179: note = Any amino acid
  VARIANT 180: note = Any amino acid
  VARIANT 181: note = Any amino acid
  VARIANT 182: note = Any amino acid
  VARIANT 183: note = Any amino acid
  VARIANT 184: note = Any amino acid
  VARIANT 185: note = Any amino acid
  VARIANT 186: note = Any amino acid
  VARIANT 187: note = Any amino acid
  VARIANT 188: note = Any amino acid
MDGDRGKRDSYWSTSPSGSTTKLASSWERSSKVDTWLLILSFTQWALSIATVIICIIISARQGYSMKEYSMTVEALNMSSREVKESLTSLIRQEVIARAVNIQSSVQTGIPVLLNKNSRDVIQMIDKSCSRQELTQLCESTIAVHHAEGITPLEPHSFWRCPVGEPYLSSDPKISLXXXXXXXXXXXXISGCVRLPSLSIGEAIYAYSSNLITQGCADIGKSYQVLQLGYISLNSDMFPDLNPVVSHTYDINDNRKSCSVVATGTRGYQLCSMPTVDERTDYSSDGIEDLVLDVLDLKGRTKSHRYRNSEVDLDHPFSALYPSVGNGIATEGTLIFLGYGGLTTPLQGDTKCRTKGCQQVSQDTCNEALKITWLGGKQVVSVIIQVNDYLSERPKIRVTTIPITQNYLGAEGRLLKLGDRVYIYTRSSGWHSQLQIGVLDISHPLTINWTPHEALSRPGNKECNWYNTCPKECISGVYTDAYPLSPDAANVATVTLYANTSRVNPTIMYSNTTNIINMLRIKDVQLEAAYTTTSCITHFGKGYCFHIIEINQKSLNTLQPMLFKTSIPKLCKAES

SEQ ID NO: 8817 - protein, 316 aa, unidentified; identical to SEQ ID NO: 8732

SEQ ID NO: 8818 - protein, 316 aa, unidentified; identical to SEQ ID NO: 8732

SEQ ID NO: 8819 - protein, 575 aa, unidentified; identical to SEQ ID NO: 8816
  VARIANT 177: note = Any amino acid
  VARIANT 178: note = Any amino acid
  VARIANT 179: note = Any amino acid
  VARIANT 180: note = Any amino acid
  VARIANT 181: note = Any amino acid
  VARIANT 182: note = Any amino acid
  VARIANT 183: note = Any amino acid
  VARIANT 184: note = Any amino acid
  VARIANT 185: note = Any amino acid
  VARIANT 186: note = Any amino acid
  VARIANT 187: note = Any amino acid
  VARIANT 188: note = Any amino acid

SEQ ID NO: 8820 - protein, 575 aa, unidentified; identical to SEQ ID NO: 8816
  VARIANT 177: note = Any amino acid
  VARIANT 178: note = Any amino acid
  VARIANT 179: note = Any amino acid
  VARIANT 180: note = Any amino acid
  VARIANT 181: note = Any amino acid
  VARIANT 182: note = Any amino acid
  VARIANT 183: note = Any amino acid
  VARIANT 184: note = Any amino acid
  VARIANT 185: note = Any amino acid
  VARIANT 186: note = Any amino acid
  VARIANT 187: note = Any amino acid
  VARIANT 188: note = Any amino acid

SEQ ID NO: 8821 - protein, 575 aa, unidentified; identical to SEQ ID NO: 8816
  VARIANT 177: note = Any amino acid
  VARIANT 178: note = Any amino acid
  VARIANT 179: note = Any amino acid
  VARIANT 180: note = Any amino acid
  VARIANT 181: note = Any amino acid
  VARIANT 182: note = Any amino acid
  VARIANT 183: note = Any amino acid
  VARIANT 184: note = Any amino acid
  VARIANT 185: note = Any amino acid
  VARIANT 186: note = Any amino acid
  VARIANT 187: note = Any amino acid
  VARIANT 188: note = Any amino acid

SEQ ID NO: 8822 - protein, 575 aa, unidentified; identical to SEQ ID NO: 8816
  VARIANT 177: note = Any amino acid
  VARIANT 178: note = Any amino acid
  VARIANT 179: note = Any amino acid
  VARIANT 180: note = Any amino acid
  VARIANT 181: note = Any amino acid
  VARIANT 182: note = Any amino acid
  VARIANT 183: note = Any amino acid
  VARIANT 184: note = Any amino acid
  VARIANT 185: note = Any amino acid
  VARIANT 186: note = Any amino acid
  VARIANT 187: note = Any amino acid
  VARIANT 188: note = Any amino acid

SEQ ID NO: 8823 - protein, 575 aa, unidentified; identical to SEQ ID NO: 8816
  VARIANT 177: note = Any amino acid
  VARIANT 178: note = Any amino acid
  VARIANT 179: note = Any amino acid
  VARIANT 180: note = Any amino acid
  VARIANT 181: note = Any amino acid
  VARIANT 182: note = Any amino acid
  VARIANT 183: note = Any amino acid
  VARIANT 184: note = Any amino acid
  VARIANT 185: note = Any amino acid
  VARIANT 186: note = Any amino acid
  VARIANT 187: note = Any amino acid
  VARIANT 188: note = Any amino acid

SEQ ID NO: 8824 - protein, 122 aa, unidentified
QGSPVSKIFLPNRGEEVWCNSSIRVNFSLPDGSMEQQGWLESGYGRLFPLTRPCGKSQPLLEFYIPSYEKGDYELMSRSYPDMAISEPEEKMFRFSFVDFTPDSGLHRLHYLERIQSYAGED

SEQ ID NO: 8825 - protein, 67 aa, unidentified
LANQILYNVAIIIPLKIDSIETVIFSALKDMHTGSMSNTNCTPGNLLLHDAAYINGINKFLVLKSYN

SEQ ID NO: 8826 - protein, 1605 aa, unidentified
MSQLAAHNLAMSNFYGTQQGDQYGSKQPTQGEGQVLFRYASMIVGLLSLFTIIALNVTNIIYMTGSGGTMESIKNSQQSLSGIVKETSGVIIEDIKPKTDLINSMVSYNLPSQLTIIHNLIKNEVLRQCTPSFMFNNTICPIAENPTHSHYLEELNLEMLSECRNPNGYLEVKSPIEYVEYPSFIPGSTKPGSCTRLPSFSMSSTVFAYTHTIMGHGCSELDVGDHYFSIGRIADHGHEQPIFETLTEWFINDKINRRSCTVAAGKLGAWMGCVIMTETFFDDVESSDTGRITISFMDVFGRKKEWMYSKSEIHYDQVYTALYFSVGSGAVIGDTVYFLVWGTLRDLVDQPAYCVAPGCINYDQRRCNEAQRPEQFGHRQVVNGLLSFKTNVDGKPSLLLRTFSPSDVPLGSEGRLIHFENLGRTFIYIRSTGWHSLPLTGLLNLGPPISITWTVQTAVSRPGDHPCGASNRCPRDCVTGVYTDLYPLGYDYEYTATTFLNAELYRVNPTIALTNTSKSVYTKTLTNPSQQAGYTTTTCFVFKLRVWCLSIVELSPATITAFEPVPFLFQLDIGCRNLRTGNLDPLSGKDQVYKLGRFQEPRNECFFERIDQHVYFIISIPGSIQAYEVRDLDPSATDRVNPYITDVCSLALEAFKKMTPSTRKSISIMVGHWQFRPVQVGRGVRLEFSNGFLGRVDPKLVAPEDPGFETFPGEHLSASACVQDLELCYRALEHDSIDLSTTAANNTPLNSRSTTTMTPATVHGETSQITATGKLSSTIVNKSSDQPRVSPTLSEDQDGFATTAYNQTVGRQDAPVKTVTNKLMSTSASLVIIGANNTTTQSHKVSTEGVTTVHSVRSTGLLDNAVPSQFNASRNRSEAHDDDGYTHHELTLPGTEIGKTPELPTFQTGIESTADHDEDDITPTPSNDSRNGTGVNRTDQIESRSNTMTSTLHAFADYYNDGVKKGVTGTIIGTIGYLGNYLTTTIRDKADVISSISNDYTTSSFPLTTPVNIPQSVTNNTQNSNKSTENYTITTVPDSTKPSMTNDVNAPTTTHHFTSLVPTSQTDPNTTMLPDSTEHPPHVTANTSYTNSVEDRTSTIIDYNKQSSRTSTSTTLWTSTTTAEDSIATNVTATDENSRTAYNSISPPHNSANTTTAPPVNAGGIGSSKRQTTEAAQSDTYTPTLLLVINSTNQSISEDRQNEPTGTNKGQGNQDSEHITKPSMFTTTQEMIKSQKKTTSIPSRHSSSPEISGNHIMPTVDPEIKHGIGHSYLAADPGVAAQNLLLGMRNQEIMLERKLPRFTLTKSECPPSMHDQLCYEIKRYMRVLEDKCSGSVSLNVPLLAVGYVLTSTWRQSNNTYILPPMYYLCMENKETVVSQLPEHTYYDPKNGENKEIRWGSFALDLKTWSRREDEIPMLPFSKKDMMVIFGDIDPSIPSPFCVVLEVCGYPVVVYNNGRRYIPFMMYTPADRSNPTWRSHFDSKDICYQLYRVILNTDEMNEYYADIGNDQTPVTLRTITDLCYMSYTALGGECFDREYSRSYVYSYLRYGNTDVYSMYSFDFDTKSEIVGFGSYQVEEDIKRVSTEKMSLDPFNNMKSVYNRFWN

SEQ ID NO: 8827 - protein, 293 aa, unidentified; identical to SEQ ID NO: 8158

SEQ ID NO: 8828 - protein, 313 aa, unidentified
GVAKGSRTIWYMWLGSRFLEFEALGFLNEERWASRDISGGGVEGIGINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCSHHFHELFLRDGRKLIVPCRDQHELVGRSMVSQGGSSGVAGTACLAKAYAQMWLMSYFHRRDLRTLGFGIMSSV

SEQ ID NO: 8829 - protein, 245 aa, unidentified
DTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCSHHFHELFLRDGRKLIVPCRDQHELVGRSMVSQGGSSGVAGTACLAKAYAQMWLMSYFHRRDLRTLGFGIMSS

SEQ ID NO: 8830 - protein, 309 aa, unidentified
KGSRTIWYMWLGSRFLEFESFGFLNEEHWASRELSGGGVESIPLFYLGYHLREMAKKPGKLYADDTAGWDTRITEADLDDECILCDYMEDEHKQLALSLFELCYKNKVALCPRPGRHGGTVMDVIFRRDQRGSGQVVTYALNTLTNIKVQLIRLAESEGVLDEDFNDHGIETWLNHYGEERLSRLLISGDDCLVNAFDERFGKALTWLNTMEKIRKDIDLCAPSNGYENFEKVEFCSNHFHELMLKDGRQLVVPCRSQNELVGRASVNQGGSATVAGTACLAKAYAQMWNLLYFHRRDLRLLGFAIMSA

SEQ ID NO: 8831 - protein, 131 aa, unidentified
ADDTAGWDTRITMADLEDEYTLTELMEGEHKKLAETLFNFAYKNKVALCPRPGKNGGTVLDVISRTDQRGSGQVVTYALNTLTNIKVQLIRMAESEGVLDEEFHDNGMLKWLEKHGRDRLQRLMVSGDDCV

SEQ ID NO: 8832 - protein, 309 aa, unidentified
GSRTIWYMWLGSRFLEFESFGFLNEEHWASRELSGGGVESIPLFYLGYHLREMAKKPGKLYADDTAGWDTRITEADLDDECILCDYMEDEHKQLALSLFELCYKNKVALCPRPGRHGGTVMDVIFRRDQRGSGQVVTYALNTLTNIKVQLIRLAESEGVLDEDFNDHGIETWLNHYGEERLSRLLISGDDCLVNAFDERFGKALTWLNTMEKIRKDIDLCAPSNGYENFEKVEFCSNHFHELMLKDGRQLVVPCRSQNELVGRASVNQGGSATVAGTACLAKAYAQMWNLLYFHRRDLRLLGFAIMSAT

SEQ ID NO: 8833 - protein, 293 aa, unidentified; identical to SEQ ID NO: 8158

SEQ ID NO: 8834 - protein, 85 aa, unidentified
KIVSRAGGALVANILRTRANTALGFYESCAEWKIFYEGVVFSPYMRQACTGTNGEWSRMKEQFYTKFYEMATRFQCFKFVRVPYI

SEQ ID NO: 8835 - protein, 293 aa, unidentified; identical to SEQ ID NO: 8158

SEQ ID NO: 8836 - protein, 193 aa, unidentified
DTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCSHHFHELFLRDGRKLIVPCRD

SEQ ID NO: 8837 - protein, 154 aa, unidentified; identical to SEQ ID NO: 8743

SEQ ID NO: 8838 - protein, 507 aa, unidentified
  VARIANT 478: note = Any amino acid
  VARIANT 479: note = Any amino acid
  VARIANT 480: note = Any amino acid
  VARIANT 481: note = Any amino acid
  VARIANT 482: note = Any amino acid
  VARIANT 483: note = Any amino acid
  VARIANT 484: note = Any amino acid
  VARIANT 485: note = Any amino acid
  VARIANT 486: note = Any amino acid
  VARIANT 487: note = Any amino acid
  VARIANT 488: note = Any amino acid
  VARIANT 489: note = Any amino acid
  VARIANT 490: note = Any amino acid
  VARIANT 491: note = Any amino acid
  VARIANT 492: note = Any amino acid
MEWNTFFLVILIIIIKSTTSQITQRPPVENISTYHVDWDTPLYTHPSNCRKNSFVPIRPDQLRCPHEFEDTNKGLVSVPAQIIHLPLSVTSVSAVANGHYLHRVTYRVTCSTNFFGGQTIEKTILEAKLSRQEAINEAGKDHEYPFFPEPSCIWMKDNVHKDITHYYKTPKTVSIDLYSRKSPNPDFIEGVCTTSPCPTHWQGVYWIGATPQAHCPTSETLKGHLFTRTHDHRVVKAIVAGHHPWGLTMACTVTFCGTEWIKTDLGDLIQVTGQGGANKLSPKRCVNTDVQMRGATDDFSYLNHLITNMAQRTECLDAHSDITASGKISPFLLSKFRPSHPGPGKAHYLLDGQIMRGECDYEAVVSINYNSAQYKTVNNTWKPWNRIDNNTDGYDGMIFGDKLIIPDIEKYQSIYDSGMLVQRNLVEIPHPSIVFVSNTSDLSTNYIHTNLIPSDWSFNWSLWPSLSGMGVVGGAFLXXXXXXXXXXXXXXXSYGIPMQQFSRSQMV

SEQ ID NO: 8839 - protein, 507 aa, unidentified; identical to SEQ ID NO: 8838
  VARIANT 478: note = Any amino acid
  VARIANT 479: note = Any amino acid
  VARIANT 480: note = Any amino acid
  VARIANT 481: note = Any amino acid
  VARIANT 482: note = Any amino acid
  VARIANT 483: note = Any amino acid
  VARIANT 484: note = Any amino acid
  VARIANT 485: note = Any amino acid
  VARIANT 486: note = Any amino acid
  VARIANT 487: note = Any amino acid
  VARIANT 488: note = Any amino acid
  VARIANT 489: note = Any amino acid
  VARIANT 490: note = Any amino acid
  VARIANT 491: note = Any amino acid
  VARIANT 492: note = Any amino acid

SEQ ID NO: 8840 - protein, 74 aa, unidentified
FKSPHCDIHTWDCIVVKTYVSWDEDHDTHKYLRNTTVWESPDIGRVGLYDACKKEFCGVEGIRLNNGEWWFLER

SEQ ID NO: 8841 - protein, 74 aa, unidentified; identical to SEQ ID NO: 8840

SEQ ID NO: 8842 - protein, 74 aa, unidentified; identical to SEQ ID NO: 8840

SEQ ID NO: 8843 - protein, 74 aa, unidentified; identical to SEQ ID NO: 8840

SEQ ID NO: 8844 - protein, 74 aa, unidentified; identical to SEQ ID NO: 8840

SEQ ID NO: 8845 - protein, 74 aa, unidentified; identical to SEQ ID NO: 8840

SEQ ID NO: 8846 - protein, 74 aa, unidentified; identical to SEQ ID NO: 8840

SEQ ID NO: 8847 - protein, 74 aa, unidentified; identical to SEQ ID NO: 8840

SEQ ID NO: 8848 - protein, 74 aa, unidentified; identical to SEQ ID NO: 8840

SEQ ID NO: 8849 - protein, 258 aa, unidentified; identical to SEQ ID NO: 8309

SEQ ID NO: 8850 - protein, 258 aa, unidentified; identical to SEQ ID NO: 8309

SEQ ID NO: 8851 - protein, 581 aa, unidentified; identical to SEQ ID NO: 8677

SEQ ID NO: 8852 - protein, 157 aa, unidentified
RTIWYMWLGSRFLEFESFGFLNEEHWASRELSGGGVESIPLFYLGYHLREMAKKPGKLYADDTAGWDTRITEADLDDECILCDYMEDEHKQLALSLFELCYKNKVALCPRPGRHGGTVMDVIFRRDQRGSGQVVTYALNTLTNIKVQLIRLAESEGV

SEQ ID NO: 8853 - protein, 258 aa, unidentified; identical to SEQ ID NO: 8309

SEQ ID NO: 8854 - protein, 258 aa, unidentified; identical to SEQ ID NO: 8309

SEQ ID NO: 8855 - protein, 45 aa, unidentified
YDRSLHSRVFPGGNCSGVAVSSTYCSTNHDYTIWMPENPRLGMSC

SEQ ID NO: 8856 - protein, 501 aa, unidentified; identical to SEQ ID NO: 8222

SEQ ID NO: 8857 - protein, 638 aa, unidentified; identical to SEQ ID NO: 8641

SEQ ID NO: 8858 - protein, 319 aa, unidentified
KGSRTIWYMWLGSRFLEFEALGFLNEERWASRDISGGGVEGIGINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCSHHFHELFLRDGRKLIVPCRDQHELVGRSMVSQGGSSGVAGTACLAKAYAQMWLMSYFHRRDLRTLGFGIMSSVPKDWFPTGR

SEQ ID NO: 8859 - protein, 50 aa, unidentified; identical to SEQ ID NO: 8765

SEQ ID NO: 8860 - protein, 50 aa, unidentified; identical to SEQ ID NO: 8765

SEQ ID NO: 8861 - protein, 50 aa, unidentified; identical to SEQ ID NO: 8765

SEQ ID NO: 8862 - protein, 50 aa, unidentified; identical to SEQ ID NO: 8765

SEQ ID NO: 8863 - protein, 50 aa, unidentified; identical to SEQ ID NO: 8765

SEQ ID NO: 8864 - protein, 50 aa, unidentified; identical to SEQ ID NO: 8765

SEQ ID NO: 8865 - protein, 106 aa, unidentified
QIPGSTYSTGCVRIPTFSLGSMIYSYSHNIIYEGCNDHSKSSQYWQLGYISTGKNGEPLQQVSRTLTLNNGLNRKSCSTVAQGRGAYLLCTNVVEDERTDYSTEGI

SEQ ID NO: 8866 - protein, 50 aa, unidentified; identical to SEQ ID NO: 8765

SEQ ID NO: 8867 - protein, 50 aa, unidentified; identical to SEQ ID NO: 8765

SEQ ID NO: 8868 - protein, 50 aa, unidentified; identical to SEQ ID NO: 8765

SEQ ID NO: 8869 - protein, 50 aa, unidentified; identical to SEQ ID NO: 8765

SEQ ID NO: 8870 - protein, 50 aa, unidentified; identical to SEQ ID NO: 8765

SEQ ID NO: 8871 - protein, 50 aa, unidentified; identical to SEQ ID NO: 8765

SEQ ID NO: 8872 - protein, 50 aa, unidentified; identical to SEQ ID NO: 8765

SEQ ID NO: 8873 - protein, 50 aa, unidentified; identical to SEQ ID NO: 8765

SEQ ID NO: 8874 - protein, 142 aa, unidentified
TWDTDRMLMYTLCHHTWDKIQRGDPLTPIDLSYLSPQRPGPGLGFLLINGTMHMSHLTYKALELANDSVWVLDRADRDNPSQVMWSRWERMAGVMVGPNGIVKQGSKIIFPMAMIQQGRIISELEQSEVAKVTPHHEILGNL

SEQ ID NO: 8875 - protein, 109 aa, unidentified
TEMQGVTIYGLNSITYHIGPEEWYTIMPDFIAVQGFLISNFDERKCSVTKSSILCQQNSIYPMSTEMQRCIKGEIRFCPRSKAIGTLVNRFILTKGNLMANCLGIICRC

SEQ ID NO: 8876 - protein, 87 aa, unidentified
KRVKYNRSSHDYHLNEFEWSLNVTPVVNIIVGHETNPINHAYGTQSDLLPYTRSTNLTSTDTGSGWVHIGLPSFAFINPLGWIRDIL

SEQ ID NO: 8877 - protein, 109 aa, unidentified; identical to SEQ ID NO: 8875

SEQ ID NO: 8878 - protein, 319 aa, unidentified; identical to SEQ ID NO: 8213

SEQ ID NO: 8879 - protein, 319 aa, unidentified; identical to SEQ ID NO: 8213

SEQ ID NO: 8880 - protein, 319 aa, unidentified; identical to SEQ ID NO: 8213

SEQ ID NO: 8881 - protein, 319 aa, unidentified; identical to SEQ ID NO: 8213

SEQ ID NO: 8882 - protein, 319 aa, unidentified; identical to SEQ ID NO: 8213

SEQ ID NO: 8883 - protein, 319 aa, unidentified; identical to SEQ ID NO: 8213

SEQ ID NO: 8884 - protein, 95 aa, unidentified
CDMGTEEQLELVSGLKQIDGNKQKYQHSVFVVGTNYPFMDAKGACKLRFCGKSGMLLSNGLWFNIAHTILPKPEANSNFWSALPDCSSDKQVGVL

SEQ ID NO: 8885 - protein, 95 aa, unidentified; identical to SEQ ID NO: 8884

SEQ ID NO: 8886 - protein, 95 aa, unidentified; identical to SEQ ID NO: 8884

SEQ ID NO: 8887 - protein, 95 aa, unidentified; identical to SEQ ID NO: 8884

SEQ ID NO: 8888 - protein, 74 aa, unidentified; identical to SEQ ID NO: 8774

SEQ ID NO: 8889 - protein, 81 aa, unidentified; identical to SEQ ID NO: 8775

SEQ ID NO: 8890 - protein, 194 aa, unidentified
AILGLKDSIKQSNKAIAELQTAAQQTVLVINALQDQINNQLVPAINTLGCQVIGNTLGLRLNQYFSEVSLIFGPNLRDPTSETLSIQALSRAFNGDFDSMLSKLKYDDTDFLDLLESDSIRGRIIDVSLDDYFIVIQIEYPSLISIKDATVQTFNLISYNHRGSEWISIFPSQLLVRGTYISNIDISECVSTTN

SEQ ID NO: 8891 - protein, 52 aa, unidentified
VLNDTTQKIDCVTSANRLGVELSLYLTQITTAFGNQIRNPALSDLSIQALYN

SEQ ID NO: 8892 - protein, 319 aa, unidentified; identical to SEQ ID NO: 8681

SEQ ID NO: 8893 - protein, 191 aa, unidentified
HLSGAPDGHCKKVNEIGHAELEPNWEKILSVDDYDIRHQLCLDTLASVLGGGFLTARDLLKFAPMRPGLGPAYFLFNPNKRERAVHVWTAGATTSSILWKSTCKYELIDIPQLNDTGIITYEKLDNIIGKILRNDVGVSFKDLGFTENELTDDDVSQSQLNSSLGIYHRNTSMKGIPWKRHRASTPKLKMG

SEQ ID NO: 8894 - protein, 78 aa, unidentified
NGCGLFGKGSIVGCVKTTCKSSGIAKSYSYDIPKVKYVISTEVHKGELISGNVSASVVSATFSSEAEKHSMELEDYGR

SEQ ID NO: 8895 - protein, 90 aa, unidentified
PPLYLLGEDWYQISSRGLIRHSKPATMQQDDVNYEFSVLSGLGNGGLYNDETIALYQEALVSGITSEIVKTRVADSIGGRSDLPTGYSVI

SEQ ID NO: 8896 - protein, 572 aa, unidentified; identical to SEQ ID NO: 8208

SEQ ID NO: 8897 - protein, 285 aa, unidentified; identical to SEQ ID NO: 8156

SEQ ID NO: 8898 - protein, 285 aa, unidentified; identical to SEQ ID NO: 8156

SEQ ID NO: 8899 - protein, 285 aa, unidentified; identical to SEQ ID NO: 8156

SEQ ID NO: 8900 - protein, 285 aa, unidentified; identical to SEQ ID NO: 8156

SEQ ID NO: 8901 - protein, 285 aa, unidentified; identical to SEQ ID NO: 8156

SEQ ID NO: 8902 - protein, 285 aa, unidentified; identical to SEQ ID NO: 8156

SEQ ID NO: 8903 - protein, 575 aa, unidentified; identical to SEQ ID NO: 8301
  VARIANT 178: note = Any amino acid
  VARIANT 179: note = Any amino acid
  VARIANT 180: note = Any amino acid
  VARIANT 181: note = Any amino acid
  VARIANT 182: note = Any amino acid
  VARIANT 183: note = Any amino acid
  VARIANT 184: note = Any amino acid
  VARIANT 185: note = Any amino acid
  VARIANT 186: note = Any amino acid
  VARIANT 187: note = Any amino acid
  VARIANT 188: note = Any amino acid
  VARIANT 189: note = Any amino acid
  VARIANT 190: note = Any amino acid
  VARIANT 509: note = Any amino acid
  VARIANT 510: note = Any amino acid
  VARIANT 511: note = Any amino acid
  VARIANT 512: note = Any amino acid

SEQ ID NO: 8904 - protein, 285 aa, unidentified; identical to SEQ ID NO: 8156

SEQ ID NO: 8905 - protein, 285 aa, unidentified; identical to SEQ ID NO: 8156

SEQ ID NO: 8906 - protein, 285 aa, unidentified; identical to SEQ ID NO: 8156

SEQ ID NO: 8907 - protein, 572 aa, unidentified; identical to SEQ ID NO: 8208

SEQ ID NO: 8908 - protein, 444 aa, unidentified
TIRNDNQEVPPQRITHDVGIKPLNPDDFWRCTSGLPSLMKTPKIRLMPGPGLLAMPTTVDGCVRTPSLVINDLIYAYTSNLITRGCQDIGKSYQVLQIGIITVNSDLVPDLNPRISHTFNINDNRKSCSLALLNTDVYQLCSTPKVDERSDYASSGIEDIVLDIVNYDGSISTTRFKNNNISFDQPYAALYPSVGPGIYYKGKIIFLGYGGLEHPINENAICNTTGCPGKTQRDCNQASHSPWFSDRRMVNSIIVVDKGLNSVPKLKVWTISMRQNYWGSEGRLLLLGNKIYIYTRSTSWHSKLQLGIIDITDYSDIRIKWTWHNVLSRPGNNECPWGHSCPDGCITGVYTDAYPLNPTGSIVSSVILDSQKSRVNPVITYSTATERVNELAIRNKTLSAGYTTTSCITHYNKGYCFHIVEINHKSLNTFQPMLFKTEIPKSCS

SEQ ID NO: 8909 - protein, 285 aa, unidentified; identical to SEQ ID NO: 8156

SEQ ID NO: 8910 - protein, 285 aa, unidentified; identical to SEQ ID NO: 8156

SEQ ID NO: 8911 - protein, 54 aa, unidentified; identical to SEQ ID NO: 8783

SEQ ID NO: 8912 - protein, 313 aa, unidentified; identical to SEQ ID NO: 8356

SEQ ID NO: 8913 - protein, 74 aa, unidentified; identical to SEQ ID NO: 8774

SEQ ID NO: 8914 - protein, 293 aa, unidentified; identical to SEQ ID NO: 8158

SEQ ID NO: 8915 - protein, 572 aa, unidentified
MEYWKHTNSTKNTNNETETTRGKHSSKVTNIIMYTFWTITSTILLVIFIMILTNLIQENNHNKLMLQEIRKEFAAIDTKIQRTSDDIGTSIQSGINTRLLTIQSHVQNYIPLSLTQQMSDLRKFINDLTNKREHQEVPIQRMTHDRGIEPLNPDKFWRCTSGNPSLTSSPKIRLIPGPGLLATSTTVNGCIRIPSLAINHLIYAYTSNLITQGCQDIGKSYQVLQIGIITINSDLVPDLNPRVTHTFNIDDNRKSCSLALLNTDVYQLCSTPKVDERSDYASTGIEDIVLDIVTNNGLIITTRFTNNNITFDKPYAALYPSVGPGIYYKGKVIFLGYGGLEHEENGDVICNTTGCPGKTQRDCNQASYSPWFSNRRMVNSIIVVDKGIDATFSLRVWTIPMSQNYWGSEGRLLLLGDRIYIYTRSTSWHSKLQLGVIDISDYNNIRINWTWHNVLSRPGNDECPWGHSCPDGCITGVYTDAYPLNPSGSVVSSVILDSQKSRENPIITYSTATNRINELAIYNRTLPAAYTTTNCITHYDKGYCFHIVEINHRSLNTFQPMLFKTEVPKNCS

SEQ ID NO: 8916 - protein, 74 aa, unidentified; identical to SEQ ID NO: 8774

SEQ ID NO: 8917 - protein, 572 aa, unidentified; identical to SEQ ID NO: 8915

SEQ ID NO: 8918 - protein, 249 aa, unidentified
VLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCSHHFHELFLRDGRKLIVPCRDQHELVGRSMVSQGGSSGVAGTACLAKAYAQMWLMSYFHRRDLRTLGFGIMS

SEQ ID NO: 8919 - protein, 270 aa, unidentified
VEGIPLFYLGYHLEKMAEKAGILYADDTAGWDTRITMADLEDEYTLTELMEGEHKKLAETLFNFAYKNKVALCPRPGKNGGTVLDVISRTDQRGSGQVVTYALNTLTNIKVQLIRMAESEGVLDEEFHDNGMLKWLEKHGRDRLQRLMVSGDDCVVNAIDERFGKSLVWLNEMQKIRKDIDLWKPSAGHCNWEEVEFCSNHFHKLVMRDGRTLVVPCRHEVELVGRASVNQGGSTGISGTACLAKAYAQMWLLLYFHRRDLRILGMAICS

SEQ ID NO: 8920 - protein, 240 aa, unidentified; identical to SEQ ID NO: 8468

SEQ ID NO: 8921 - protein, 120 aa, unidentified
SIERRGEYADMNLRERCLDAIDRITNENTVTLRTLGHFMPRSPGRHPVYILINSTLMCGSAKYKEYTGSLDNDNLWTLLKNSLWVHWADDNHLSYNGVLRYGKESQPEIHIPHLNDIRDS

SEQ ID NO: 8922 - protein, 319 aa, unidentified
AKGSRTIWYMWLGSRFLEFESFGFLNEEHWASRELSGGGVEGIPLNYLGYHLREMAQKPGVLYADDTAGWDTRITMADLEDEGILLDMMSGEHKKLASALFSKAYKVKVALCPRPGPKGGTLMDVISRTDQRGSGQVVTYALNTLTNIKVQLIRMAEAEGVLGATFEDFGIDRWLQEHGEDRVERMLVSGDDCVVNAIDERFGSSLNWLNAMEKVRKDIDLWKPSPSFRNWERVEFCSNHFHEMTMKDGRVIVAPCRGQTELIARGTVNQGGCVGVESTGCLAKAYAQMWLLLYFHRRDLRTLALAVMSAVPSNWIPTG

SEQ ID NO: 8923 - protein, 422 aa, unidentified; identical to SEQ ID NO: 8501

SEQ ID NO: 8924 - protein, 422 aa, unidentified; identical to SEQ ID NO: 8501

SEQ ID NO: 8925 - protein, 49 aa, unidentified
WWLNWKTCIQVGIGIIVCLLLLLMILSCIKSFFIKFAQSTLKFRYSREK

SEQ ID NO: 8926 - protein, 95 aa, unidentified
SNAISIKEQYKAISYLREHASTVDASLRDVQSSFEKTAKVFDNLYLVMQNEFKHYNSYINYIECKVHDQHQSELYESMLLLIERKVTSLIDSVLF

SEQ ID NO: 8927 - protein, 165 aa, unidentified; identical to SEQ ID NO: 8768

SEQ ID NO: 8928 - protein, 38 aa, unidentified
VTRRVEPLLPTEAECREAVNLEQHGILESGSYPPESCY

SEQ ID NO: 8929 - protein, 317 aa, unidentified
KGSRTIWYMWLGSRFLEFESFGFLNEEHWASRELSGGGVEGIPLNYLGYHLREMAQKPGVLYADDTAGWDTRITMADLEDEGILLDMMSGEHKKLASALFSKAYKVKVALCPRPGPKGGTLMDVISRTDQRGSGQVVTYALNTLTNIKVQLIRMAEAEGVLGATFEDFGIDRWLQEHGEDRVERMLVSGDDCVVNAIDERFGSSLNWLNAMEKVRKDIDLWKPSPSFRNWERVEFCSNHFHEMTMKDGRVIVAPCRGQTELIARGTVNQGGCVGVESTGCLAKAYAQMWLLLYFHRRDLRTLALAVMSAVPSNWIPT

SEQ ID NO: 8930 - protein, 296 aa, unidentified
AKGSRTIWYMWLGSRFLEFESFGFLNEEHWASRELSGGGVESIPLFYLGYHLREMAKKPGKLYADDTAGWDTRITEADLDDECILCDYMEDEHKQLALSLFELCYKNKVALCPRPGRHGGTVMDVIFRRDQRGSGQVVTYALNTLTNIKVQLIRLAESEGVLDEDFNDHGIETWLNHYGEERLSRLLISGDDCLVNAFDERFGKALTWLNTMEKIRKDIDLCAPSNGYENFEKVEFCSNHFHELMLKDGRQLVVPCRSQNELVGRASVNQGGSATVAGTACLAKAYAQMWNLLYFH

SEQ ID NO: 8931 - protein, 182 aa, unidentified
VKEWNLDSEITMRSTPVDPQYWLSYPMYDSLLVYAAADGTCRVKRKTGQYMTLPQGLQQLSSSDGDFAECGGYTVHVPQGAQMTPLSVYGSPPVLRSLDYHEQVAVKAGALSGQLLQDVLDDDKTSEAYDMYMSDNRGQGRVIAANQAICLVLLLVVIGVVIWLLKNRKIIRDWWAGVGLFG

SEQ ID NO: 8932 - protein, 524 aa, unidentified
MEKQYRPQILSVFLPEPLYIPHCLAMLLVLLLLLPLPSMTTPFKTLQCDTSSSPSAIKFTPPKIDLELQNVTCTVKAKNRITEAMAVEIHACYKITTYTSWGVFQDCDAKEEITRQYAGCIYGSEIPSDPCTAWWWRGNGPDIWKMASQRYKTEVCVCLPAVSATVAVSNHPPPIYCSFDDCSTCTNKDLAAGLCTLRSMKDIKFTPKVLQAEEEETDKAGILHPHTRHVELPSFHSSYPLTADLKYNDANIKIECKLAQKTKRRRRDDAQQYILDILAPHLASSKLTSWELATLQDTLLSQPLIDYTKYIQAILKRDDVVGTVNSGLILYWGCDQVVADFLPWLNDTFYPPVTVNGSLQYLHPYTGILFSSSPPAPHGLYSLIYVDSQHYLGSVGSGTTPHVISTTHVLPSAYGDVELNALHDFRLGSHYIDPTSVAIGPSQDPLAASHESSKRLLDAAALHSIGLGYVYQYDPMYLIKDLLVKIATIGGVMYFSYCMFICFKYLYHFIVWGQLILRPPALIP

SEQ ID NO: 8933 - protein, 174 aa, unidentified
IRNKDLLDDILKPCASGLTVRTHAPTMGLVKATWDTDRMLMYTLCHHTWDKIQRGDPLTPIDLSYLSPQRPGPGLGFLLINGTMHMSHLTYKALELANDSVWVLDRADRDNPSQVMWSRWERMAGVMVGPNGIVKQGSKIIFPMAMIQQGRIISELEQSEVAKVTPHHEILGNL

SEQ ID NO: 8934 - protein, 270 aa, unidentified; identical to SEQ ID NO: 8919

SEQ ID NO: 8935 - protein, 125 aa, unidentified
LGHGHKDGVSEFKRVDLFAMRKGKVNPYKDKGDPWLQYAYQVKRETKAANLSDQALGWKALNFHRALMCDLTNARIGEGHVANGYHMAIEAYGPQRGSSEERVWWKTTSTLGKDEEYYRSEGEEE

SEQ ID NO: 8936 - protein, 111 aa, unidentified
LTPIDLSYLSPQRPGPGLGFLLINGTMHMSHLTYKALELANDSVWVLDRADRDNPSQVMWSRWERMAGVMVGPNGIVKQGSKIIFPMAMIQQGRIISELEQSEVAKVTPHH

SEQ ID NO: 8937 - protein, 111 aa, unidentified; identical to SEQ ID NO: 8936

SEQ ID NO: 8938 - protein, 51 aa, unidentified
KPDIGNLQMFGTNLVLNEEDGMKICHLNNECSLKLPVVRCMNSSLFRVTCG

SEQ ID NO: 8939 - protein, 74 aa, unidentified; identical to SEQ ID NO: 8840

SEQ ID NO: 8940 - protein, 74 aa, unidentified; identical to SEQ ID NO: 8840

SEQ ID NO: 8941 - protein, 74 aa, unidentified; identical to SEQ ID NO: 8840

SEQ ID NO: 8942 - protein, 74 aa, unidentified; identical to SEQ ID NO: 8840

SEQ ID NO: 8943 - protein, 74 aa, unidentified; identical to SEQ ID NO: 8840

SEQ ID NO: 8944 - protein, 74 aa, unidentified; identical to SEQ ID NO: 8840

SEQ ID NO: 8945 - protein, 74 aa, unidentified; identical to SEQ ID NO: 8840

SEQ ID NO: 8946 - protein, 74 aa, unidentified; identical to SEQ ID NO: 8840

SEQ ID NO: 8947 - protein, 319 aa, unidentified; identical to SEQ ID NO: 8213

SEQ ID NO: 8948 - protein, 66 aa, unidentified
AYDCNVGDLSMTSISLITTPECLTTTPNITTEKVNVAVTQGSSISNGRFISCLFEATSVISRCGAT

SEQ ID NO: 8949 - protein, 564 aa, unidentified
MDPKSYYSSEDLRKDDGNTSSGGDLYKGIILVSTVVSLIIAIISLAFIIDNKINIQSLDPLRGLEDSYLVPIKEKSESIGQDIQEGIFPRLNLITAATTTTIPRSIAVQTKDLSELIMNRCYPSVANNDTSCDVLAGAIHSNSFSQLDPSTYWTCPSGSPTMNRTVKLLPDNSQIPGSTYSTGCVRIPTFSLGSMIYSYSHNIIYEGCNDHSKSSQYWQLGYISTGKNGEPLQQVSRTLTLNNGLNRKSCSTVAQGRGAYLLCTNVVEDERTDYSTEGIQDLILDYIDIFGAERSYRYTNSEVDLDRPYAALYPSVGSGTVYNDRILFLGYGGLMTPYGDQAMCQAPECTSATQEGCNSNQLIGYFSGRQIVNCIIEVITVGTEKPIIRVKTIPNSQVWLGAEGRIQTLGGVLYLYIRSSGWHALAQTGIILTLDPIRISWIENTGYSRPGNQPCPASSRCPVQCITGVYTDIFPLSQNYGYLATVTLLSGVNRVNPVISYGTSTRRVADSQLTSPSQVAAYTTTTCFTFNQKGYCYHIIELSPATLGIFQPVLVVTEIPKICS

SEQ ID NO: 8950 - protein, 564 aa, unidentified; identical to SEQ ID NO: 8949

SEQ ID NO: 8951 - protein, 564 aa, unidentified; identical to SEQ ID NO: 8949

SEQ ID NO: 8952 - protein, 564 aa, unidentified; identical to SEQ ID NO: 8949

SEQ ID NO: 8953 - protein, 564 aa, unidentified; identical to SEQ ID NO: 8949

SEQ ID NO: 8954 - protein, 564 aa, unidentified; identical to SEQ ID NO: 8949

SEQ ID NO: 8955 - protein, 110 aa, unidentified
ELPSIGKLNGARSTLLETLAVDTTRGPSSPIIPSAVIEIGGAMEELDLSPCITTDLDMFCTKIISYPLSQSTLSCLNGNLSDCVFSRSEGVLSTPYMTIKGKIVANCKQV

SEQ ID NO: 8956 - protein, 499 aa, unidentified; identical to SEQ ID NO: 8808

SEQ ID NO: 8957 - protein, 499 aa, unidentified; identical to SEQ ID NO: 8808

SEQ ID NO: 8958 - protein, 564 aa, unidentified; identical to SEQ ID NO: 8949

SEQ ID NO: 8959 - protein, 564 aa, unidentified; identical to SEQ ID NO: 8949

SEQ ID NO: 8960 - protein, 564 aa, unidentified; identical to SEQ ID NO: 8949

SEQ ID NO: 8961 - protein, 564 aa, unidentified; identical to SEQ ID NO: 8949

SEQ ID NO: 8962 - protein, 320 aa, unidentified
AKGSRTIWYMWLGSRFLEFESFGFLNEEHWASRELCGGGVEGIPLFYLGYHLEKMAEKAGILYADDTAGWDTRITMADLEDEYTLTELMEGEHKKLAETLFNFAYKNKVALCPRPGKNGGTVLDVISRTDQRGSGQVVTYALNTLTNIKVQLIRMAESEGVLDEEFHDNGMLKWLEKHGRDRLQRLMVSGDDCVVNAIDERFGKSLVWLNEMQKIRKDIDLWKPSAGHCNWEEVEFCSNHFHKLVMRDGRTLVVPCRHEVELVGRASVNQGGSTGISGTACLAKAYAQMWLLLYFHRRDLRILGMAICSAVPANWVPTGR

SEQ ID NO: 8963 - protein, 594 aa, unidentified
MTMGTLVFMLLVLLAGECKGGDESCLYPPALIQQEGKIFYNGVPGTTRLVSTDRVICPSTGCNIISDGRLSASADAYGSMDMHKRDYEFYKDKIVSRAGGALVANILRTRANTALGFYESCAEWKIFYEGVVFSPYMRQACTGTNGEWSRMKEQFYTKFYEMATRFQCFKFVRVPYIRPAESTQEVAPGCGAGGTINGVEYITDPRNGTIITSVVTDLKITGEYLMPFCYFVYRSRDIWLAENRGYDSDPFLKVYNEQGETLFDWNQLTDGYGEPKAEKMIKCSFIIVEKTSKITIQSWSASQFITRAAYYFNETIPRRPIQVIESKWAQSRMSDPITQESACRRLGDYCIYFRIGTYLGIFDDELGDLQVRDILSGQKGGGPNFCGGRSYPGGCPASCNPSPFCTDYISMGGATAHMASPYSSYRSFGSLYEKWTLTYPGGESVSTLLHQLSLSMASEWNTGSITPEGEPTLSLLGMDSEISNFETLGYTKDPETTRWCVTLSCENCTNLFDTRTGRPRIAPFVASRIKAEGLAEIEMRDYWNDVSLIIALCLLLALIIWLIVTSVLLTDVRRTKKHPRSSIDPSMEGYVADL

SEQ ID NO: 8964 - protein, 656 aa, unidentified
MVYYFALLWILTNFVSSERSSESSNRTIRSYHSFLLPPTTTSIPHPVSSSNISTTSPSTSRSQLPAASTSAPSAVNVWENGDAYDMFRGHFEAPSVLHPASFGRRRLLSFSSSTRKTHNVTRFPLTKIAVCPSLDQFHAIQAAELSCDALFDDPVDTTPVNIYRVLSKTIYVTSELCLCTGVKHYRRCFLEFFGSRTRYGSSDTQIIPDVRICTDLCQSLVETGRSVLKEGKILEPGCYWMRDSHKTSYTYTAFSTTVKVDRFEDIISSPAISGGVCSLSQRSCQSIKPGRLIFTSQFEEDVNIGLQVVEVSVVQWQNVPAPWFVARNRKTNEGIILRTDCARSIGAIKLAKSLTGAIFSSASLDPSCSTSLESSELPALVDFPSLPSKLEQYRAYVSCQLHKGVILNSITLGNPVHSVLLNPFQSLGQEENSEGKVDRYLISTGTLLQAKCEIREVNGLRLYKGNTWIAYHEDQEIACISGELQLGFESNCIARNETNIPILLGKWSVHLTDNGYTVVPLMYPIGVTLKGLETLSNDLKDLNDYLNKPITVNIFDPDAEVQNDLGEQGEPVSIWENFLEWIGWYKFKAAIITIFILVCISLGAYIVVKLGWCAVCCSRGRFRVKRERPLSLSDSEDVLFDRVSSSSLRSHKLHRR

SEQ ID NO: 8965 - protein, 275 aa, unidentified
AKGSRTIWYMWLGSRFLEFESFGFLNEEHWASRELSGGGVESIPLFYLGYHLREMAKKPGKLYADDTAGWDTRITEADLDDECILCDYMEDEHKQLALSLFELCYKNKVALCPRPGRHGGTVMDVIFRRDQRGSGQVVTYALNTLTNIKVQLIRLAESEGVLDEDFNDHGIETWLNHYGEERLSRLLISGDDCLVNAFDERFGKALTWLNTMEKIRKDIDLCAPSNGYENFEKVEFCSNHFHELMLKDGRQLVVPCRSQNELVGRASVNQGGSAT

SEQ ID NO: 8966 - protein, 428 aa, unidentified
DTQILAAHAAASPYRAYCPDCDGTACISPIAIDEVVSSGSDHVLRIRVGSQSGVTAKGGAAGETSLRYLGRDGKVYAADNTRLVVRTTAKCDVLQATGHYILANCPVGQSLTVAATLDGTRHQCTTVFEHQVTEKFTRERSKGHHLSDLTKKCTRFSTTPKKSALYLVDVYDALPTSVEISTVVTCNERQCTVRVPPGTTVKFDKRCKNAAKETVTFTSDSQTFTCEEPVLTAASITQGKPHLRSSMLPSGGKEVKARIPFPFPPETATCRVSIAPLPSITYEESDVLLAGTAKYPVLLTTRNLGFHSNATSEWIQGKYLRRIPVTPQGIELMLGNNAPLHFWSSVRYASGDADAYPWELLVHHIKHHPEYAWAFVGVACGLLAVAACMFACACNRVRYSLLANTFNPNPPPLTALTAALCCIPGARA

SEQ ID NO: 8967 - protein, 473 aa, unidentified
METSRLVCVVICAISFIAMMSLSIMIITIHTETIVAHLSDTSNGLADQSRRLYGQMSSVVTALQVAHKDSNAIYTNLRTNSEAMTEILHSFMEMQQLLADRPVAWSQSRACFWYDVKDITTQMNLNSAGPYSLDLPPRMADLGSYQLVSDTSSVSFFAMRSETTTFTDFFIELYRENQMGRRERYATQYIPSTVPFVAKMYSACYSALGPCFSMTADLTTLQVNVYCYNKNLKMWTSERRISSSANKVQGQPVVTCNPNSPLVQVLALNKAFGTIDFWAVRPGVSSELSFQTLPFGPWQADMQGLTLTTGCAYTSMAAIGTSSIKIMSTGMVRSPYNNFNYETACGRKDHDVVFYFQHYTKSKEYACHDYVLCRHITTSNDYVLSNLCYKALSTSSKPEYRTGRFTLDRAPITTRSTYETYDRWLTLDGATMLTISRRTGSKVLAWNIRVEGTLHDPSTTPDATHSARGLIQQ

SEQ ID NO: 8968 - protein, 428 aa, unidentified; identical to SEQ ID NO: 8966

SEQ ID NO: 8969 - protein, 315 aa, unidentified
GCAKGSRTIWYMWLGSRFLEFESFGFLNEEHWASRELSGGGVESIPLFYLGYHLREMAKKPGKLYADDTAGWDTRITEADLDDECILCDYMEDEHKQLALSLFELCYKNKVALCPRPGRHGGTVMDVIFRRDQRGSGQVVTYALNTLTNIKVQLIRLAESEGVLDEDFNDHGIETWLNHYGEERLSRLLISGDDCLVNAFDERFGKALTWLNTMEKIRKDIDLCAPSNGYENFEKVEFCSNHFHELMLKDGRQLVVPCRSQNELVGRASVNQGGSATVAGTACLAKAYAQMWNLLYFHRRDLRLLGFAIMSATPS

SEQ ID NO: 8970 - protein, 621 aa, unidentified
MKRVLDWVHQKMARKGLDPINPTIKVGRDGTEVDQGLAIYIARVTVSILAIILLTVLLVTPTVTGLFQVFDSSASEQSHPIMDLLNDEVLPPLRNTHALLEEDTAPRVRSIQTAVELRIPGDLKSATQQILHAIKDTCVGGDGGGTGPAPSCPPEGVLPQHHSAFKPIDPDSFTPCATGKPTFSGSPAASSSIGSFPWISSGTQDTPKISMTMSSSYLGFYATDTYITTGQNKRSVSVIGLGRLTVTEDGRSSAVVTEAEPIHHSSLIGYQSTGTGITGTVSFFRTTGSEDTADAQDVGIRSHTLLVMRRNRKLDTYVYEGGEIQGGDMYMMASPLSGQGTMVGDEMVLLGYAVPVTNYAGPVWCPNTFCNTQTMEACKNASGTIRFPGSSTGLAVVMVRYMIQDLDKDGFKPKITIHMLNREQWPIPGPYHLTSGTKGLFISVYSWGWYGHPVSGEINRATWDMRSIRLVYALLWPDLPETEGKCYTNLANPCPRACTIGSTRIGSGIPLTFTGQLSAWLTISADGGATRLKPEVAVSYSDPSYHDLVERTYPYTTAATFTAVEGSITCFMVSGLPQCITLIEGDSSAYATNLQTYNLWSLPIDCPSTRNLTLTTNTTSP

SEQ ID NO: 8971 - protein, 578 aa, unidentified
MLLCISMTIWSVLSVMGQEPNHPIYSQGPIPTKDVKIKGPYRRFWAPSVTNESLKLVSHSSKLSTSLVNGNINIPVKALTPWDNISPIKIECSFTTPIIDKTSSTLVYLNDDQRSTTEVESTMCTAWNLKVNCQTSFLGYKNITKTKQYEPITYQECLKTMNKSIIESIFDLKDDGLFPPTRCKWYSSETVEKSVITRNPVTADYDPFTDSLRHGLLNPEFCKGRCCDTKLPNSVMCPNKEAKTICSSWKAIHVYTSFYGIQIEDSDVSIPFADSCCFRYCGFPARRLIGGGVVVIKNHDGVGPIGCDTWCHDIHEVNTKADNSRVVSLTELETRQSERCMDARDLIVATGSVSTHTLSKLAPVINSGILPIYRISKGKLQRRLAIYEKASAFSYHPERLCATLAADSTKTWCLYSDSDSVFELTTGSQRDKNNIRSDMKETSLINGVHNGDDGVLTPPYTWGIVRVSQFHRNLTREWILTPPEIIEIHDLPKPDPIVEFDDEDFLSNLSWAGQFISRYRQWVKGAIGGLSVLLIIVLIYMVFRCAARIVSWIPKRRERGQPDLEMQRIPRYQRVEGW

SEQ ID NO: 8972 - protein, 438 aa, unidentified
RLTLLVCLFHIAYGLEAYDCHDQTPINRLTLPQPEQCQKQSTDLIDLPLPQVSLVQLPLFVRVNGLKFSKITLDRTYYCSMTRLMTPVVDYYGLMGFSGAQTSLQDLGLESISPPLLYDEAKRVSLSPEWTFTVDDQLIDQEGYCSQRSTRFNLHVQGLSMTPVVLNLHSSDNGIVDHVKFWDETITGPLSLGYGHSIDGDLFIWDAQNTTYCGLELLYSGVPSGYYSVNNESVMVFDDFSTGFRVTNYTHICGIPARLTSIPYLFVLTQEAASSLSLPSSFEVRPSISSLSMANSISISLVASLRGVRKILVEQICKIDTRLSSLILGDSSISPDLAAYLLTTKKGYSVVRHGGEILLTKCNLTSVVIRPTNTCYSMVPVNHVESNTSSFWNPLTSVLSSTAEPLHCSSPYIPSFEYRGTWYRLTPHLSVIPAPMEY

SEQ ID NO: 8973 - protein, 479 aa, unidentified
LLLPAAAALVGYDCNKKGMGHPYAIGSMSECRKFDKGAISSSAWAGTILQVPKQTQTPHKTCKLLLRSYSMYCTYYNNPTMLEKYSDDVDLTPYIMDEQDCIDAWDKRVFYYQGTQISVNPGGVTKILIGADIDENGFCRTSKGTSTVVKGHIELVWAEVMEVTDLRGQPKRRELDGEGLRWSLTRKSSTTVTGVTVLTNSPPTAMCSWQSIYQGAGELLEYPGSETYVTIPKLSSGFKLITVVTVCGLRVSVTDDPSIFLVNTTAVDVTPANDEFSGRYSSYFKSGLLGLQLILQSGMTTTTRDLLKNQCILEQMIQQNVVHQASKHPGLAAYTLTGVRGWTIILSGAGVILKQCTEVAVVLRPQDECYTDIPITINSTSSPLFLDPTTHIIKISSHTIECDDDSNPIFQVRNQYYRMTPKLVPVRGLPNLPSVLSDLNTTLLSPGTGLYPNEVLNHLDEGMSHISRKEEVERQLLKL

SEQ ID NO: 8974 - protein, 564 aa, unidentified; identical to SEQ ID NO: 8949

SEQ ID NO: 8975 - protein, 564 aa, unidentified; identical to SEQ ID NO: 8949

SEQ ID NO: 8976 - protein, 608 aa, unidentified
MDAGYLFVLCVLVAIGGQTWGLVGYDCTSSVANITTISLFSVLPCELDQKPQSEYLSVIQVVQQRSVSRVHTFSCLVIRSSVIHHCGMHHHTSVGPMSIGEIMHTSNTQCADLHHFGKLAVGSGTLLTGFKVNETVQISITEHGYSDSEFKCRGTSFSHNGIAYHDAVMKSSYTVTLREEWASLDLDTGDLKMSTGYMHPFKTGQSFDASAGDVFWSTQDNQDCTPTSYLVLHEGAGIIYQGHRDTKTLVVNSSTHAMAVGILGPTLVCHQPALRTEHPKIFIVMKHPGSPSFFFKKSIVDPANVDMFLYINSKLVYLERHMGYQMSLVYEHFHKRTCNIKHQLLRHLIAIAVMNPEEFAWLYSKRPGVTAILRGELIYLMECQAVPVTIRKPSGRCYNELPVTFNNTPMFIKPRSRILVHYGSEIDCSPIVPAGFMIEGRWWALRPDSTQLPAPTTLSAEPEEGKWSYTSPHDLFKSGIYTLEELLAFQKRLLFSFEKPAISHTLSSAAARQPADLSGIDGAGLFHPGQLEEIQKNFMSKIWGWYWNVSVVLGGLVGIYMVFQLIKSVINSIITCTCLYRAYGCGVEILTCCFSSCAKYLLLKRHTD

SEQ ID NO: 8977 - protein, 564 aa, unidentified; identical to SEQ ID NO: 8949

SEQ ID NO: 8978 - protein, 381 aa, unidentified
CVRIPTFSLGSMIYSYSHNIIYEGCNDHSKSSQYWQLGYISTGKNGEPLQQVSRTLTLNNGLNRKSCSTVAQGRGAYLLCTNVVEDERTDYSTEGIQDLILDYIDIFGAERSYRYTNSEVDLDRPYAALYPSVGSGTVYNDRILFLGYGGLMTPYGDQAMCQAPECTSATQEGCNSNQLIGYFSGRQIVNCIIEVITVGTEKPIIRVKTIPNSQVWLGAEGRIQTLGGVLYLYIRSSGWHALAQTGIILTLDPIRISWIENTGYSRPGNQPCPASSRCPVQCITGVYTDIFPLSQNYGYLATVTLLSGVNRVNPVISYGTSTRRVADSQLTSPSQVAAYTTTTCFTFNQKGYCYHIIELSPATLGIFQPVLVVTEIPKICS

SEQ ID NO: 8979 - protein, 221 aa, unidentified
FEALGFLNEERWASRDISGGGVEGIGINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCSH

SEQ ID NO: 8980 - protein, 45 aa, unidentified
HIRNKVLEKIVCRHSGLIFKATANVELKHSCPGIPRDAHVYLTES

SEQ ID NO: 8981 - protein, 45 aa, unidentified; identical to SEQ ID NO: 8980

SEQ ID NO: 8982 - protein, 45 aa, unidentified; identical to SEQ ID NO: 8980

SEQ ID NO: 8983 - protein, 293 aa, unidentified; identical to SEQ ID NO: 8158

SEQ ID NO: 8984 - protein, 293 aa, unidentified; identical to SEQ ID NO: 8158

SEQ ID NO: 8985 - protein, 293 aa, unidentified; identical to SEQ ID NO: 8158

SEQ ID NO: 8986 - protein, 60 aa, unidentified
VANLSSNQMILSDQVTIDQSTIENILSDLTEHGLRLNEAEKSFNNSHLCIVRNETHDVNH

SEQ ID NO: 8987 - protein, 57 aa, unidentified; identical to SEQ ID NO: 8179

SEQ ID NO: 8988 - protein, 293 aa, unidentified; identical to SEQ ID NO: 8158

SEQ ID NO: 8989 - protein, 54 aa, unidentified
CLIVDGSCYPPSEKVLFNGIFVNDAGHVIIPERVFGDTPDQLPLIESYQIPMKH

SEQ ID NO: 8990 - protein, 319 aa, unidentified; identical to SEQ ID NO: 8213

SEQ ID NO: 8991 - protein, 95 aa, unidentified; identical to SEQ ID NO: 8884

SEQ ID NO: 8992 - protein, 319 aa, unidentified; identical to SEQ ID NO: 8213

SEQ ID NO: 8993 - protein, 95 aa, unidentified; identical to SEQ ID NO: 8884

SEQ ID NO: 8994 - protein, 95 aa, unidentified; identical to SEQ ID NO: 8884

SEQ ID NO: 8995 - protein, 258 aa, unidentified; identical to SEQ ID NO: 8309

SEQ ID NO: 8996 - protein, 258 aa, unidentified; identical to SEQ ID NO: 8309

SEQ ID NO: 8997 - protein, 258 aa, unidentified; identical to SEQ ID NO: 8309

SEQ ID NO: 8998 - protein, 258 aa, unidentified; identical to SEQ ID NO: 8309

SEQ ID NO: 8999 - protein, 585 aa, unidentified
LVGYDCTSSVANITTISLFSVLPCELDQKPQSEYLSVIQVVQQRSVSRVHTFSCLVIRSSVIHHCGMHHHTSVGPMSIGEIMHTSNTQCADLHHFGKLAVGSGTLLTGFKVNETVQISITEHGYSDSEFKCRGTSFSHNGIAYHDAVMKSSYTVTLREEWASLDLDTGDLKMSTGYMHPFKTGQSFDASAGDVFWSTQDNQDCTPTSYLVLHEGAGIIYQGHRDTKTLVVNSSTHAMAVGILGPTLVCHQPALRTEHPKIFIVMKHPGSPSFFFKKSIVDPANVDMFLYINSKLVYLERHMGYQMSLVYEHFHKRTCNIKHQLLRHLIAIAVMNPEEFAWLYSKRPGVTAILRGELIYLMECQAVPVTIRKPSGRCYNELPVTFNNTPMFIKPRSRILVHYGSEIDCSPIVPAGFMIEGRWWALRPDSTQLPAPTTLSAEPEEGKWSYTSPHDLFKSGIYTLEELLAFQKRLLFSFEKPAISHTLSSAAARQPADLSGIDGAGLFHPGQLEEIQKNFMSKIWGWYWNVSVVLGGLVGIYMVFQLIKSVINSIITCTCLYRAYGCGVEILTCCFSSCAKYLLLKRH

SEQ ID NO: 9000 - protein, 661 aa, unidentified
LVGYDCTSSVANITTISLFSVLPCELDQKPQSEYLSVIQVVQQRSVSRVHTFSCLVIRSSVIHHCGMHHHTSVGPMSIGEIMHTSNTQCADLHHFGKLAVGSGTLLTGFKVNETVQISITEHGYSDSEFKCRGTSFSHNGIAYHDAVMKSSYTVTLREEWASLDLDTGDLKMSTGYMHPFKTGQSFDASAGDVFWSTQDNQDCTPTSYLVLHEGAGIIYQGHRDTKTLVVNSSTHAMAVGILGPTLVCHQPALRTEHPKIFIVMKHPGSPSFFFKKSIVDPANVDMFLYINSKLVYLERHMGYQMSLVYEHFHKRTCNIKHQLLRHLIAIAVMNPEEFAWLYSKRPGVTAILRGELIYLMECQAVPVTIRKPSGRCYNELPVTFNNTPMFIKPRSRILVHYGSEIDCSPIVPAGFMIEGRWWALRPDSTQLPAPTTLSAEPEEGKWSYTSPHDLFKSGIYTLEELLAFQKRLLFSFEKPAISHTLSSAAARQPADLSGIDGAGLFHPGQLEEIQKNFMSKIWGWYWNVSVVLGGLVGIYMVFQLIKSVINSIITCTCLYRAYGCGVEILTCCFSSCAKYLLLKRHTDPDFRGGTARIVDWISRRSRPTTQVAQEDSVEAAVQLDDVRVEAPIATAPSRIHSPLYPPNEPIDTTYPSAYLRR

SEQ ID NO: 9001 - protein, 285 aa, unidentified; identical to SEQ ID NO: 8156

SEQ ID NO: 9002 - protein, 57 aa, unidentified; identical to SEQ ID NO: 8179

SEQ ID NO: 9003 - protein, 260 aa, unidentified; identical to SEQ ID NO: 8254

SEQ ID NO: 9004 - protein, 576 aa, unidentified
MEETKVKTSEYWARSPQIHATNHPNVQNREKIKEILTILISFISSLSLVLVIAVLIMQSLHNGTILRCKDVGLESINKSTYSISNAILDVIKQELITRIINTQSSVQVALPILINKKIQDLSLIIEKSSKVHQNSPTCSGVAALTHVEGIKPLDPDDYWRCPSGEPYLEDELTLSLIPGPSMLAGTSTIDGCVRLPSLAIGKSLYAYSSNLITKGCQDIGKSYQVLQLGIITLNSDLHPDLNPIISHTYDINDNRKSCSVAVSETKGYQLCSMPRVNEKTDYTSDGIEDIVFDVLDLKGSSRSFKFSNNDINFDHPFSALYPSVGSGIIWKNELYFLGYGALTTALQGNTKCNLMGCPGATQDNCNKFISSSWLYSKQMVNVLIQVKGYLSSKPSIIVRTIPITENYVGAEGKLVGTRERIYIYTRSTGWHTNLQIGVLNINHPITITWTDHRVLSRPGRSPCAWNNKCPRNCTTGVYTDAYPISPDANYVATVTLLSNSTRNNPTIMYSSSDRVYNMLRLRNTELEAAYTTTSCIVHFDRGYCFHIIEINQKELNTLQPMLFKTAIPKACRISNL

SEQ ID NO: 9005 - protein, 57 aa, unidentified; identical to SEQ ID NO: 8179

SEQ ID NO: 9006 - protein, 57 aa, unidentified; identical to SEQ ID NO: 8179

SEQ ID NO: 9007 - protein, 576 aa, unidentified; identical to SEQ ID NO: 9004

SEQ ID NO: 9008 - protein, 285 aa, unidentified; identical to SEQ ID NO: 8156

SEQ ID NO: 9009 - protein, 260 aa, unidentified; identical to SEQ ID NO: 8254

SEQ ID NO: 9010 - protein, 265 aa, unidentified
KGSRTIWYMWLGSRFLEFEALGFLNEERWASRDISGGGVEGIGINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCSHHFHELFLRDGRKLIVPCRDQHELVGRS

SEQ ID NO: 9011 - protein, 318 aa, unidentified
KGSRTIWYMWLGSRFLEFESFGFLNEEHWASRELSGGGVESIPLFYLGYHLREMAKKPGKLYADDTAGWDTRITEADLDDECILCDYMEDEHKQLALSLFELCYKNKVALCPRPGRHGGTVMDVIFRRDQRGSGQVVTYALNTLTNIKVQLIRLAESEGVLDEDFNDHGIETWLNHYGEERLSRLLISGDDCLVNAFDERFGKALTWLNTMEKIRKDIDLCAPSNGYENFEKVEFCSNHFHELMLKDGRQLVVPCRSQNELVGRASVNQGGSATVAGTACLAKAYAQMWNLLYFHRRDLRLLGFAIMSATPSNWIPTG

SEQ ID NO: 9012 - protein, 80 aa, unidentified
LIPVMANMSCEIKKNTFRTRLLAYWLSLVSKYQNLIANPWSEEPSFSEEQRIKNDASIAALVTSKYGIPATEFKGPDIRI

SEQ ID NO: 9013 - protein, 219 aa, unidentified
KGSRTIWYMWLGSRFLEFESFGFLNEEHWASRELSGGGVESIPLFYLGYHLREMAKKPGKLYADDTAGWDTRITEADLDDECILCDYMEDEHKQLALSLFELCYKNKVALCPRPGRHGGTVMDVIFRRDQRGSGQVVTYALNTLTNIKVQLIRLAESEGVLDEDFNDHGIETWLNHYGEERLSRLLISGDDCLVNAFDERFGKALTWLNTMEKIRKDID

SEQ ID NO: 9014 - protein, 319 aa, unidentified; identical to SEQ ID NO: 8213

SEQ ID NO: 9015 - protein, 605 aa, unidentified; identical to SEQ ID NO: 8741

SEQ ID NO: 9016 - protein, 577 aa, unidentified
MDRAVSQVALENDEREAKNTWRLIFRIAILFLTVVTLAISVASLLYSMGASTPSDLVGIPTRISRAEEKITSTLGSNQDVVDRIYKQVALESPLALLNTETTIMNAITSLSYQINGAANNSGWGAPIHDPDYIGGIGKELIVDDASDVTSFYPSAFQEHLNFIPAPTTGSGCTRIPSFDMSATHYCYTHNVILSGCRDHSHSYQYLALGVLRTSATGRVFFSTLRSINLDDTQNRKSCSVSATPLGCDMLCSKATETEEEDYNSAVPTRMVHGRLGFDGQYHEKDLDVTTLFGDWVANYPGVGGGSFIDSRVWFSVYGGLKPNSPSDTVQEGKYVIYKRYNDTCPDEQDYQIRMAKSSYKPGRFGGKRIQQAILSIKVSTSLGEDPVLTVPPNTVTLMGAEGRILTVGTSHFLYQRGSSYFSPALLYPMTVSNKTATLHSPYTFNAFTRPGSIPCQASARCPNSCVTGVYTDPYPLIFYRNHTLRGVFGTMLDGEQARLNPASAVFDSTSRSRITRVSSSSIKAAYTTSTCFKVVKTNKTYCLSIAEISNTLFGEFRIVPLLVEILKDDGVREARSG

SEQ ID NO: 9017 - protein, 565 aa, unidentified; identical to SEQ ID NO: 8390

SEQ ID NO: 9018 - protein, 92 aa, unidentified
TCIFCDAVIHDPMPIRWDPEVGIWVKYKPLRGIVGSAVFIMHKHQRNCSLVKPSTSCSEGPKPRPRHDPVLRCDMFEKHHKPRQKRPRRRSI

SEQ ID NO: 9019 - protein, 132 aa, unidentified
ADDTAGWDTRITEADLDDECILCDYMEDEHKQLALSLFELCYKNKVALCPRPGRHGGTVMDVIFRRDQRGSGQVVTYALNTLTNIKVQLIRLAESEGVLDEDFNDHGIETWLNHYGEERLSRLLISGDDCLV

SEQ ID NO: 9020 - protein, 535 aa, unidentified
SSSDTFLNSSVGPIAVCGKKSLNIETTLSECFERCRRMPQPTSTAKIGLHQVTAKGLGPRVVECKKVTITQQFVETWTFSTWKSTPTREYSLPSEEECKTVISKKCGTLECDIREPTSLTEDYLYASTNFKKETYISLITMPSSFFTSGVELMIMPLASEDQFSVTRESGESTTARYYWKKVDPLTECPFERVGQQYRCDYFEIDKNDKHWLCNRGGFSLTPKSEIETVIPVCKGLVQSKEGMIYEILDKSDKLSIWSQRLSSVGTTYKDADTDWLKEKINHMMSSMDSDLCILQCQILSLEARMYQSSSRVLKIAANIILLRPDGTGEKCETAHGCKLSTPHLMCGDPPRVAITCTGTSAYWDPKEPYALMDGHCSKPGKNEKLTFSARHHTYVIDDDLKSLLPSGFMHRKTHDLFSIDHLKGLQFKQEDIDEIRTSWNAHKTSESSAELTDSSVDKDHCGIMIDIITGSKKLLSGVVDYFSYIKYLVYVIVGLIVAGMSIKLMMLFVPSKRVKEPGMRYASVRQATEPTIEWI

SEQ ID NO: 9021 - protein, 311 aa, unidentified
SRTIWYMWLGSRFLEFESFGFLNEEHWASRELSGGGVEGIPLNYLGYHLREMAQKPGVLYADDTAGWDTRITMADLEDEGILLDMMSGEHKKLASALFSKAYKVKVALCPRPGPKGGTLMDVISRTDQRGSGQVVTYALNTLTNIKVQLIRMAEAEGVLGATFEDFGIDRWLQEHGEDRVERMLVSGDDCVVNAIDERFGSSLNWLNAMEKVRKDIDLWKPSPSFRNWERVEFCSNHFHEMTMKDGRVIVAPCRGQTELIARGTVNQGGCVGVESTGCLAKAYAQMWLLLYFHRRDLRTLALAVMSAVPSN

SEQ ID NO: 9022 - protein, 119 aa, unidentified
PTAERLILTPVDPHYINCEPGLTHYELPGDDLIHFMAASPNPRLKTKEGHLCTKQRWTTICYEGFFGEVSETGSIEPMEISDNECLDSIILYKENRLKTPHYPLPACGWLKTNYNHQDF

SEQ ID NO: 9023 - protein, 76 aa, unidentified
GEEVVVSTTNRDFSSALEYLELTGKTRKNVPQGAPSRMESDWEKVEFCFHHYHEMCLKDGRILIAPCRHENEVLGR

SEQ ID NO: 9024 - protein, 76 aa, unidentified; identical to SEQ ID NO: 9023

SEQ ID NO: 9025 - protein, 568 aa, unidentified
MSGAEGNTNKRTFRAVFRTLIILITLTILALSAAILYEVTHTSNGSESNNQVFDPTDTLNAITGNIKSMIALLNQILYNAAIALPLKIDSTESVLLAAIKDLQFSNPASQNCSSGGNLLNDALYINGINQYLLSNSFAGTVGLGPLLNIPSFIPSATAPGGCTRIPSFSLTKTHWCYSHNVILAGCADSKASNQYLAMGIVEQSSADFPFFRTMRTLYLSDGINRKSCSIVAIPGGCALYCYVATKTEQEDYAATTPSELRLTFYYYNETLVERTLTIPNVTGNWATLNPAVGSGVYHLGYLAFPVYGGLIQNSAAWNSQFGSYFLPQNPAVQCSGSAEQQINTAKGSYVVNWFSGRLIQSAVLVCPLSDQLTDQCRVVLFNNSETMMGAEGRLYTIGGDLYYYQRSSSWWTASLLYKINTDFSQGLPPLIEAQWVPTYLVPRPGAQPCSAGNFCPANCITGVYADVWPMNNPFPAGSSGVNPNYLFGGAFLWADVARVNPTFYMASATQYKNTTGFPNSNQKAAYTSTTCFQNTGSKKIYCLFIIEMGSSLMGEFQIVPFLREVIIT

SEQ ID NO: 9026 - protein, 568 aa, unidentified; identical to SEQ ID NO: 9025

SEQ ID NO: 9027 - protein, 285 aa, unidentified; identical to SEQ ID NO: 8156

SEQ ID NO: 9028 - protein, 285 aa, unidentified; identical to SEQ ID NO: 8156

SEQ ID NO: 9029 - protein, 575 aa, unidentified; identical to SEQ ID NO: 8301
  VARIANT 178: note = Any amino acid
  VARIANT 179: note = Any amino acid
  VARIANT 180: note = Any amino acid
  VARIANT 181: note = Any amino acid
  VARIANT 182: note = Any amino acid
  VARIANT 183: note = Any amino acid
  VARIANT 184: note = Any amino acid
  VARIANT 185: note = Any amino acid
  VARIANT 186: note = Any amino acid
  VARIANT 187: note = Any amino acid
  VARIANT 188: note = Any amino acid
  VARIANT 189: note = Any amino acid
  VARIANT 190: note = Any amino acid
  VARIANT 509: note = Any amino acid
  VARIANT 510: note = Any amino acid
  VARIANT 511: note = Any amino acid
  VARIANT 512: note = Any amino acid

SEQ ID NO: 9030 - protein, 285 aa, unidentified; identical to SEQ ID NO: 8156

SEQ ID NO: 9031 - protein, 572 aa, unidentified; identical to SEQ ID NO: 8527

SEQ ID NO: 9032 - protein, 293 aa, unidentified; identical to SEQ ID NO: 8158

SEQ ID NO: 9033 - protein, 293 aa, unidentified; identical to SEQ ID NO: 8158

SEQ ID NO: 9034 - protein, 293 aa, unidentified; identical to SEQ ID NO: 8158

SEQ ID NO: 9035 - protein, 285 aa, unidentified; identical to SEQ ID NO: 8156

SEQ ID NO: 9036 - protein, 82 aa, unidentified
TKYMVRTTSVYDGLEQRNRLIKFEVLEFEDVVSKYQGEGNYDVKDTSVEITPDGQRVINRTDFVKTIAKGGKEIVSGIVGWF

SEQ ID NO: 9037 - protein, 95 aa, unidentified; identical to SEQ ID NO: 8787

SEQ ID NO: 9038 - protein, 96 aa, unidentified
YLHTYHIMVPLKTRIINPPGSSRDWVHIAPGVGSGLLYAKLLIFPLYGGLTEKSVIHNNQSGKYFFPNSTKLQCRNSTMEKIKGAKDSYTITYFSG

SEQ ID NO: 9039 - protein, 95 aa, unidentified; identical to SEQ ID NO: 8787

SEQ ID NO: 9040 - protein, 130 aa, unidentified
YIENNPVHYDDMCTIKRCNNLILTIKNFKKYVIKSSGLFQECKTDNIHYLNKEESFNEVEDHILCANKLVKVIKEKKLNYYDLKYFHPTRIGLHNIYRLNEDKKLEKNIAYYSKVDSDKDEVKVKSVACG

SEQ ID NO: 9041 - protein, 130 aa, unidentified; identical to SEQ ID NO: 9040

SEQ ID NO: 9042 - protein, 420 aa, unidentified
DLETHFTQYKLARPYIADCSNCGHGRCDSPIAIEDIRGDAHAGYIRIQTSAMFGLKSDGVDLAYMSFMNGKTLKAIKIEHLYARTSAPCSLVSYHGYYILAQCPPGDTVTVGFQDGANKHMCTIAHKVEFKPVGREKYRHPPEHGVELPCTKYTHKRADQGHYVEMHQPGLVADHSLLSMSSTKVKITVPSGSQVKYYCKCPDVKEGTTGSDYTTACTNLKQCRAYLIDNKKWVYNSGKLPRGEGETFKGKLHVPFVPVTSKCTATLAPEPLVEHKHRSLILHLHPEHPTLLTTRALGSNARPTRQWIEQPTTVNFTVTGEGFEYTWGNHPPKRVWAQESGEGNPHGWPHEIVIYYYNRYPMTTVIGLCTCVAIIMVSCVTSVWLLCRTRNLCITPYRLAPNAQVPILLAVLCCVKPTRA

SEQ ID NO: 9043 - protein, 420 aa, unidentified; identical to SEQ ID NO: 9042

SEQ ID NO: 9044 - protein, 420 aa, unidentified; identical to SEQ ID NO: 9042

SEQ ID NO: 9045 - protein, 420 aa, unidentified; identical to SEQ ID NO: 9042

SEQ ID NO: 9046 - protein, 420 aa, unidentified; identical to SEQ ID NO: 9042

SEQ ID NO: 9047 - protein, 420 aa, unidentified; identical to SEQ ID NO: 9042

SEQ ID NO: 9048 - protein, 420 aa, unidentified; identical to SEQ ID NO: 9042

SEQ ID NO: 9049 - protein, 420 aa, unidentified; identical to SEQ ID NO: 9042

SEQ ID NO: 9050 - protein, 100 aa, unidentified
SVTCDFRWYGSKYISHEVVVKRTTPDQCKFAIKEYQEGLPELPTMPAESCGWNNVLTESKDYVTVTPHSVRLDPYGMVYVDSEFKDGRCSEQVCQTPNHR

SEQ ID NO: 9051 - protein, 54 aa, unidentified
LKKPDIGNLQMFGTNLVLNEEDGMKICHLNNECSLKLPVVRCMNSSLFRVTCGS

SEQ ID NO: 9052 - protein, 78 aa, unidentified
PEKIEKWTPIDMIHLSCPNNMLSEEEGCNTESPFTYFELKSGYLAHQKVPGFTCTGVVNEAETYTNFVGYVTTTFKRK

SEQ ID NO: 9053 - protein, 69 aa, unidentified; identical to SEQ ID NO: 8367

SEQ ID NO: 9054 - protein, 137 aa, unidentified
EWWRIMNTYVVSGESCNSSDSGWDEILVEKMQSKREIVFHFWRGDLTLVYPYNVSHWTLYKDEKIQRSSKWFPKLQYMMLDKEIYIDNVTQALHNYTQDIYNHYMGNQTASTGLGSIIPRILDRITLSVGNAVKLVV

SEQ ID NO: 9055 - protein, 70 aa, unidentified
EHLIEKHSTHFFDHVTKQSIFERELQNGEISIDDLEQLIGRKTNHTDLPKKVRNWVQNAKESVVGIFREF

SEQ ID NO: 9056 - protein, 124 aa, unidentified
RTRVVNTHVPKFALSGGVVFANCAPIVCKCQDPMANINQEPKVTNVMVSSDTCKEVYVDGIYITLGKKTLPRAMYAEDVALGGPISVDPIDLGNDVSAIQDAINKSKEHLDEANHLLDKVNPNI

SEQ ID NO: 9057 - protein, 109 aa, unidentified; identical to SEQ ID NO: 8703

SEQ ID NO: 9058 - protein, 302 aa, unidentified
MWLGSRFLEFEALGFLNEERWASRDISGGGVEGIGINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCSHHFHELFLRDGRKLIVPCRDQHELVGRSMVSQGGSSGVAGTACLAKAYAQMWLMSYFHRRDLRTLGFGIMSSV

SEQ ID NO: 9059 - protein, 300 aa, unidentified
KPGEFGCAKGSRTIWYMWLGSRFLEFESFGFLNEEHWASRELSGGGVESIPLFYLGYHLREMAKKPGKLYADDTAGWDTRITEADLDDECILCDYMEDEHKQLALSLFELCYKNKVALCPRPGRHGGTVMDVIFRRDQRGSGQVVTYALNTLTNIKVQLIRLAESEGVLDEDFNDHGIETWLNHYGEERLSRLLISGDDCLVNAFDERFGKALTWLNTMEKIRKDIDLCAPSNGYENFEKVEFCSNHFHELMLKDGRQLVVPCRSQNELVGRASVNQGGSATVAGTACLAKAYAQMWNLL

SEQ ID NO: 9060 - protein, 134 aa, unidentified
GSGQVVTFALNTITNGKVQVARVLESEGLLHADESVLDAWLEKHLEEALGNMVIAGEEVVVSTTNRDFSSALEYLELTGKTRKNVPQGAPSRMESDWEKVEFCFHHYHEMCLKDGRILIAPCRHENEVLGRSRL

SEQ ID NO: 9061 - protein, 61 aa, unidentified
EGTYGCDEFDEGDELFYVCAAGGLTVTPRKSSPLIHPSLCPGLKWSQEGLLYEISKGDPNS

SEQ ID NO: 9062 - protein, 310 aa, unidentified
GSRTIWYMWLGSRFLEFEALGFLNEERWASRDISGGGVEGIGINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCSHHFHELFLRDGRKLIVPCRDQHELVGRSMVSQGGSSGVAGTACLAKAYAQMWLMSYFHRRDLRTLGFGIMSSVP

SEQ ID NO: 9063 - protein, 241 aa, unidentified
ADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCSHHFHELFLRDGRKLIVPCRDQHELVGRSMVSQGGSSGVAGTACLAKAYAQMWLMSYFHRRDLRTLG

SEQ ID NO: 9064 - protein, 50 aa, unidentified
IAFPKELSPVGSGMLFRPINPYDICNMPRAVLLLNKTYYTFSLWEGDCGY

SEQ ID NO: 9065 - protein, 54 aa, unidentified
RGSSYFSPALLYPMTVSNKTATLHSPYTFNAFTRPGSIPCQASARCPNSCVTGV

SEQ ID NO: 9066 - protein, 310 aa, unidentified; identical to SEQ ID NO: 9062

SEQ ID NO: 9067 - protein, 317 aa, unidentified
GSRTIWYMWLGSRFLEFEALGFLNEERWASRDISGGGVEGIGINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCSHHFHELFLRDGRKLIVPCRDQHELVGRSMVSQGGSSGVAGTACLAKAYAQMWLMSYFHRRDLRTLGFGIMSSVPKDWFPTG

SEQ ID NO: 9068 - protein, 317 aa, unidentified; identical to SEQ ID NO: 9067

SEQ ID NO: 9069 - protein, 242 aa, unidentified
GSRTIWYMWLGSRFLEFEALGFLNEERWASRDISGGGVEGIGINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCSHHFHEL

SEQ ID NO: 9070 - protein, 47 aa, unidentified
TNPFISNQIKSNLSPPVLAEGHLSPSPIPKFRKILLTISFVSTIVVL

SEQ ID NO: 9071 - protein, 662 aa, unidentified; identical to SEQ ID NO: 8758

SEQ ID NO: 9072 - protein, 499 aa, unidentified; identical to SEQ ID NO: 8808

SEQ ID NO: 9073 - protein, 82 aa, unidentified
LNFHRALMCDLTNARIGEGHVANGYHMAIEAYGPQRGSSEERVWWKTTSTLGKDEEYYRSEGEEECFPNSPAPHRRTWTERH

SEQ ID NO: 9074 - protein, 270 aa, unidentified
GSRTIWYMWLGSRFLEFESFGFLNEEHWASRELSGGGVEGIPLNYLGYHLREMAQKPGVLYADDTAGWDTRITMADLEDEGILLDMMSGEHKKLASALFSKAYKVKVALCPRPGPKGGTLMDVISRTDQRGSGQVVTYALNTLTNIKVQLIRMAEAEGVLGATFEDFGIDRWLQEHGEDRVERMLVSGDDCVVNAIDERFGSSLNWLNAMEKVRKDIDLWKPSPSFRNWERVEFCSNHFHEMTMKDGRVIVAPCRGQTELIARGTVNQGG

SEQ ID NO: 9075 - protein, 318 aa, unidentified
GSRTIWYMWLGSRFLEFESFGFLNEEHWASRELSGGGVESIPLFYLGYHLREMAKKPGKLYADDTAGWDTRITEADLDDECILCDYMEDEHKQLALSLFELCYKNKVALCPRPGRHGGTVMDVIFRRDQRGSGQVVTYALNTLTNIKVQLIRLAESEGVLDEDFNDHGIETWLNHYGEERLSRLLISGDDCLVNAFDERFGKALTWLNTMEKIRKDIDLCAPSNGYENFEKVEFCSNHFHELMLKDGRQLVVPCRSQNELVGRASVNQGGSATVAGTACLAKAYAQMWNLLYFHRRDLRLLGFAIMSATPSNWIPTGR

SEQ ID NO: 9076 - protein, 69 aa, unidentified; identical to SEQ ID NO: 8367

SEQ ID NO: 9077 - protein, 565 aa, unidentified; identical to SEQ ID NO: 8390

SEQ ID NO: 9078 - protein, 109 aa, unidentified
EVDCSGLLTVKYKLTHEWYTVGSNLIVTSAPERLDFSNKDDWTFRTIDDLIETGIYTLEDLEAVQKIIMTPIQKNALTERISRTIQGESELPTGSNVIHLFTEEDLKTL

SEQ ID NO: 9079 - protein, 113 aa, unidentified
GGEWIKFPYHTCLISWSCFIREIDLPVRVLEDGKIYSSFSNGTMFELTKHIYTMEKGAQLYIPTLPLKHQSEVILDCLGSENSGGLKCILRSGPKELIGGVYSGNSTYVANRH

SEQ ID NO: 9080 - protein, 34 aa, unidentified; identical to SEQ ID NO: 8588

SEQ ID NO: 9081 - protein, 575 aa, unidentified; identical to SEQ ID NO: 8816
  VARIANT 177: note = Any amino acid
  VARIANT 178: note = Any amino acid
  VARIANT 179: note = Any amino acid
  VARIANT 180: note = Any amino acid
  VARIANT 181: note = Any amino acid
  VARIANT 182: note = Any amino acid
  VARIANT 183: note = Any amino acid
  VARIANT 184: note = Any amino acid
  VARIANT 185: note = Any amino acid
  VARIANT 186: note = Any amino acid
  VARIANT 187: note = Any amino acid
  VARIANT 188: note = Any amino acid

SEQ ID NO: 9082 - protein, 575 aa, unidentified; identical to SEQ ID NO: 8816
  VARIANT 177: note = Any amino acid
  VARIANT 178: note = Any amino acid
  VARIANT 179: note = Any amino acid
  VARIANT 180: note = Any amino acid
  VARIANT 181: note = Any amino acid
  VARIANT 182: note = Any amino acid
  VARIANT 183: note = Any amino acid
  VARIANT 184: note = Any amino acid
  VARIANT 185: note = Any amino acid
  VARIANT 186: note = Any amino acid
  VARIANT 187: note = Any amino acid
  VARIANT 188: note = Any amino acid

SEQ ID NO: 9083 - protein, 86 aa, unidentified
VMTACSADTEWYLKLPIEYCAEKNMMKVVHNSTKSEEWWRIMNTYVVSGESCNSSDSGWDEILVEKMQSKREIVFHFWRGDLTLVY

SEQ ID NO: 9084 - protein, 111 aa, unidentified
LLGEDWYQISSRGLIRHSKPATMQQDDVNYEFSVLSGLGNGGLYNDETIALYQEALVSGITSEIVKTRVADSIGGRSDLPTGYSVIKAMSDGDYHIIESKIGGFWTRFKSN

SEQ ID NO: 9085 - protein, 86 aa, unidentified; identical to SEQ ID NO: 9083

SEQ ID NO: 9086 - protein, 575 aa, unidentified; identical to SEQ ID NO: 8816
  VARIANT 177: note = Any amino acid
  VARIANT 178: note = Any amino acid
  VARIANT 179: note = Any amino acid
  VARIANT 180: note = Any amino acid
  VARIANT 181: note = Any amino acid
  VARIANT 182: note = Any amino acid
  VARIANT 183: note = Any amino acid
  VARIANT 184: note = Any amino acid
  VARIANT 185: note = Any amino acid
  VARIANT 186: note = Any amino acid
  VARIANT 187: note = Any amino acid
  VARIANT 188: note = Any amino acid

SEQ ID NO: 9087 - protein, 575 aa, unidentified; identical to SEQ ID NO: 8816
  VARIANT 177: note = Any amino acid
  VARIANT 178: note = Any amino acid
  VARIANT 179: note = Any amino acid
  VARIANT 180: note = Any amino acid
  VARIANT 181: note = Any amino acid
  VARIANT 182: note = Any amino acid
  VARIANT 183: note = Any amino acid
  VARIANT 184: note = Any amino acid
  VARIANT 185: note = Any amino acid
  VARIANT 186: note = Any amino acid
  VARIANT 187: note = Any amino acid
  VARIANT 188: note = Any amino acid

SEQ ID NO: 9088 - protein, 575 aa, unidentified; identical to SEQ ID NO: 8816
  VARIANT 177: note = Any amino acid
  VARIANT 178: note = Any amino acid
  VARIANT 179: note = Any amino acid
  VARIANT 180: note = Any amino acid
  VARIANT 181: note = Any amino acid
  VARIANT 182: note = Any amino acid
  VARIANT 183: note = Any amino acid
  VARIANT 184: note = Any amino acid
  VARIANT 185: note = Any amino acid
  VARIANT 186: note = Any amino acid
  VARIANT 187: note = Any amino acid
  VARIANT 188: note = Any amino acid

SEQ ID NO: 9089 - protein, 575 aa, unidentified; identical to SEQ ID NO: 8816
  VARIANT 177: note = Any amino acid
  VARIANT 178: note = Any amino acid
  VARIANT 179: note = Any amino acid
  VARIANT 180: note = Any amino acid
  VARIANT 181: note = Any amino acid
  VARIANT 182: note = Any amino acid
  VARIANT 183: note = Any amino acid
  VARIANT 184: note = Any amino acid
  VARIANT 185: note = Any amino acid
  VARIANT 186: note = Any amino acid
  VARIANT 187: note = Any amino acid
  VARIANT 188: note = Any amino acid

SEQ ID NO: 9090 - protein, 575 aa, unidentified; identical to SEQ ID NO: 8816
  VARIANT 177: note = Any amino acid
  VARIANT 178: note = Any amino acid
  VARIANT 179: note = Any amino acid
  VARIANT 180: note = Any amino acid
  VARIANT 181: note = Any amino acid
  VARIANT 182: note = Any amino acid
  VARIANT 183: note = Any amino acid
  VARIANT 184: note = Any amino acid
  VARIANT 185: note = Any amino acid
  VARIANT 186: note = Any amino acid
  VARIANT 187: note = Any amino acid
  VARIANT 188: note = Any amino acid

SEQ ID NO: 9091 - protein, 575 aa, unidentified; identical to SEQ ID NO: 8816
  VARIANT 177: note = Any amino acid
  VARIANT 178: note = Any amino acid
  VARIANT 179: note = Any amino acid
  VARIANT 180: note = Any amino acid
  VARIANT 181: note = Any amino acid
  VARIANT 182: note = Any amino acid
  VARIANT 183: note = Any amino acid
  VARIANT 184: note = Any amino acid
  VARIANT 185: note = Any amino acid
  VARIANT 186: note = Any amino acid
  VARIANT 187: note = Any amino acid
  VARIANT 188: note = Any amino acid

SEQ ID NO: 9092 - protein, 575 aa, unidentified; identical to SEQ ID NO: 8816
  VARIANT 177: note = Any amino acid
  VARIANT 178: note = Any amino acid
  VARIANT 179: note = Any amino acid
  VARIANT 180: note = Any amino acid
  VARIANT 181: note = Any amino acid
  VARIANT 182: note = Any amino acid
  VARIANT 183: note = Any amino acid
  VARIANT 184: note = Any amino acid
  VARIANT 185: note = Any amino acid
  VARIANT 186: note = Any amino acid
  VARIANT 187: note = Any amino acid
  VARIANT 188: note = Any amino acid

SEQ ID NO: 9093 - protein, 575 aa, unidentified; identical to SEQ ID NO: 8816
  VARIANT 177: note = Any amino acid
  VARIANT 178: note = Any amino acid
  VARIANT 179: note = Any amino acid
  VARIANT 180: note = Any amino acid
  VARIANT 181: note = Any amino acid
  VARIANT 182: note = Any amino acid
  VARIANT 183: note = Any amino acid
  VARIANT 184: note = Any amino acid
  VARIANT 185: note = Any amino acid
  VARIANT 186: note = Any amino acid
  VARIANT 187: note = Any amino acid
  VARIANT 188: note = Any amino acid

SEQ ID NO: 9094 - protein, 575 aa, unidentified; identical to SEQ ID NO: 8816
  VARIANT 177: note = Any amino acid
  VARIANT 178: note = Any amino acid
  VARIANT 179: note = Any amino acid
  VARIANT 180: note = Any amino acid
  VARIANT 181: note = Any amino acid
  VARIANT 182: note = Any amino acid
  VARIANT 183: note = Any amino acid
  VARIANT 184: note = Any amino acid
  VARIANT 185: note = Any amino acid
  VARIANT 186: note = Any amino acid
  VARIANT 187: note = Any amino acid
  VARIANT 188: note = Any amino acid

SEQ ID NO: 9095 - protein, 285 aa, unidentified; identical to SEQ ID NO: 8156

SEQ ID NO: 9096 - protein, 305 aa, unidentified
RTIWYMWLGSRFLEFEALGFLNEERWASRDISGGGVEGIGINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCSHHFHELFLRDGRKLIVPCRDQHELVGRSMVSQGGSSGVAGTACLAKAYAQMWLMSYFHRRDLRTLGFGIMS

SEQ ID NO: 9097 - protein, 171 aa, unidentified
WRHHEFNKHNLDITQNFTKLFCNQKRNNCRTVETSYSSTTKCDVLPLSVLDSQNYTKRRKRNAEVALTTTTSFISIVALDTGYSDSSELWKNLIRTQESLNILEKIVANLSSNQMILSDQVTIDQSTIENILSDLTEHGLRLNEAEKSFNNSHLCIVRNETHDVNHLLRVT

SEQ ID NO: 9098 - protein, 171 aa, unidentified; identical to SEQ ID NO: 9097

SEQ ID NO: 9099 - protein, 69 aa, unidentified
CDIKTWDCIVVKAYVAWDEDHNTHNYLRNTKVWESPDIGRVGLYDACKKRFCGVDGIRLNNGEWWFLER

SEQ ID NO: 9100 - protein, 69 aa, unidentified; identical to SEQ ID NO: 9099

SEQ ID NO: 9101 - protein, 293 aa, unidentified; identical to SEQ ID NO: 8158

SEQ ID NO: 9102 - protein, 316 aa, unidentified; identical to SEQ ID NO: 8402

SEQ ID NO: 9103 - protein, 316 aa, unidentified; identical to SEQ ID NO: 8402

SEQ ID NO: 9104 - protein, 255 aa, unidentified
DTAGWDTRITEADLDDECILCDYMEDEHKQLALSLFELCYKNKVALCPRPGRHGGTVMDVIFRRDQRGSGQVVTYALNTLTNIKVQLIRLAESEGVLDEDFNDHGIETWLNHYGEERLSRLLISGDDCLVNAFDERFGKALTWLNTMEKIRKDIDLCAPSNGYENFEKVEFCSNHFHELMLKDGRQLVVPCRSQNELVGRASVNQGGSATVAGTACLAKAYAQMWNLLYFHRRDLRLLGFAIMSATPSNWIPTGR

SEQ ID NO: 9105 - protein, 571 aa, unidentified; identical to SEQ ID NO: 8536

SEQ ID NO: 9106 - protein, 103 aa, unidentified
CDVAKNTLAISLTQYFSKLSLLFGPNLRNPVEQPLSVQAIAGLMDGDINAVVSQLGYTQSDLLDLLSTESIVGTVTAIDMVNYMIQIEMSFPQYITIPDTKVL

SEQ ID NO: 9107 - protein, 565 aa, unidentified; identical to SEQ ID NO: 8390

SEQ ID NO: 9108 - protein, 565 aa, unidentified; identical to SEQ ID NO: 8390

SEQ ID NO: 9109 - protein, 330 aa, unidentified
KPGEFGVAKGSRTIWYMWLGSRFLEFEALGFLNEERWASRDISGGGVEGIGINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCSHHFHELFLRDGRKLIVPCRDQHELVGRSMVSQGGSSGVAGTACLAKAYAQMWLMSYFHRRDLRTLGFGIMSSVPKDWFPTGRTTW

SEQ ID NO: 9110 - protein, 69 aa, unidentified; identical to SEQ ID NO: 9099

SEQ ID NO: 9111 - protein, 258 aa, unidentified; identical to SEQ ID NO: 8309

SEQ ID NO: 9112 - protein, 560 aa, unidentified
YDCTSSVANITTISLFSVLPCELDQKPQSEYLSVIQVVQQRSVSRVHTFSCLVIRSSVIHHCGMHHHTSVGPMSIGEIMHTSNTQCADLHHFGKLAVGSGTLLTGFKVNETVQISITEHGYSDSEFKCRGTSFSHNGIAYHDAVMKSSYTVTLREEWASLDLDTGDLKMSTGYMHPFKTGQSFDASAGDVFWSTQDNQDCTPTSYLVLHEGAGIIYQGHRDTKTLVVNSSTHAMAVGILGPTLVCHQPALRTEHPKIFIVMKHPGSPSFFFKKSIVDPANVDMFLYINSKLVYLERHMGYQMSLVYEHFHKRTCNIKHQLLRHLIAIAVMNPEEFAWLYSKRPGVTAILRGELIYLMECQAVPVTIRKPSGRCYNELPVTFNNTPMFIKPRSRILVHYGSEIDCSPIVPAGFMIEGRWWALRPDSTQLPAPTTLSAEPEEGKWSYTSPHDLFKSGIYTLEELLAFQKRLLFSFEKPAISHTLSSAAARQPADLSGIDGAGLFHPGQLEEIQKNFMSKIWGWYWNVSVVLGGLVGIYMVFQLIKSVINSIITCTCLYRAYG

SEQ ID NO: 9113 - protein, 258 aa, unidentified; identical to SEQ ID NO: 8309

SEQ ID NO: 9114 - protein, 45 aa, unidentified
IVLYLTHSQILCINRNTLYQIGLIHRSVKKVNFYSQGSPSYIVVK

SEQ ID NO: 9115 - protein, 312 aa, unidentified
FGVAKGSRTIWYMWLGSRFLEFESFGFLNEEHWASRELCGGGVEGIPLFYLGYHLEKMAEKAGILYADDTAGWDTRITMADLEDEYTLTELMEGEHKKLAETLFNFAYKNKVALCPRPGKNGGTVLDVISRTDQRGSGQVVTYALNTLTNIKVQLIRMAESEGVLDEEFHDNGMLKWLEKHGRDRLQRLMVSGDDCVVNAIDERFGKSLVWLNEMQKIRKDIDLWKPSAGHCNWEEVEFCSNHFHKLVMRDGRTLVVPCRHEVELVGRASVNQGGSTGISGTACLAKAYAQMWLLLYFHRRDLRILGMAICS

SEQ ID NO: 9116 - protein, 258 aa, unidentified; identical to SEQ ID NO: 8309

SEQ ID NO: 9117 - protein, 35 aa, unidentified
PSGCDSLEIKMISKVFISLRQFNKTNFIMSSIKDP

SEQ ID NO: 9118 - protein, 72 aa, unidentified
PKFPPCRALAAKNQQFLEFPPWLQCIHPHPVLHTMARTNHYVYDWGVANPLGTTEIQRMTSPGGWVARILST

SEQ ID NO: 9119 - protein, 76 aa, unidentified; identical to SEQ ID NO: 9023

SEQ ID NO: 9120 - protein, 48 aa, unidentified; identical to SEQ ID NO: 8590

SEQ ID NO: 9121 - protein, 73 aa, unidentified
MPPLYLLGEDWYQISSRGLIRHSKPATMQQDDVNYEFSVLSGLGNGGLYNDETIALYQEALVSGITSEIVKTR

SEQ ID NO: 9122 - protein, 260 aa, unidentified; identical to SEQ ID NO: 8254

SEQ ID NO: 9123 - protein, 288 aa, unidentified
YKDKIVSRAGGALVANILRTRANTALGFYESCAEWKIFYEGVVFSPYMRQACTGTNGEWSRMKEQFYTKFYEMATRFQCFKFVRVPYIRPAESTQEVAPGCGAGGTINGVEYITDPRNGTIITSVVTDLKITGEYLMPFCYFVYRSRDIWLAENRGYDSDPFLKVYNEQGETLFDWNQLTDGYGEPKAEKMIKCSFIIVEKTSKITIQSWSASQFITRAAYYFNETIPRRPIQVIESKWAQSRMSDPITQESACRRLGDYCIYFRIGTYLGIFDDELGDLQVRDILSG

SEQ ID NO: 9124 - protein, 517 aa, unidentified
MKKTLTDFIMKLIIALTLVSQAIGYPLFVPTRLQGWHDVKLDTLRCPSYASELNKEAAWPQIGLRHLAAKDHYEAKGTICHKTTWVKTCDFRWYGPKYITTKISYTPITGLECQQAIVKASKDELETPYMPEDNCNWATISDNEKTFITVQKSNIFMDPYNMVYVSTVLKGGKCASTVCPLEMHGGIWIPSEAPRDSCNLGSSITSHINPNNASRLVSEESYLVTEYHRQLPFLGACRMSMCGEVGMRFKSGEWYKIESSDGRVQSFLSSVPMCDGELTVSIHDGSATYQKLSQEILDLSAQIACISELRRAREKNAVSNYLLSFLTPNHGGFGTAYRVLNGQLQSSKATYVRVKLGAISTATNWGQLDDGSAYSSEDVTGKIVDGPLFNGNRMDNGTLRVVQNAILGQTLEDEDLYEHSAKEILHPHLTVLSSNESDVLSAFRPVGAQGDIIHAVGEWVGTGVSGFIHTIVYLVILCGIILILYRCLPYLLKKRKSQSTSQTTPQMIPLQQYQFVP

SEQ ID NO: 9125 - protein, 258 aa, unidentified; identical to SEQ ID NO: 8309

SEQ ID NO: 9126 - protein, 482 aa, unidentified
LFTVTLLLPAAAALVGYDCNKKGMGHPYAIGSMSECRKFDKGAISSSAWAGTILQVPKQTQTPHKTCKLLLRSYSMYCTYYNNPTMLEKYSDDVDLTPYIMDEQDCIDAWDKRVFYYQGTQISVNPGGVTKILIGADIDENGFCRTSKGTSTVVKGHIELVWAEVMEVTDLRGQPKRRELDGEGLRWSLTRKSSTTVTGVTVLTNSPPTAMCSWQSIYQGAGELLEYPGSETYVTIPKLSSGFKLITVVTVCGLRVSVTDDPSIFLVNTTAVDVTPANDEFSGRYSSYFKSGLLGLQLILQSGMTTTTRDLLKNQCILEQMIQQNVVHQASKHPGLAAYTLTGVRGWTIILSGAGVILKQCTEVAVVLRPQDECYTDIPITINSTSSPLFLDPTTHIIKISSHTIECDDDSNPIFQVRNQYYRMTPKLVPVRGLPNLPSVLSDLNTTLLSPGTGLYPNEVLNHLDEGMSHISRKEEVERQLL

SEQ ID NO: 9127 - protein, 576 aa, unidentified; identical to SEQ ID NO: 8759

SEQ ID NO: 9128 - protein, 285 aa, unidentified; identical to SEQ ID NO: 8156

SEQ ID NO: 9129 - protein, 67 aa, unidentified
LEDTTPKLRNILDSVLFQLPKMLASIASKINTQTPPPPTTSGHSTALATQCSSNCENRPEIGYDYLR

SEQ ID NO: 9130 - protein, 498 aa, unidentified
QCIDVAKRDFIQGVSGGTWVDVVLDVHGCVTIAAEGKPTVDFKLTKLEMTKLAKVRAYCLTASVSDITVESGCPGTGEIHNTKAKDTSYMCKVSYPDRGWGNGCGLFGKGSMETCAKFACTKQLHGHVISRENIEAEVDISIHGQSAPDSDDASKRKNRKELATATITPQASSIEADMGDFGKVGMDCSLDIGIDFEQVLIVDTASRWWMVKRDWFQDLALPWTSPSADFWHDRDRLVEFGVPHATRQSVYSIGDQEGAFFTAVAKAPSVEWNSDKVKLATGFLKCRIKLGNMKLKGSTYVTCAQAFTFAKRPVDTGHGTVVFQVSYAGTDAPCKIPVAVTDKPNGEHVGRLVTAHPFIAKQNEKAVVEVEPPFGDSYIEIGAGTTKISEAWHKPGSSIGNALALSYKGMKRITAMGEHAWDFGSIGGFFSSMGKAVHHVFGSLFRTLFGGIGWMAKILIGALLIWLGISTRDRMLATSFILTGSILLYLATTTVGVS

SEQ ID NO: 9131 - protein, 190 aa, unidentified
PHHRALIAVTMRLAYQNIAAVFPRTQSKYGSGFVMDFLGRRDQRGSGQVVTFALNTITNGKVQVARVLESEGLLHADESVLDAWLEKHLEEALGNMVIAGEEVVVSTTNRDFSSALEYLELTGKTRKNVPQGAPSRMESDWEKVEFCFHHYHEMCLKDGRILIAPCRHENEVLGRSRLQKGGVVSIPESA

SEQ ID NO: 9132 - protein, 572 aa, unidentified; identical to SEQ ID NO: 8208

SEQ ID NO: 9133 - protein, 577 aa, unidentified; identical to SEQ ID NO: 9016

SEQ ID NO: 9134 - protein, 577 aa, unidentified; identical to SEQ ID NO: 9016

SEQ ID NO: 9135 - protein, 577 aa, unidentified; identical to SEQ ID NO: 9016

SEQ ID NO: 9136 - protein, 577 aa, unidentified; identical to SEQ ID NO: 9016

SEQ ID NO: 9137 - protein, 577 aa, unidentified; identical to SEQ ID NO: 9016

SEQ ID NO: 9138 - protein, 577 aa, unidentified; identical to SEQ ID NO: 9016

SEQ ID NO: 9139 - protein, 260 aa, unidentified; identical to SEQ ID NO: 8254

SEQ ID NO: 9140 - protein, 255 aa, unidentified; identical to SEQ ID NO: 9104

SEQ ID NO: 9141 - protein, 256 aa, unidentified
GVEGIPLFYLGYHLEKMAEKAGILYADDTAGWDTRITMADLEDEYTLTELMEGEHKKLAETLFNFAYKNKVALCPRPGKNGGTVLDVISRTDQRGSGQVVTYALNTLTNIKVQLIRMAESEGVLDEEFHDNGMLKWLEKHGRDRLQRLMVSGDDCVVNAIDERFGKSLVWLNEMQKIRKDIDLWKPSAGHCNWEEVEFCSNHFHKLVMRDGRTLVVPCRHEVELVGRASVNQGGSTGISGTACLAKAYAQMWLLLY

SEQ ID NO: 9142 - protein, 113 aa, unidentified
YESCAEWKIFYEGVVFSPYMRQACTGTNGEWSRMKEQFYTKFYEMATRFQCFKFVRVPYIRPAESTQEVAPGCGAGGTINGVEYITDPRNGTIITSVVTDLKITGEYLMPFCY

SEQ ID NO: 9143 - protein, 285 aa, unidentified; identical to SEQ ID NO: 8156

SEQ ID NO: 9144 - protein, 39 aa, unidentified
RIKYCNQEGLRLHTGEWIGVAWNTKIRDVTLDSYTDTCP

SEQ ID NO: 9145 - protein, 50 aa, unidentified
PDIGNLQMFGTNLVLNEEDGMKICHLNNECSLKLPVVRCMNSSLFRVTCG

SEQ ID NO: 9146 - protein, 50 aa, unidentified; identical to SEQ ID NO: 9145

SEQ ID NO: 9147 - protein, 605 aa, unidentified; identical to SEQ ID NO: 8741

SEQ ID NO: 9148 - protein, 638 aa, unidentified; identical to SEQ ID NO: 8641

SEQ ID NO: 9149 - protein, 638 aa, unidentified; identical to SEQ ID NO: 8641

SEQ ID NO: 9150 - protein, 627 aa, unidentified
GLVGYDCTSSVANITTISLFSVLPCELDQKPQSEYLSVIQVVQQRSVSRVHTFSCLVIRSSVIHHCGMHHHTSVGPMSIGEIMHTSNTQCADLHHFGKLAVGSGTLLTGFKVNETVQISITEHGYSDSEFKCRGTSFSHNGIAYHDAVMKSSYTVTLREEWASLDLDTGDLKMSTGYMHPFKTGQSFDASAGDVFWSTQDNQDCTPTSYLVLHEGAGIIYQGHRDTKTLVVNSSTHAMAVGILGPTLVCHQPALRTEHPKIFIVMKHPGSPSFFFKKSIVDPANVDMFLYINSKLVYLERHMGYQMSLVYEHFHKRTCNIKHQLLRHLIAIAVMNPEEFAWLYSKRPGVTAILRGELIYLMECQAVPVTIRKPSGRCYNELPVTFNNTPMFIKPRSRILVHYGSEIDCSPIVPAGFMIEGRWWALRPDSTQLPAPTTLSAEPEEGKWSYTSPHDLFKSGIYTLEELLAFQKRLLFSFEKPAISHTLSSAAARQPADLSGIDGAGLFHPGQLEEIQKNFMSKIWGWYWNVSVVLGGLVGIYMVFQLIKSVINSIITCTCLYRAYGCGVEILTCCFSSCAKYLLLKRHTDPDFRGGTARIVDWISRRSRPTTQVAQEDSVEAAVQLDDV

SEQ ID NO: 9151 - protein, 423 aa, unidentified
SITDDFTLTSPYLGFCPYCRHSTPCFSPIKIENVWDESDDGSIRIQVSAQFGYNQAGTADVTKFRYMSFDHDHDIKEDSMEKIAISTSGPCRRLGHKGYFLLAQCPPGDSVTVSITSGASENSCTVEKKIRRKFVGREEYLFPPVHGKLVKCHVYDHLKETSAGYITMHRPGPHAYKSYLEEASGEVYIKPPSGKNVTYECKCGDYSTGIVSTRTKMNGCTKAKQCIAYKSDQTKWVFNSPDLIRHTDHSVQGKLHIPFRLTPTVCPVPLAHTPTVTKWFKGITLHLTAMRPTLLTTRKLGLRADATAEWITGSTSRNFSVGREGLEYVWGNHEPVRVWAQESAPGDPHGWPHEIIIHYYHRHPVYTVIVLCGVALAILVGTASSAACIAKARRDCLTPYALAPNATVPTALAVLCCIRPTNA

SEQ ID NO: 9152 - protein, 638 aa, unidentified; identical to SEQ ID NO: 8641

SEQ ID NO: 9153 - protein, 423 aa, unidentified; identical to SEQ ID NO: 9151

SEQ ID NO: 9154 - protein, 638 aa, unidentified; identical to SEQ ID NO: 8641

SEQ ID NO: 9155 - protein, 638 aa, unidentified; identical to SEQ ID NO: 8641

SEQ ID NO: 9156 - protein, 638 aa, unidentified; identical to SEQ ID NO: 8641

SEQ ID NO: 9157 - protein, 50 aa, unidentified
VPLFQIDSFVNKSMSISGLLEHASFIPSPTTLHGCTRIPSFHLGPRHWCY

SEQ ID NO: 9158 - protein, 154 aa, unidentified
GRYVIIFNLILLHRAVSLDNSRLLQQGIMSATEREIKVYTNSITGSIAVRLIPNLPQEVLKCSAGQIKSYNDTLNRIFTPIKANLERLLATPSMLEDNQNPAPEPRLIGAIIGTAALGLATAAQVTAALALNQAQDNAKAILNLKESITKTNEA

SEQ ID NO: 9159 - protein, 501 aa, unidentified; identical to SEQ ID NO: 8222

SEQ ID NO: 9160 - protein, 501 aa, unidentified; identical to SEQ ID NO: 8222

SEQ ID NO: 9161 - protein, 501 aa, unidentified; identical to SEQ ID NO: 8222

SEQ ID NO: 9162 - protein, 154 aa, unidentified; identical to SEQ ID NO: 8743

SEQ ID NO: 9163 - protein, 575 aa, unidentified; identical to SEQ ID NO: 8816
  VARIANT 177: note = Any amino acid
  VARIANT 178: note = Any amino acid
  VARIANT 179: note = Any amino acid
  VARIANT 180: note = Any amino acid
  VARIANT 181: note = Any amino acid
  VARIANT 182: note = Any amino acid
  VARIANT 183: note = Any amino acid
  VARIANT 184: note = Any amino acid
  VARIANT 185: note = Any amino acid
  VARIANT 186: note = Any amino acid
  VARIANT 187: note = Any amino acid
  VARIANT 188: note = Any amino acid

SEQ ID NO: 9164 - protein, 36 aa, unidentified
FWNSDQRFSAINLMDLIRLPFAFLFGGLGFMMKMII

SEQ ID NO: 9165 - protein, 45 aa, unidentified; identical to SEQ ID NO: 8980

SEQ ID NO: 9166 - protein, 45 aa, unidentified; identical to SEQ ID NO: 8980

SEQ ID NO: 9167 - protein, 45 aa, unidentified; identical to SEQ ID NO: 8980

SEQ ID NO: 9168 - protein, 559 aa, unidentified
GYDCTSSVANITTISLFSVLPCELDQKPQSEYLSVIQVVQQRSVSRVHTFSCLVIRSSVIHHCGMHHHTSVGPMSIGEIMHTSNTQCADLHHFGKLAVGSGTLLTGFKVNETVQISITEHGYSDSEFKCRGTSFSHNGIAYHDAVMKSSYTVTLREEWASLDLDTGDLKMSTGYMHPFKTGQSFDASAGDVFWSTQDNQDCTPTSYLVLHEGAGIIYQGHRDTKTLVVNSSTHAMAVGILGPTLVCHQPALRTEHPKIFIVMKHPGSPSFFFKKSIVDPANVDMFLYINSKLVYLERHMGYQMSLVYEHFHKRTCNIKHQLLRHLIAIAVMNPEEFAWLYSKRPGVTAILRGELIYLMECQAVPVTIRKPSGRCYNELPVTFNNTPMFIKPRSRILVHYGSEIDCSPIVPAGFMIEGRWWALRPDSTQLPAPTTLSAEPEEGKWSYTSPHDLFKSGIYTLEELLAFQKRLLFSFEKPAISHTLSSAAARQPADLSGIDGAGLFHPGQLEEIQKNFMSKIWGWYWNVSVVLGGLVGIYMVFQLIKSVINSIITCTCLYRA

SEQ ID NO: 9169 - protein, 45 aa, unidentified; identical to SEQ ID NO: 8980

SEQ ID NO: 9170 - protein, 89 aa, unidentified
GITFKKDIKNIITSSCAGSLNVSSDGVIYQVLSAYNKTSLSDRLSGLLSSNINMNQLIHVINDALISIEDAYCSSTCDVMEIILSNYPT

SEQ ID NO: 9171 - protein, 173 aa, unidentified
RVISAKSRAYMESFTCTQLLPVIKDTGKLYANQLMLLRPHVEGAVTVYVIHGEDHKISSCKGWYSYTDSVERDLVNDVSTKVLVKHFGEEFYTSFGYWKNSSWHRYNNILGHLEDKIVSKANLQHWEQSPLKYHYEDLGLKETKIHQSGVESESTYPLPSFPWLDFKKLMYHP

SEQ ID NO: 9172 - protein, 45 aa, unidentified; identical to SEQ ID NO: 8980

SEQ ID NO: 9173 - protein, 81 aa, unidentified
HLHIKDHRYINRETEQTEFSILLSVECSKTKDDLLSQTSINRVQLQSLTPRIPGRHRVYRFHNNTLQMGYSEYKWVRTEKS

SEQ ID NO: 9174 - protein, 45 aa, unidentified; identical to SEQ ID NO: 8980

SEQ ID NO: 9175 - protein, 199 aa, unidentified
QVFDLSQNFSGLHCLQQKQNCTIVTSSSGTNSTRCLTVPLSVLHRQKRSETASLTSTTSFISLISLDTGYSDSTALWQSITRIQDVMLMLESIVANLSANQAILAGEINIDQKTIKNILGDLQEHGLKLTRAEKSFNNTHLCVMRNESHDLTHFIRINHTYSDGSHFHDCKSLILVNDSLSGLIHLTKLAHQEALEGMR

SEQ ID NO: 9176 - protein, 89 aa, unidentified; identical to SEQ ID NO: 9170

SEQ ID NO: 9177 - protein, 45 aa, unidentified; identical to SEQ ID NO: 8980

SEQ ID NO: 9178 - protein, 288 aa, unidentified; identical to SEQ ID NO: 9123

SEQ ID NO: 9179 - protein, 324 aa, unidentified
GEFGVAKGSRTIWYMWLGSRFLEFEALGFLNEERWASRDISGGGVEGIGINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCSHHFHELFLRDGRKLIVPCRDQHELVGRSMVSQGGSSGVAGTACLAKAYAQMWLMSYFHRRDLRTLGFGIMSSVPKDWFPTG

SEQ ID NO: 9180 - protein, 74 aa, unidentified; identical to SEQ ID NO: 8840

SEQ ID NO: 9181 - protein, 324 aa, unidentified; identical to SEQ ID NO: 9179

SEQ ID NO: 9182 - protein, 324 aa, unidentified; identical to SEQ ID NO: 9179

SEQ ID NO: 9183 - protein, 324 aa, unidentified; identical to SEQ ID NO: 9179

SEQ ID NO: 9184 - protein, 224 aa, unidentified
GDFGVAKGSRTIWYMWLGSRFLEFESFGFLNEEHWASRELSGGGVEGIPLNYLGYHLREMAQKPGVLYADDTAGWDTRITMADLEDEGILLDMMSGEHKKLASALFSKAYKVKVALCPRPGPKGGTLMDVISRTDQRGSGQVVTYALNTLTNIKVQLIRMAEAEGVLGATFEDFGIDRWLQEHGEDRVERMLVSGDDCVVNAIDERFGSSLNWLNAMEKVRKDI

SEQ ID NO: 9185 - protein, 324 aa, unidentified; identical to SEQ ID NO: 9179

SEQ ID NO: 9186 - protein, 565 aa, unidentified; identical to SEQ ID NO: 8390

SEQ ID NO: 9187 - protein, 635 aa, unidentified
MYKSTYLLLLLSLSRLIQVSAIIGFDCTDPSSNVTAVSLTQIGDCVVRNRNVTTTTTNIRVYQSLDFTMTTVYSCLIEMSHIISRCGKSIDQFHSGGFYSEIPSITRATCLDMIDTGKINLHGNSMEGIEVGVPYSVALMTYGTIDQDGSCTTPGDLIVNGRVFTRAIRNTNIKILVTKYQANVDIDQSELKLSTGIVCPFLKRECFSAQTGYNYWNSFLENIVCEGTRPLVQLYEGPATKAIESINSHPIQTYMFKRDKSDFAIGANNPGQFCGYNDIIQTDHPNLYIVEEKNWNLVKLKTRKLMTTDIDITAYMNSKMLYIVNHVTNQVNNLYDAYLKDRCKTEESVLRQTLTLAYMSPNDFAYDFMKGPGYTATVSGEVIYIIKCQAKSVNYRPVSETCYKELPVLIDNKPGFVMPKTHLITMIGTEIPCNPLLPPVFLLGEYWYSPSHQLIRSTPPLVLKPSEPHVWQFEQISNLISSGIYSAEDLHLYRKAFLAPDGEKAFIGTFAKKTIRWNGDDYTGNVVNSFNEHDIDLLNERLGNWFHNMYRKLGNFGSFMVSIFIIGRFLLWIINLFLNCVKLRMEGRPMTDGLFVWWDRMLDFMQVRRMYVQRKQQDKTDAQHETALREILSDP

SEQ ID NO: 9188 - protein, 266 aa, unidentified; identical to SEQ ID NO: 8360

SEQ ID NO: 9189 - protein, 266 aa, unidentified; identical to SEQ ID NO: 8360

SEQ ID NO: 9190 - protein, 123 aa, unidentified
DVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCSHHFHELFL

SEQ ID NO: 9191 - protein, 285 aa, unidentified; identical to SEQ ID NO: 8156

SEQ ID NO: 9192 - protein, 285 aa, unidentified; identical to SEQ ID NO: 8156

SEQ ID NO: 9193 - protein, 245 aa, unidentified
KPGEFGVAKGSRTIWYMWLGSRFLEFEALGFLNEERWASRDISGGGVEGIGINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCS

SEQ ID NO: 9194 - protein, 337 aa, unidentified; identical to SEQ ID NO: 8339

SEQ ID NO: 9195 - protein, 337 aa, unidentified; identical to SEQ ID NO: 8339

SEQ ID NO: 9196 - protein, 501 aa, unidentified; identical to SEQ ID NO: 8222

SEQ ID NO: 9197 - protein, 504 aa, unidentified; identical to SEQ ID NO: 8334

SEQ ID NO: 9198 - protein, 39 aa, unidentified
MEERPIKPTEIVCPKRYNELSLEAHHTLIEGEEKIEQIC

SEQ ID NO: 9199 - protein, 321 aa, unidentified
KGSRTIWYMWLGSRFLEFESFGFLNEEHWASRELCGGGVEGIPLFYLGYHLEKMAEKAGILYADDTAGWDTRITMADLEDEYTLTELMEGEHKKLAETLFNFAYKNKVALCPRPGKNGGTVLDVISRTDQRGSGQVVTYALNTLTNIKVQLIRMAESEGVLDEEFHDNGMLKWLEKHGRDRLQRLMVSGDDCVVNAIDERFGKSLVWLNEMQKIRKDIDLWKPSAGHCNWEEVEFCSNHFHKLVMRDGRTLVVPCRHEVELVGRASVNQGGSTGISGTACLAKAYAQMWLLLYFHRRDLRILGMAICSAVPANWVPTGRTT

SEQ ID NO: 9200 - protein, 312 aa, unidentified
LDGTRHQCTTVFEHQVTEKFTRERSKGHHLSDLTKKCTRFSTTPKKSALYLVDVYDALPTSVEISTVVTCNERQCTVRVPPGTTVKFDKRCKNAAKETVTFTSDSQTFTCEEPVLTAASITQGKPHLRSSMLPSGGKEVKARIPFPFPPETATCRVSIAPLPSITYEESDVLLAGTAKYPVLLTTRNLGFHSNATSEWIQGKYLRRIPVTPQGIELMLGNNAPLHFWSSVRYASGDADAYPWELLVHHIKHHPEYAWAFVGVACGLLAVAACMFACACNRVRYSLLANTFNPNPPPLTALTAALCCIPGARA

SEQ ID NO: 9201 - protein, 438 aa, unidentified
AVSTSPVAVYDTQILAAHAAASPYRAYCPDCDGTACISPIAIDEVVSSGSDHVLRIRVGSQSGVTAKGGAAGETSLRYLGRDGKVYAADNTRLVVRTTAKCDVLQATGHYILANCPVGQSLTVAATLDGTRHQCTTVFEHQVTEKFTRERSKGHHLSDLTKKCTRFSTTPKKSALYLVDVYDALPTSVEISTVVTCNERQCTVRVPPGTTVKFDKRCKNAAKETVTFTSDSQTFTCEEPVLTAASITQGKPHLRSSMLPSGGKEVKARIPFPFPPETATCRVSIAPLPSITYEESDVLLAGTAKYPVLLTTRNLGFHSNATSEWIQGKYLRRIPVTPQGIELMLGNNAPLHFWSSVRYASGDADAYPWELLVHHIKHHPEYAWAFVGVACGLLAVAACMFACACNRVRYSLLANTFNPNPPPLTALTAALCCIPGARA

SEQ ID NO: 9202 - protein, 88 aa, unidentified
AVSTSPVAVYDTQILAAHAAASPYRAYCPDCDGTACISPIAIDEVVSSGSDHVLRIRVGSQSGVTAKGGAAGETSLRYLGRDGKVYAA

SEQ ID NO: 9203 - protein, 438 aa, unidentified; identical to SEQ ID NO: 9201

SEQ ID NO: 9204 - protein, 438 aa, unidentified; identical to SEQ ID NO: 9201

SEQ ID NO: 9205 - protein, 149 aa, unidentified
GINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDD

SEQ ID NO: 9206 - protein, 288 aa, unidentified; identical to SEQ ID NO: 9123

SEQ ID NO: 9207 - protein, 262 aa, unidentified
KPGEFGVAKGSRTIWYMWLGSRFLEFEALGFLNEERWASRDISGGGVEGIGINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCSHHFHELFLRDGRKLIVP

SEQ ID NO: 9208 - protein, 293 aa, unidentified; identical to SEQ ID NO: 8158

SEQ ID NO: 9209 - protein, 293 aa, unidentified; identical to SEQ ID NO: 8158

SEQ ID NO: 9210 - protein, 293 aa, unidentified; identical to SEQ ID NO: 8158

SEQ ID NO: 9211 - protein, 293 aa, unidentified; identical to SEQ ID NO: 8158

SEQ ID NO: 9212 - protein, 293 aa, unidentified; identical to SEQ ID NO: 8158

SEQ ID NO: 9213 - protein, 293 aa, unidentified; identical to SEQ ID NO: 8158

SEQ ID NO: 9214 - protein, 293 aa, unidentified; identical to SEQ ID NO: 8158

SEQ ID NO: 9215 - protein, 293 aa, unidentified; identical to SEQ ID NO: 8158

SEQ ID NO: 9216 - protein, 293 aa, unidentified; identical to SEQ ID NO: 8158

SEQ ID NO: 9217 - protein, 293 aa, unidentified; identical to SEQ ID NO: 8158

SEQ ID NO: 9218 - protein, 293 aa, unidentified; identical to SEQ ID NO: 8158

SEQ ID NO: 9219 - protein, 293 aa, unidentified; identical to SEQ ID NO: 8158

SEQ ID NO: 9220 - protein, 293 aa, unidentified; identical to SEQ ID NO: 8158

SEQ ID NO: 9221 - protein, 285 aa, unidentified; identical to SEQ ID NO: 8156

SEQ ID NO: 9222 - protein, 285 aa, unidentified; identical to SEQ ID NO: 8156

SEQ ID NO: 9223 - protein, 285 aa, unidentified; identical to SEQ ID NO: 8156

SEQ ID NO: 9224 - protein, 285 aa, unidentified; identical to SEQ ID NO: 8156

SEQ ID NO: 9225 - protein, 285 aa, unidentified; identical to SEQ ID NO: 8156

SEQ ID NO: 9226 - protein, 285 aa, unidentified; identical to SEQ ID NO: 8156

SEQ ID NO: 9227 - protein, 285 aa, unidentified; identical to SEQ ID NO: 8156

SEQ ID NO: 9228 - protein, 285 aa, unidentified; identical to SEQ ID NO: 8156

SEQ ID NO: 9229 - protein, 285 aa, unidentified; identical to SEQ ID NO: 8156

SEQ ID NO: 9230 - protein, 252 aa, unidentified
IFYEGVVFSPYMRQACTGTNGEWSRMKEQFYTKFYEMATRFQCFKFVRVPYIRPAESTQEVAPGCGAGGTINGVEYITDPRNGTIITSVVTDLKITGEYLMPFCYFVYRSRDIWLAENRGYDSDPFLKVYNEQGETLFDWNQLTDGYGEPKAEKMIKCSFIIVEKTSKITIQSWSASQFITRAAYYFNETIPRRPIQVIESKWAQSRMSDPITQESACRRLGDYCIYFRIGTYLGIFDDELGDLQVRDILSG

SEQ ID NO: 9231 - protein, 293 aa, unidentified; identical to SEQ ID NO: 8158

SEQ ID NO: 9232 - protein, 285 aa, unidentified; identical to SEQ ID NO: 8156

SEQ ID NO: 9233 - protein, 293 aa, unidentified; identical to SEQ ID NO: 8158

SEQ ID NO: 9234 - protein, 293 aa, unidentified; identical to SEQ ID NO: 8158

SEQ ID NO: 9235 - protein, 293 aa, unidentified; identical to SEQ ID NO: 8158

SEQ ID NO: 9236 - protein, 293 aa, unidentified; identical to SEQ ID NO: 8158

SEQ ID NO: 9237 - protein, 502 aa, unidentified; identical to SEQ ID NO: 8762

SEQ ID NO: 9238 - protein, 285 aa, unidentified; identical to SEQ ID NO: 8156

SEQ ID NO: 9239 - protein, 501 aa, unidentified; identical to SEQ ID NO: 8335

SEQ ID NO: 9240 - protein, 248 aa, unidentified; identical to SEQ ID NO: 8593

SEQ ID NO: 9241 - protein, 248 aa, unidentified; identical to SEQ ID NO: 8593

SEQ ID NO: 9242 - protein, 248 aa, unidentified; identical to SEQ ID NO: 8593

SEQ ID NO: 9243 - protein, 248 aa, unidentified; identical to SEQ ID NO: 8593

SEQ ID NO: 9244 - protein, 248 aa, unidentified; identical to SEQ ID NO: 8593

SEQ ID NO: 9245 - protein, 248 aa, unidentified; identical to SEQ ID NO: 8593

SEQ ID NO: 9246 - protein, 220 aa, unidentified
DTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCSHHFHELFLRDGRKLIVPCRDQHELVGRSMVSQGGSSGVAGTACLAKA

SEQ ID NO: 9247 - protein, 174 aa, unidentified; identical to SEQ ID NO: 8195

SEQ ID NO: 9248 - protein, 319 aa, unidentified; identical to SEQ ID NO: 8858

SEQ ID NO: 9249 - protein, 258 aa, unidentified; identical to SEQ ID NO: 8309

SEQ ID NO: 9250 - protein, 565 aa, unidentified; identical to SEQ ID NO: 8390

SEQ ID NO: 9251 - protein, 565 aa, unidentified; identical to SEQ ID NO: 8390

SEQ ID NO: 9252 - protein, 565 aa, unidentified; identical to SEQ ID NO: 8390

SEQ ID NO: 9253 - protein, 565 aa, unidentified; identical to SEQ ID NO: 8390

SEQ ID NO: 9254 - protein, 565 aa, unidentified; identical to SEQ ID NO: 8390

SEQ ID NO: 9255 - protein, 565 aa, unidentified; identical to SEQ ID NO: 8390

SEQ ID NO: 9256 - protein, 422 aa, unidentified
STEELFKEYKLTKPYMAKCIRCAVGSCHSPIAIEEVRSDGHDGYIRIQTSSQYGLDPSGGVKSRTMRYNLQGNIEEIPLHEVSLHTSRPCHIIDGHGYFLLARCPEGDSLTMEFKKDTVTHSCSVPYKVKFIPVGRELYTHPPEHGTDHPCRVYAHDAQKRGAYVEMHLPGSEVDSTLLSMSGGAVQVNPPAGTNVLVECNCGTQISETVSTVKKFNQCTQTNRCRAYRLQSDKWVFNSDKLPKASGDTLKGKLHVPFLLSEAKCTVPLAPEPVVSFGFRSVSLKLHPNNPTYLTTRHLGGEPQYTHELISEPVVKNFSITEKGWEFVWGNHPPQRFWAQETAPGNPHGMPHEIVTHYYYRYPMSTVVGLSICAAIVIISIAASLCLLCKSRVSCLTPYRLTPNARLPICLALLCCARPTRA

SEQ ID NO: 9257 - protein, 422 aa, unidentified; identical to SEQ ID NO: 9256

SEQ ID NO: 9258 - protein, 422 aa, unidentified; identical to SEQ ID NO: 9256

SEQ ID NO: 9259 - protein, 415 aa, unidentified
FTQYKLARPYIADCSNCGHGRCDSPIAIEDIRGDAHAGYIRIQTSAMFGLKSDGVDLAYMSFMNGKTLKAIKIEHLYARTSAPCSLVSYHGYYILAQCPPGDTVTVGFQDGANKHMCTIAHKVEFKPVGREKYRHPPEHGVELPCTKYTHKRADQGHYVEMHQPGLVADHSLLSMSSTKVKITVPSGSQVKYYCKCPDVKEGTTGSDYTTACTNLKQCRAYLIDNKKWVYNSGKLPRGEGETFKGKLHVPFVPVTSKCTATLAPEPLVEHKHRSLILHLHPEHPTLLTTRALGSNARPTRQWIEQPTTVNFTVTGEGFEYTWGNHPPKRVWAQESGEGNPHGWPHEIVIYYYNRYPMTTVIGLCTCVAIIMVSCVTSVWLLCRTRNLCITPYRLAPNAQVPILLAVLCCVKPTRA

SEQ ID NO: 9260 - protein, 209 aa, unidentified
FTQYKLARPYIADCSNCGHGRCDSPIAIEDIRGDAHAGYIRIQTSAMFGLKSDGVDLAYMSFMNGKTLKAIKIEHLYARTSAPCSLVSYHGYYILAQCPPGDTVTVGFQDGANKHMCTIAHKVEFKPVGREKYRHPPEHGVELPCTKYTHKRADQGHYVEMHQPGLVADHSLLSMSSTKVKITVPSGSQVKYYCKCPDVKEGTTGSDYT

SEQ ID NO: 9261 - protein, 285 aa, unidentified; identical to SEQ ID NO: 8156

SEQ ID NO: 9262 - protein, 285 aa, unidentified; identical to SEQ ID NO: 8156

SEQ ID NO: 9263 - protein, 573 aa, unidentified
  VARIANT 462: note = Any amino acid
  VARIANT 463: note = Any amino acid
  VARIANT 464: note = Any amino acid
  VARIANT 465: note = Any amino acid
  VARIANT 466: note = Any amino acid
MQDSHGNTQILNQANSMVKRTWRLLFGIATLILLVSIFVLSLIIVLQSTPGNLQNDINIIRKELNELMENFETTSKSLLSVSNQITYDVSVLTPIRQEAIETNIISKIKDHCKDRVIKEGSTCTLNGSPLHDVSFLNGFNKFYFTYKDNMQIKFKSLLDYPNFIPTATTPHGCIRIPSFSLGQTHWCYTHNINLLGCADPASSNQYVSLGTLQVLKMGDPYFKVEHSHYLNDGRNRKGCSVVAVPDGCLRNCVTMTKNETENFKDLNWQHNYLHTYHIMVPLKTRIINPPGSSRDWVHIAPGVGSGLLYAKLLIFPLYGGLTEKSVIHNNQSGKYFFPNSTKLQCRNSTMEKIKGAKDSYTITYFSGRLIQSAFLVCDLRQFLSEDCEILIPSNDYMMVGAEGRLYNIENNIFYYQRGSSWWPYPSLYRIRLNLSKKYPRITEIKFTKIEIAPRPGNKDCPXXXXXPKECITGVYQDILPLSYPNTAFPHLKQAYYTGFYLNNSLERRNPTFYTADNLDYHQQERLGKFNLTAGYSTTTCFKQTTTARLYCLYIIEVGDSVIGDFQITLFLAA

SEQ ID NO: 9264 - protein, 575 aa, unidentified; identical to SEQ ID NO: 8301
  VARIANT 178: note = Any amino acid
  VARIANT 179: note = Any amino acid
  VARIANT 180: note = Any amino acid
  VARIANT 181: note = Any amino acid
  VARIANT 182: note = Any amino acid
  VARIANT 183: note = Any amino acid
  VARIANT 184: note = Any amino acid
  VARIANT 185: note = Any amino acid
  VARIANT 186: note = Any amino acid
  VARIANT 187: note = Any amino acid
  VARIANT 188: note = Any amino acid
  VARIANT 189: note = Any amino acid
  VARIANT 190: note = Any amino acid
  VARIANT 509: note = Any amino acid
  VARIANT 510: note = Any amino acid
  VARIANT 511: note = Any amino acid
  VARIANT 512: note = Any amino acid

SEQ ID NO: 9265 - protein, 74 aa, unidentified; identical to SEQ ID NO: 8267

SEQ ID NO: 9266 - protein, 248 aa, unidentified; identical to SEQ ID NO: 8593

SEQ ID NO: 9267 - protein, 258 aa, unidentified; identical to SEQ ID NO: 8309

SEQ ID NO: 9268 - protein, 248 aa, unidentified; identical to SEQ ID NO: 8593

SEQ ID NO: 9269 - protein, 248 aa, unidentified; identical to SEQ ID NO: 8593

SEQ ID NO: 9270 - protein, 248 aa, unidentified; identical to SEQ ID NO: 8593

SEQ ID NO: 9271 - protein, 258 aa, unidentified; identical to SEQ ID NO: 8309

SEQ ID NO: 9272 - protein, 21 aa, unidentified
MKCLLYLAFLSIGVNCKFTIV

SEQ ID NO: 9273 - protein, 258 aa, unidentified; identical to SEQ ID NO: 8309

SEQ ID NO: 9274 - protein, 127 aa, unidentified; identical to SEQ ID NO: 8594

SEQ ID NO: 9275 - protein, 248 aa, unidentified; identical to SEQ ID NO: 8593

SEQ ID NO: 9276 - protein, 258 aa, unidentified; identical to SEQ ID NO: 8309

SEQ ID NO: 9277 - protein, 20 aa, unidentified
MKCLLYLAFLSIGVNCKFTI

SEQ ID NO: 9278 - protein, 22 aa, unidentified
MKCLLYLAFLSIGVNCKFTIVF

SEQ ID NO: 9279 - protein, 22 aa, unidentified
MKCLLYLAFLSIGVNCKFTIVF

SEQ ID NO: 9280 - protein, 258 aa, unidentified; identical to SEQ ID NO: 8309

SEQ ID NO: 9281 - protein, 22 aa, unidentified
MKCLLYLAFLSIGVNCKFTIVF

SEQ ID NO: 9282 - protein, 22 aa, unidentified
MKCLLYLAFLSIGVNCKFTIVF

SEQ ID NO: 9283 - protein, 22 aa, unidentified
MKCLLYLAFLSIGVNCKFTIVF

SEQ ID NO: 9284 - protein, 22 aa, unidentified
MKCLLYLAFLSIGVNCKFTIVF

SEQ ID NO: 9285 - protein, 229 aa, unidentified; identical to SEQ ID NO: 8171

SEQ ID NO: 9286 - protein, 272 aa, unidentified; identical to SEQ ID NO: 8319

SEQ ID NO: 9287 - protein, 199 aa, unidentified; identical to SEQ ID NO: 8585

SEQ ID NO: 9288 - protein, 337 aa, unidentified; identical to SEQ ID NO: 8339

SEQ ID NO: 9289 - protein, 145 aa, unidentified
PHHRALIAVTMRLAYQNIAAVFPRTQSKYGSGFVMDFLGRRDQRGSGQVVTFALNTITNGKVQVARVLESEGLLHADESVLDAWLEKHLEEALGNMVIAGEEVVVSTTNRDFSSALEYLELTGKTRKNVPQGAPSRMESDWEKVE

SEQ ID NO: 9290 - protein, 337 aa, unidentified; identical to SEQ ID NO: 8339

SEQ ID NO: 9291 - protein, 203 aa, unidentified
KPGEFGVAKGSRTIWYMWLGSRFLEFEALGFLNEERWASRDISGGGVEGIGINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVN

SEQ ID NO: 9292 - protein, 337 aa, unidentified; identical to SEQ ID NO: 8339

SEQ ID NO: 9293 - protein, 337 aa, unidentified; identical to SEQ ID NO: 8339

SEQ ID NO: 9294 - protein, 145 aa, unidentified; identical to SEQ ID NO: 9289

SEQ ID NO: 9295 - protein, 174 aa, unidentified; identical to SEQ ID NO: 8195

SEQ ID NO: 9296 - protein, 198 aa, unidentified
PGEFGVAKGSRTIWYMWLGSRFLEFEALGFLNEERWASRDISGGGVEGIGINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDD

SEQ ID NO: 9297 - protein, 337 aa, unidentified; identical to SEQ ID NO: 8339

SEQ ID NO: 9298 - protein, 199 aa, unidentified; identical to SEQ ID NO: 8585

SEQ ID NO: 9299 - protein, 337 aa, unidentified; identical to SEQ ID NO: 8339

SEQ ID NO: 9300 - protein, 337 aa, unidentified; identical to SEQ ID NO: 8339

SEQ ID NO: 9301 - protein, 333 aa, unidentified; identical to SEQ ID NO: 8351

SEQ ID NO: 9302 - protein, 333 aa, unidentified; identical to SEQ ID NO: 8351

SEQ ID NO: 9303 - protein, 235 aa, unidentified
KPGEFGVAKGSRTIWYMWLGSRFLEFEALGFLNEERWASRDISGGGVEGIGINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAY

SEQ ID NO: 9304 - protein, 309 aa, unidentified; identical to SEQ ID NO: 8830

SEQ ID NO: 9305 - protein, 337 aa, unidentified; identical to SEQ ID NO: 8339

SEQ ID NO: 9306 - protein, 337 aa, unidentified; identical to SEQ ID NO: 8339

SEQ ID NO: 9307 - protein, 337 aa, unidentified; identical to SEQ ID NO: 8339

SEQ ID NO: 9308 - protein, 337 aa, unidentified; identical to SEQ ID NO: 8339

SEQ ID NO: 9309 - protein, 337 aa, unidentified; identical to SEQ ID NO: 8339

SEQ ID NO: 9310 - protein, 337 aa, unidentified; identical to SEQ ID NO: 8339

SEQ ID NO: 9311 - protein, 337 aa, unidentified; identical to SEQ ID NO: 8339

SEQ ID NO: 9312 - protein, 337 aa, unidentified; identical to SEQ ID NO: 8339

SEQ ID NO: 9313 - protein, 242 aa, unidentified
VAKGSRTIWYMWLGSRFLEFESFGFLNEEHWASRELCGGGVEGIPLFYLGYHLEKMAEKAGILYADDTAGWDTRITMADLEDEYTLTELMEGEHKKLAETLFNFAYKNKVALCPRPGKNGGTVLDVISRTDQRGSGQVVTYALNTLTNIKVQLIRMAESEGVLDEEFHDNGMLKWLEKHGRDRLQRLMVSGDDCVVNAIDERFGKSLVWLNEMQKIRKDIDLWKPSAGHCNWEEVEFCSNHF

SEQ ID NO: 9314 - protein, 192 aa, unidentified
SRTIWYMWLGSRFLEFESFGFLNEEHWASRELCGGGVEGIPLFYLGYHLEKMAEKAGILYADDTAGWDTRITMADLEDEYTLTELMEGEHKKLAETLFNFAYKNKVALCPRPGKNGGTVLDVISRTDQRGSGQVVTYALNTLTNIKVQLIRMAESEGVLDEEFHDNGMLKWLEKHGRDRLQRLMVSGDDCVV

SEQ ID NO: 9315 - protein, 231 aa, unidentified
PHHRALIAVTMRLAYQNIAAVFPRTQSKYGSGFVMDFLGRRDQRGSGQVVTFALNTITNGKVQVARVLESEGLLHADESVLDAWLEKHLEEALGNMVIAGEEVVVSTTNRDFSSALEYLELTGKTRKNVPQGAPSRMESDWEKVEFCFHHYHEMCLKDGRILIAPCRHENEVLGRSRLQKGGVVSIPESACMAKAYAQMWALYFFHRRDLRLGFIAISSAVPTNWFPLGRT

SEQ ID NO: 9316 - protein, 337 aa, unidentified; identical to SEQ ID NO: 8339

SEQ ID NO: 9317 - protein, 248 aa, unidentified; identical to SEQ ID NO: 8593

SEQ ID NO: 9318 - protein, 337 aa, unidentified; identical to SEQ ID NO: 8339

SEQ ID NO: 9319 - protein, 337 aa, unidentified; identical to SEQ ID NO: 8339

SEQ ID NO: 9320 - protein, 75 aa, unidentified
QESLNILEKIVANLSSNQMILSDQVTIDQSTIENILSDLTEHGLRLNEAEKSFNNSHLCIVRNETHDVNHLLRVT

SEQ ID NO: 9321 - protein, 310 aa, unidentified
VAKGSRTIWYMWLGSRFLEFESFGFLNEEHWASRELCGGGVEGIPLFYLGYHLEKMAEKAGILYADDTAGWDTRITMADLEDEYTLTELMEGEHKKLAETLFNFAYKNKVALCPRPGKNGGTVLDVISRTDQRGSGQVVTYALNTLTNIKVQLIRMAESEGVLDEEFHDNGMLKWLEKHGRDRLQRLMVSGDDCVVNAIDERFGKSLVWLNEMQKIRKDIDLWKPSAGHCNWEEVEFCSNHFHKLVMRDGRTLVVPCRHEVELVGRASVNQGGSTGISGTACLAKAYAQMWLLLYFHRRDLRILGMAICS

SEQ ID NO: 9322 - protein, 337 aa, unidentified; identical to SEQ ID NO: 8339

SEQ ID NO: 9323 - protein, 337 aa, unidentified; identical to SEQ ID NO: 8339

SEQ ID NO: 9324 - protein, 310 aa, unidentified; identical to SEQ ID NO: 9321

SEQ ID NO: 9325 - protein, 310 aa, unidentified; identical to SEQ ID NO: 9321

SEQ ID NO: 9326 - protein, 122 aa, unidentified
PHHRALIAVTMRLAYQNIAAVFPRTQSKYGSGFVMDFLGRRDQRGSGQVVTFALNTITNGKVQVARVLESEGLLHADESVLDAWLEKHLEEALGNMVIAGEEVVVSTTNRDFSSALEYLELT

SEQ ID NO: 9327 - protein, 337 aa, unidentified; identical to SEQ ID NO: 8339

SEQ ID NO: 9328 - protein, 310 aa, unidentified; identical to SEQ ID NO: 9321

SEQ ID NO: 9329 - protein, 231 aa, unidentified; identical to SEQ ID NO: 9315

SEQ ID NO: 9330 - protein, 337 aa, unidentified; identical to SEQ ID NO: 8339

SEQ ID NO: 9331 - protein, 337 aa, unidentified; identical to SEQ ID NO: 8339

SEQ ID NO: 9332 - protein, 337 aa, unidentified; identical to SEQ ID NO: 8339

SEQ ID NO: 9333 - protein, 337 aa, unidentified; identical to SEQ ID NO: 8339

SEQ ID NO: 9334 - protein, 337 aa, unidentified; identical to SEQ ID NO: 8339

SEQ ID NO: 9335 - protein, 337 aa, unidentified; identical to SEQ ID NO: 8339

SEQ ID NO: 9336 - protein, 337 aa, unidentified; identical to SEQ ID NO: 8339

SEQ ID NO: 9337 - protein, 337 aa, unidentified; identical to SEQ ID NO: 8339

SEQ ID NO: 9338 - protein, 337 aa, unidentified; identical to SEQ ID NO: 8339

SEQ ID NO: 9339 - protein, 283 aa, unidentified
KPGEFGVAKGSRTIWYMWLGSRFLEFEALGFLNEERWASRDISGGGVEGIGINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCSHHFHELFLRDGRKLIVPCRDQHELVGRSMVSQGGSSGV

SEQ ID NO: 9340 - protein, 337 aa, unidentified; identical to SEQ ID NO: 8339

SEQ ID NO: 9341 - protein, 337 aa, unidentified; identical to SEQ ID NO: 8339

SEQ ID NO: 9342 - protein, 337 aa, unidentified; identical to SEQ ID NO: 8339

SEQ ID NO: 9343 - protein, 337 aa, unidentified; identical to SEQ ID NO: 8339

SEQ ID NO: 9344 - protein, 259 aa, unidentified
AKGSRTIWYMWLGSRFLEFEALGFLNEERWASRDISGGGVEGIGINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCSHHFHELFLRDGRKLIVPCRDQ

SEQ ID NO: 9345 - protein, 107 aa, unidentified
PLSNLQCPRHPSERTLRNSRFGKGWILKQNIVDVPGLFVVKQKWKTACHMNFLGIKTIKHEIISEELTATDFTNYTTTPTFPNEECNWMTDTVKETTHFIASRGTLA

SEQ ID NO: 9346 - protein, 218 aa, unidentified
KGSRTIWYMWLGSRFLEFESFGFLNEEHWASRELSGGGVEGIPLNYLGYHLREMAQKPGVLYADDTAGWDTRITMADLEDEGILLDMMSGEHKKLASALFSKAYKVKVALCPRPGPKGGTLMDVISRTDQRGSGQVVTYALNTLTNIKVQLIRMAEAEGVLGATFEDFGIDRWLQEHGEDRVERMLVSGDDCVVNAIDERFGSSLNWLNAMEKVRKDI

SEQ ID NO: 9347 - protein, 83 aa, unidentified
FQNISFNMIAEFENLSALICDGGSRKQYEFRRLSMSSNGWNIFNKFNNKSKISATGFSYPVHSVWKNGKRTKRGDSSLFSSLS

SEQ ID NO: 9348 - protein, 89 aa, unidentified; identical to SEQ ID NO: 8257

SEQ ID NO: 9349 - protein, 89 aa, unidentified; identical to SEQ ID NO: 8257

SEQ ID NO: 9350 - protein, 337 aa, unidentified; identical to SEQ ID NO: 8339

SEQ ID NO: 9351 - protein, 279 aa, unidentified
GVESIPLFYLGYHLREMAKKPGKLYADDTAGWDTRITEADLDDECILCDYMEDEHKQLALSLFELCYKNKVALCPRPGRHGGTVMDVIFRRDQRGSGQVVTYALNTLTNIKVQLIRLAESEGVLDEDFNDHGIETWLNHYGEERLSRLLISGDDCLVNAFDERFGKALTWLNTMEKIRKDIDLCAPSNGYENFEKVEFCSNHFHELMLKDGRQLVVPCRSQNELVGRASVNQGGSATVAGTACLAKAYAQMWNLLYFHRRDLRLLGFAIMSATPSNWIP

SEQ ID NO: 9352 - protein, 22 aa, unidentified
MKCLLYLAFLSIGVNCKFTIVF

SEQ ID NO: 9353 - protein, 24 aa, unidentified
MKCLLYLAFLSIGVNCKFTIVFPH

SEQ ID NO: 9354 - protein, 22 aa, unidentified
MKCLLYLAFLSIGVNCKFTIVF

SEQ ID NO: 9355 - protein, 248 aa, unidentified; identical to SEQ ID NO: 8593

SEQ ID NO: 9356 - protein, 22 aa, unidentified
MKCLLYLAFLSIGVNCKFTIVF

SEQ ID NO: 9357 - protein, 258 aa, unidentified; identical to SEQ ID NO: 8309

SEQ ID NO: 9358 - protein, 217 aa, unidentified
GFLNEERWASRDISGGGVEGIGINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCSH

SEQ ID NO: 9359 - protein, 28 aa, unidentified
MKCLLYLAFLSIGVNCKFTIVFPHNQKG

SEQ ID NO: 9360 - protein, 31 aa, unidentified
MKCLLYLAFLSIGVNCKFTIVFPHNQKGTWK

SEQ ID NO: 9361 - protein, 258 aa, unidentified; identical to SEQ ID NO: 8309

SEQ ID NO: 9362 - protein, 337 aa, unidentified; identical to SEQ ID NO: 8339

SEQ ID NO: 9363 - protein, 258 aa, unidentified; identical to SEQ ID NO: 8309

SEQ ID NO: 9364 - protein, 268 aa, unidentified
PLFYLGYHLREMAKKPGKLYADDTAGWDTRITEADLDDECILCDYMEDEHKQLALSLFELCYKNKVALCPRPGRHGGTVMDVIFRRDQRGSGQVVTYALNTLTNIKVQLIRLAESEGVLDEDFNDHGIETWLNHYGEERLSRLLISGDDCLVNAFDERFGKALTWLNTMEKIRKDIDLCAPSNGYENFEKVEFCSNHFHELMLKDGRQLVVPCRSQNELVGRASVNQGGSATVAGTACLAKAYAQMWNLLYFHRRDLRLLGFAIMSAT

SEQ ID NO: 9365 - protein, 127 aa, unidentified; identical to SEQ ID NO: 8344

SEQ ID NO: 9366 - protein, 199 aa, unidentified; identical to SEQ ID NO: 8585

SEQ ID NO: 9367 - protein, 337 aa, unidentified; identical to SEQ ID NO: 8339

SEQ ID NO: 9368 - protein, 114 aa, unidentified
PHHRALIAVTMRLAYQNIAAVFPRTQSKYGSGFVMDFLGRRDQRGSGQVVTFALNTITNGKVQVARVLESEGLLHADESVLDAWLEKHLEEALGNMVIAGEEVVVSTTNRDFSS

SEQ ID NO: 9369 - protein, 170 aa, unidentified
GFLNEERWASRDISGGGVEGIGINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDD

SEQ ID NO: 9370 - protein, 230 aa, unidentified
HHRALIAVTMRLAYQNIAAVFPRTQSKYGSGFVMDFLGRRDQRGSGQVVTFALNTITNGKVQVARVLESEGLLHADESVLDAWLEKHLEEALGNMVIAGEEVVVSTTNRDFSSALEYLELTGKTRKNVPQGAPSRMESDWEKVEFCFHHYHEMCLKDGRILIAPCRHENEVLGRSRLQKGGVVSIPESACMAKAYAQMWALYFFHRRDLRLGFIAISSAVPTNWFPLGRT

SEQ ID NO: 9371 - protein, 311 aa, unidentified
VAKGSRTIWYMWLGSRFLEFESFGFLNEEHWASRELCGGGVEGIPLFYLGYHLEKMAEKAGILYADDTAGWDTRITMADLEDEYTLTELMEGEHKKLAETLFNFAYKNKVALCPRPGKNGGTVLDVISRTDQRGSGQVVTYALNTLTNIKVQLIRMAESEGVLDEEFHDNGMLKWLEKHGRDRLQRLMVSGDDCVVNAIDERFGKSLVWLNEMQKIRKDIDLWKPSAGHCNWEEVEFCSNHFHKLVMRDGRTLVVPCRHEVELVGRASVNQGGSTGISGTACLAKAYAQMWLLLYFHRRDLRILGMAICSA

SEQ ID NO: 9372 - protein, 337 aa, unidentified; identical to SEQ ID NO: 8339

SEQ ID NO: 9373 - protein, 219 aa, unidentified
HHRALIAVTMRLAYQNIAAVFPRTQSKYGSGFVMDFLGRRDQRGSGQVVTFALNTITNGKVQVARVLESEGLLHADESVLDAWLEKHLEEALGNMVIAGEEVVVSTTNRDFSSALEYLELTGKTRKNVPQGAPSRMESDWEKVEFCFHHYHEMCLKDGRILIAPCRHENEVLGRSRLQKGGVVSIPESACMAKAYAQMWALYFFHRRDLRLGFIAISSA

SEQ ID NO: 9374 - protein, 337 aa, unidentified; identical to SEQ ID NO: 8339

SEQ ID NO: 9375 - protein, 337 aa, unidentified; identical to SEQ ID NO: 8339

SEQ ID NO: 9376 - protein, 149 aa, unidentified
PHHRALIAVTMRLAYQNIAAVFPRTQSKYGSGFVMDFLGRRDQRGSGQVVTFALNTITNGKVQVARVLESEGLLHADESVLDAWLEKHLEEALGNMVIAGEEVVVSTTNRDFSSALEYLELTGKTRKNVPQGAPSRMESDWEKVEFCFH

SEQ ID NO: 9377 - protein, 337 aa, unidentified; identical to SEQ ID NO: 8339

SEQ ID NO: 9378 - protein, 333 aa, unidentified; identical to SEQ ID NO: 8351

SEQ ID NO: 9379 - protein, 337 aa, unidentified; identical to SEQ ID NO: 8339

SEQ ID NO: 9380 - protein, 221 aa, unidentified
KPGEFGVAKGSRTIWYMWLGSRFLEFEALGFLNEERWASRDISGGGVEGIGINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEK

SEQ ID NO: 9381 - protein, 193 aa, unidentified; identical to SEQ ID NO: 8836

SEQ ID NO: 9382 - protein, 154 aa, unidentified; identical to SEQ ID NO: 8743

SEQ ID NO: 9383 - protein, 248 aa, unidentified; identical to SEQ ID NO: 8593

SEQ ID NO: 9384 - protein, 248 aa, unidentified; identical to SEQ ID NO: 8593

SEQ ID NO: 9385 - protein, 248 aa, unidentified; identical to SEQ ID NO: 8593

SEQ ID NO: 9386 - protein, 258 aa, unidentified; identical to SEQ ID NO: 8309

SEQ ID NO: 9387 - protein, 337 aa, unidentified; identical to SEQ ID NO: 8339

SEQ ID NO: 9388 - protein, 238 aa, unidentified
KPGEFGVAKGSRTIWYMWLGSRFLEFEALGFLNEERWASRDISGGGVEGIGINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTW

SEQ ID NO: 9389 - protein, 258 aa, unidentified; identical to SEQ ID NO: 8309

SEQ ID NO: 9390 - protein, 20 aa, unidentified
MKCLLYLAFLSIGVNCKFTI

SEQ ID NO: 9391 - protein, 258 aa, unidentified; identical to SEQ ID NO: 8309

SEQ ID NO: 9392 - protein, 127 aa, unidentified; identical to SEQ ID NO: 8344

SEQ ID NO: 9393 - protein, 22 aa, unidentified
MKCLLYLAFLSIGVNCKFTIVF

SEQ ID NO: 9394 - protein, 22 aa, unidentified
MKCLLYLAFLSIGVNCKFTIVF

SEQ ID NO: 9395 - protein, 258 aa, unidentified; identical to SEQ ID NO: 8309

SEQ ID NO: 9396 - protein, 333 aa, unidentified; identical to SEQ ID NO: 8351

SEQ ID NO: 9397 - protein, 333 aa, unidentified; identical to SEQ ID NO: 8351

SEQ ID NO: 9398 - protein, 337 aa, unidentified; identical to SEQ ID NO: 8339

SEQ ID NO: 9399 - protein, 337 aa, unidentified; identical to SEQ ID NO: 8339

SEQ ID NO: 9400 - protein, 337 aa, unidentified; identical to SEQ ID NO: 8339

SEQ ID NO: 9401 - protein, 231 aa, unidentified; identical to SEQ ID NO: 9315

SEQ ID NO: 9402 - protein, 174 aa, unidentified
DTAGWDTRITEADLDDECILCDYMEDEHKQLALSLFELCYKNKVALCPRPGRHGGTVMDVIFRRDQRGSGQVVTYALNTLTNIKVQLIRLAESEGVLDEDFNDHGIETWLNHYGEERLSRLLISGDDCLVNAFDERFGKALTWLNTMEKIRKDIDLCAPSNGYENFEKVEFCSN

SEQ ID NO: 9403 - protein, 329 aa, unidentified
KGSRTIWYMWLGSRFLEFEALGFLNEERWASRDISGGGVEGIGINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCSHHFHELFLRDGRKLIVPCRDQHELVGRSMVSQGGSSGVAGTACLAKAYAQMWLMSYFHRRDLRTLGFGIMSSVPKDWFPTGRTTWSVHANHE

SEQ ID NO: 9404 - protein, 337 aa, unidentified; identical to SEQ ID NO: 8339

SEQ ID NO: 9405 - protein, 226 aa, unidentified
VAKGSRTIWYMWLGSRFLEFESFGFLNEEHWASRELCGGGVEGIPLFYLGYHLEKMAEKAGILYADDTAGWDTRITMADLEDEYTLTELMEGEHKKLAETLFNFAYKNKVALCPRPGKNGGTVLDVISRTDQRGSGQVVTYALNTLTNIKVQLIRMAESEGVLDEEFHDNGMLKWLEKHGRDRLQRLMVSGDDCVVNAIDERFGKSLVWLNEMQKIRKDIDLWKPS

SEQ ID NO: 9406 - protein, 337 aa, unidentified; identical to SEQ ID NO: 8339

SEQ ID NO: 9407 - protein, 337 aa, unidentified; identical to SEQ ID NO: 8339

SEQ ID NO: 9408 - protein, 337 aa, unidentified; identical to SEQ ID NO: 8339

SEQ ID NO: 9409 - protein, 248 aa, unidentified; identical to SEQ ID NO: 8593

SEQ ID NO: 9410 - protein, 20 aa, unidentified
MKCLLYLAFLSIGVNCKFTI

SEQ ID NO: 9411 - protein, 22 aa, unidentified
MKCLLYLAFLSIGVNCKFTIVF

SEQ ID NO: 9412 - protein, 248 aa, unidentified; identical to SEQ ID NO: 8593

SEQ ID NO: 9413 - protein, 248 aa, unidentified; identical to SEQ ID NO: 8593

SEQ ID NO: 9414 - protein, 248 aa, unidentified; identical to SEQ ID NO: 8593

SEQ ID NO: 9415 - protein, 337 aa, unidentified; identical to SEQ ID NO: 8339

SEQ ID NO: 9416 - protein, 337 aa, unidentified; identical to SEQ ID NO: 8339

SEQ ID NO: 9417 - protein, 283 aa, unidentified; identical to SEQ ID NO: 9339

SEQ ID NO: 9418 - protein, 337 aa, unidentified; identical to SEQ ID NO: 8339

SEQ ID NO: 9419 - protein, 337 aa, unidentified; identical to SEQ ID NO: 8339

SEQ ID NO: 9420 - protein, 337 aa, unidentified; identical to SEQ ID NO: 8339

SEQ ID NO: 9421 - protein, 310 aa, unidentified; identical to SEQ ID NO: 9321

SEQ ID NO: 9422 - protein, 310 aa, unidentified; identical to SEQ ID NO: 9321

SEQ ID NO: 9423 - protein, 310 aa, unidentified; identical to SEQ ID NO: 9321

SEQ ID NO: 9424 - protein, 333 aa, unidentified; identical to SEQ ID NO: 8351

SEQ ID NO: 9425 - protein, 337 aa, unidentified; identical to SEQ ID NO: 8339

SEQ ID NO: 9426 - protein, 258 aa, unidentified; identical to SEQ ID NO: 8309

SEQ ID NO: 9427 - protein, 337 aa, unidentified; identical to SEQ ID NO: 8339

SEQ ID NO: 9428 - protein, 337 aa, unidentified; identical to SEQ ID NO: 8339

SEQ ID NO: 9429 - protein, 337 aa, unidentified; identical to SEQ ID NO: 8339

SEQ ID NO: 9430 - protein, 337 aa, unidentified; identical to SEQ ID NO: 8339

SEQ ID NO: 9431 - protein, 337 aa, unidentified; identical to SEQ ID NO: 8339

SEQ ID NO: 9432 - protein, 333 aa, unidentified; identical to SEQ ID NO: 8351

SEQ ID NO: 9433 - protein, 231 aa, unidentified; identical to SEQ ID NO: 9315

SEQ ID NO: 9434 - protein, 337 aa, unidentified; identical to SEQ ID NO: 8339

SEQ ID NO: 9435 - protein, 333 aa, unidentified; identical to SEQ ID NO: 8351

SEQ ID NO: 9436 - protein, 337 aa, unidentified; identical to SEQ ID NO: 8339

SEQ ID NO: 9437 - protein, 196 aa, unidentified
EERWASRDISGGGVEGIGINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAW

SEQ ID NO: 9438 - protein, 231 aa, unidentified; identical to SEQ ID NO: 9315

SEQ ID NO: 9439 - protein, 337 aa, unidentified; identical to SEQ ID NO: 8339

SEQ ID NO: 9440 - protein, 337 aa, unidentified; identical to SEQ ID NO: 8339

SEQ ID NO: 9441 - protein, 337 aa, unidentified; identical to SEQ ID NO: 8339

SEQ ID NO: 9442 - protein, 127 aa, unidentified; identical to SEQ ID NO: 8594

SEQ ID NO: 9443 - protein, 248 aa, unidentified; identical to SEQ ID NO: 8593

SEQ ID NO: 9444 - protein, 69 aa, unidentified; identical to SEQ ID NO: 8367

SEQ ID NO: 9445 - protein, 69 aa, unidentified; identical to SEQ ID NO: 8367

SEQ ID NO: 9446 - protein, 74 aa, unidentified; identical to SEQ ID NO: 8267

SEQ ID NO: 9447 - protein, 74 aa, unidentified; identical to SEQ ID NO: 8267

SEQ ID NO: 9448 - protein, 248 aa, unidentified; identical to SEQ ID NO: 8593

SEQ ID NO: 9449 - protein, 127 aa, unidentified; identical to SEQ ID NO: 8594

SEQ ID NO: 9450 - protein, 248 aa, unidentified; identical to SEQ ID NO: 8593

SEQ ID NO: 9451 - protein, 248 aa, unidentified; identical to SEQ ID NO: 8593

SEQ ID NO: 9452 - protein, 248 aa, unidentified; identical to SEQ ID NO: 8593

SEQ ID NO: 9453 - protein, 258 aa, unidentified; identical to SEQ ID NO: 8309

SEQ ID NO: 9454 - protein, 19 aa, unidentified
MKCLLYLAFLSIGVNCKFT

SEQ ID NO: 9455 - protein, 258 aa, unidentified; identical to SEQ ID NO: 8309

SEQ ID NO: 9456 - protein, 22 aa, unidentified
MKCLLYLAFLSIGVNCKFTIVF

SEQ ID NO: 9457 - protein, 258 aa, unidentified; identical to SEQ ID NO: 8309

SEQ ID NO: 9458 - protein, 18 aa, unidentified
MKCLLYLAFLSIGVNCKF

SEQ ID NO: 9459 - protein, 258 aa, unidentified; identical to SEQ ID NO: 8309

SEQ ID NO: 9460 - protein, 127 aa, unidentified; identical to SEQ ID NO: 8344

SEQ ID NO: 9461 - protein, 22 aa, unidentified
MKCLLYLAFLSIGVNCKFTIVF

SEQ ID NO: 9462 - protein, 19 aa, unidentified
MKCLLYLAFLSIGVNCKFT

SEQ ID NO: 9463 - protein, 258 aa, unidentified; identical to SEQ ID NO: 8309

SEQ ID NO: 9464 - protein, 127 aa, unidentified; identical to SEQ ID NO: 8344

SEQ ID NO: 9465 - protein, 23 aa, unidentified
MKCLLYLAFLSIGVNCKFTIVFP

SEQ ID NO: 9466 - protein, 19 aa, unidentified
MKCLLYLAFLSIGVNCKFT

SEQ ID NO: 9467 - protein, 199 aa, unidentified; identical to SEQ ID NO: 8585

SEQ ID NO: 9468 - protein, 176 aa, unidentified
LEFEALGFLNEERWASRDISGGGVEGIGINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDD

SEQ ID NO: 9469 - protein, 337 aa, unidentified; identical to SEQ ID NO: 8339

SEQ ID NO: 9470 - protein, 337 aa, unidentified; identical to SEQ ID NO: 8339

SEQ ID NO: 9471 - protein, 337 aa, unidentified; identical to SEQ ID NO: 8339

SEQ ID NO: 9472 - protein, 231 aa, unidentified; identical to SEQ ID NO: 9315

SEQ ID NO: 9473 - protein, 199 aa, unidentified; identical to SEQ ID NO: 8585

SEQ ID NO: 9474 - protein, 337 aa, unidentified; identical to SEQ ID NO: 8339

SEQ ID NO: 9475 - protein, 337 aa, unidentified; identical to SEQ ID NO: 8339

SEQ ID NO: 9476 - protein, 337 aa, unidentified; identical to SEQ ID NO: 8339

SEQ ID NO: 9477 - protein, 199 aa, unidentified; identical to SEQ ID NO: 8585

SEQ ID NO: 9478 - protein, 337 aa, unidentified; identical to SEQ ID NO: 8339

SEQ ID NO: 9479 - protein, 337 aa, unidentified; identical to SEQ ID NO: 8339

SEQ ID NO: 9480 - protein, 199 aa, unidentified; identical to SEQ ID NO: 8585

SEQ ID NO: 9481 - protein, 258 aa, unidentified; identical to SEQ ID NO: 8309

SEQ ID NO: 9482 - protein, 199 aa, unidentified; identical to SEQ ID NO: 8585

SEQ ID NO: 9483 - protein, 112 aa, unidentified
HHRALIAVTMRLAYQNIAAVFPRTQSKYGSGFVMDFLGRRDQRGSGQVVTFALNTITNGKVQVARVLESEGLLHADESVLDAWLEKHLEEALGNMVIAGEEVVVSTTNRDFS

SEQ ID NO: 9484 - protein, 311 aa, unidentified
RTIWYMWLGSRFLEFESFGFLNEEHWASRELSGGGVESIPLFYLGYHLREMAKKPGKLYADDTAGWDTRITEADLDDECILCDYMEDEHKQLALSLFELCYKNKVALCPRPGRHGGTVMDVIFRRDQRGSGQVVTYALNTLTNIKVQLIRLAESEGVLDEDFNDHGIETWLNHYGEERLSRLLISGDDCLVNAFDERFGKALTWLNTMEKIRKDIDLCAPSNGYENFEKVEFCSNHFHELMLKDGRQLVVPCRSQNELVGRASVNQGGSATVAGTACLAKAYAQMWNLLYFHRRDLRLLGFAIMSATPSNW

SEQ ID NO: 9485 - protein, 165 aa, unidentified
HHRALIAVTMRLAYQNIAAVFPRTQSKYGSGFVMDFLGRRDQRGSGQVVTFALNTITNGKVQVARVLESEGLLHADESVLDAWLEKHLEEALGNMVIAGEEVVVSTTNRDFSSALEYLELTGKTRKNVPQGAPSRMESDWEKVEFCFHHYHEMCLKDGRILIAPC

SEQ ID NO: 9486 - protein, 127 aa, unidentified; identical to SEQ ID NO: 8344

SEQ ID NO: 9487 - protein, 127 aa, unidentified; identical to SEQ ID NO: 8344

SEQ ID NO: 9488 - protein, 230 aa, unidentified; identical to SEQ ID NO: 9370

SEQ ID NO: 9489 - protein, 337 aa, unidentified; identical to SEQ ID NO: 8339

SEQ ID NO: 9490 - protein, 205 aa, unidentified
PGEFGVAKGSRTIWYMWLGSRFLEFEALGFLNEERWASRDISGGGVEGIGINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALD

SEQ ID NO: 9491 - protein, 196 aa, unidentified
SGGGVEGIGINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTW

SEQ ID NO: 9492 - protein, 199 aa, unidentified; identical to SEQ ID NO: 8585

SEQ ID NO: 9493 - protein, 337 aa, unidentified; identical to SEQ ID NO: 8339

SEQ ID NO: 9494 - protein, 337 aa, unidentified; identical to SEQ ID NO: 8339

SEQ ID NO: 9495 - protein, 311 aa, unidentified
VAKGSRTIWYMWLGSRFLEFEALGFLNEERWASRDISGGGVEGIGINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCSHHFHELFLRDGRKLIVPCRDQHELVGRSMVSQGGSSGVAGTACLAKAYAQMWLMSYFHRRDLRTLGFGIMSS

SEQ ID NO: 9496 - protein, 333 aa, unidentified; identical to SEQ ID NO: 8351

SEQ ID NO: 9497 - protein, 337 aa, unidentified; identical to SEQ ID NO: 8339

SEQ ID NO: 9498 - protein, 337 aa, unidentified; identical to SEQ ID NO: 8339

SEQ ID NO: 9499 - protein, 333 aa, unidentified; identical to SEQ ID NO: 8351

SEQ ID NO: 9500 - protein, 337 aa, unidentified; identical to SEQ ID NO: 8339

SEQ ID NO: 9501 - protein, 337 aa, unidentified; identical to SEQ ID NO: 8339

SEQ ID NO: 9502 - protein, 245 aa, unidentified; identical to SEQ ID NO: 8829

SEQ ID NO: 9503 - protein, 337 aa, unidentified; identical to SEQ ID NO: 8339

SEQ ID NO: 9504 - protein, 262 aa, unidentified
KPGDFGVAKGSRTIWYMWLGSRFLEFESFGFLNEEHWASRELSGGGVEGIPLNYLGYHLREMAQKPGVLYADDTAGWDTRITMADLEDEGILLDMMSGEHKKLASALFSKAYKVKVALCPRPGPKGGTLMDVISRTDQRGSGQVVTYALNTLTNIKVQLIRMAEAEGVLGATFEDFGIDRWLQEHGEDRVERMLVSGDDCVVNAIDERFGSSLNWLNAMEKVRKDIDLWKPSPSFRNWERVEFCSNHFHEMTMKDGRVIVAP

SEQ ID NO: 9505 - protein, 209 aa, unidentified
KPGEFGVAKGSRTIWYMWLGSRFLEFEALGFLNEERWASRDISGGGVEGIGINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERF

SEQ ID NO: 9506 - protein, 337 aa, unidentified; identical to SEQ ID NO: 8339

SEQ ID NO: 9507 - protein, 337 aa, unidentified; identical to SEQ ID NO: 8339

SEQ ID NO: 9508 - protein, 242 aa, unidentified; identical to SEQ ID NO: 9313

SEQ ID NO: 9509 - protein, 337 aa, unidentified; identical to SEQ ID NO: 8339

SEQ ID NO: 9510 - protein, 231 aa, unidentified; identical to SEQ ID NO: 9315

SEQ ID NO: 9511 - protein, 231 aa, unidentified; identical to SEQ ID NO: 9315

SEQ ID NO: 9512 - protein, 337 aa, unidentified; identical to SEQ ID NO: 8339

SEQ ID NO: 9513 - protein, 127 aa, unidentified; identical to SEQ ID NO: 8344

SEQ ID NO: 9514 - protein, 337 aa, unidentified; identical to SEQ ID NO: 8339

SEQ ID NO: 9515 - protein, 231 aa, unidentified; identical to SEQ ID NO: 9315

SEQ ID NO: 9516 - protein, 337 aa, unidentified; identical to SEQ ID NO: 8339

SEQ ID NO: 9517 - protein, 337 aa, unidentified; identical to SEQ ID NO: 8339

SEQ ID NO: 9518 - protein, 337 aa, unidentified; identical to SEQ ID NO: 8339

SEQ ID NO: 9519 - protein, 337 aa, unidentified; identical to SEQ ID NO: 8339

SEQ ID NO: 9520 - protein, 255 aa, unidentified
KPGEFGVAKGSRTIWYMWLGSRFLEFEALGFLNEERWASRDISGGGVEGIGINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCSHHFHELFLRD

SEQ ID NO: 9521 - protein, 310 aa, unidentified; identical to SEQ ID NO: 9321

SEQ ID NO: 9522 - protein, 337 aa, unidentified; identical to SEQ ID NO: 8339

SEQ ID NO: 9523 - protein, 337 aa, unidentified; identical to SEQ ID NO: 8339

SEQ ID NO: 9524 - protein, 231 aa, unidentified; identical to SEQ ID NO: 9315

SEQ ID NO: 9525 - protein, 231 aa, unidentified; identical to SEQ ID NO: 9315

SEQ ID NO: 9526 - protein, 337 aa, unidentified; identical to SEQ ID NO: 8339

SEQ ID NO: 9527 - protein, 333 aa, unidentified; identical to SEQ ID NO: 8351

SEQ ID NO: 9528 - protein, 337 aa, unidentified; identical to SEQ ID NO: 8339

SEQ ID NO: 9529 - protein, 337 aa, unidentified; identical to SEQ ID NO: 8339

SEQ ID NO: 9530 - protein, 337 aa, unidentified; identical to SEQ ID NO: 8339

SEQ ID NO: 9531 - protein, 337 aa, unidentified; identical to SEQ ID NO: 8339

SEQ ID NO: 9532 - protein, 337 aa, unidentified; identical to SEQ ID NO: 8339

SEQ ID NO: 9533 - protein, 337 aa, unidentified; identical to SEQ ID NO: 8339

SEQ ID NO: 9534 - protein, 337 aa, unidentified; identical to SEQ ID NO: 8339

SEQ ID NO: 9535 - protein, 127 aa, unidentified; identical to SEQ ID NO: 8594

SEQ ID NO: 9536 - protein, 337 aa, unidentified; identical to SEQ ID NO: 8339

SEQ ID NO: 9537 - protein, 231 aa, unidentified; identical to SEQ ID NO: 9315

SEQ ID NO: 9538 - protein, 337 aa, unidentified; identical to SEQ ID NO: 8339

SEQ ID NO: 9539 - protein, 174 aa, unidentified; identical to SEQ ID NO: 8195

SEQ ID NO: 9540 - protein, 127 aa, unidentified; identical to SEQ ID NO: 8594

SEQ ID NO: 9541 - protein, 83 aa, unidentified; identical to SEQ ID NO: 9347

SEQ ID NO: 9542 - protein, 89 aa, unidentified; identical to SEQ ID NO: 8257

SEQ ID NO: 9543 - protein, 74 aa, unidentified; identical to SEQ ID NO: 8267

SEQ ID NO: 9544 - protein, 248 aa, unidentified; identical to SEQ ID NO: 8593

SEQ ID NO: 9545 - protein, 174 aa, unidentified; identical to SEQ ID NO: 8195

SEQ ID NO: 9546 - protein, 248 aa, unidentified; identical to SEQ ID NO: 8593

SEQ ID NO: 9547 - protein, 154 aa, unidentified; identical to SEQ ID NO: 8743

SEQ ID NO: 9548 - protein, 248 aa, unidentified; identical to SEQ ID NO: 8593

SEQ ID NO: 9549 - protein, 21 aa, unidentified
MKCLLYLAFLSIGVNCKFTIV

SEQ ID NO: 9550 - protein, 258 aa, unidentified; identical to SEQ ID NO: 8309

SEQ ID NO: 9551 - protein, 21 aa, unidentified
MKCLLYLAFLSIGVNCKFTIV

SEQ ID NO: 9552 - protein, 36 aa, unidentified
MKCLLYLAFLSIGVNCKFTIVFPHNQKGTWKNVPSN

SEQ ID NO: 9553 - protein, 21 aa, unidentified
MKCLLYLAFLSIGVNCKFTIV

SEQ ID NO: 9554 - protein, 258 aa, unidentified; identical to SEQ ID NO: 8309

SEQ ID NO: 9555 - protein, 258 aa, unidentified; identical to SEQ ID NO: 8309

SEQ ID NO: 9556 - protein, 18 aa, unidentified
MKCLLYLAFLSIGVNCKF

SEQ ID NO: 9557 - protein, 22 aa, unidentified
MKCLLYLAFLSIGVNCKFTIVF

SEQ ID NO: 9558 - protein, 57 aa, unidentified; identical to SEQ ID NO: 8179

SEQ ID NO: 9559 - protein, 20 aa, unidentified
MKCLLYLAFLSIGVNCKFTI

SEQ ID NO: 9560 - protein, 22 aa, unidentified
MKCLLYLAFLSIGVNCKFTIVF

SEQ ID NO: 9561 - protein, 164 aa, unidentified
DTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYR

SEQ ID NO: 9562 - protein, 21 aa, unidentified
MKCLLYLAFLSIGVNCKFTIV

SEQ ID NO: 9563 - protein, 22 aa, unidentified
MKCLLYLAFLSIGVNCKFTIVF

SEQ ID NO: 9564 - protein, 57 aa, unidentified; identical to SEQ ID NO: 8179

SEQ ID NO: 9565 - protein, 74 aa, unidentified; identical to SEQ ID NO: 8267

SEQ ID NO: 9566 - protein, 259 aa, unidentified
RTIWYMWLGSRFLEFESFGFLNEEHWASRELSGGGVESIPLFYLGYHLREMAKKPGKLYADDTAGWDTRITEADLDDECILCDYMEDEHKQLALSLFELCYKNKVALCPRPGRHGGTVMDVIFRRDQRGSGQVVTYALNTLTNIKVQLIRLAESEGVLDEDFNDHGIETWLNHYGEERLSRLLISGDDCLVNAFDERFGKALTWLNTMEKIRKDIDLCAPSNGYENFEKVEFCSNHFHELMLKDGRQLVVPCRSQNELV

SEQ ID NO: 9567 - protein, 234 aa, unidentified
RTIWYMWLGSRFLEFESFGFLNEEHWASRELSGGGVESIPLFYLGYHLREMAKKPGKLYADDTAGWDTRITEADLDDECILCDYMEDEHKQLALSLFELCYKNKVALCPRPGRHGGTVMDVIFRRDQRGSGQVVTYALNTLTNIKVQLIRLAESEGVLDEDFNDHGIETWLNHYGEERLSRLLISGDDCLVNAFDERFGKALTWLNTMEKIRKDIDLCAPSNGYENFEKVEFCS

SEQ ID NO: 9568 - protein, 337 aa, unidentified; identical to SEQ ID NO: 8339

SEQ ID NO: 9569 - protein, 127 aa, unidentified; identical to SEQ ID NO: 8344

SEQ ID NO: 9570 - protein, 337 aa, unidentified; identical to SEQ ID NO: 8339

SEQ ID NO: 9571 - protein, 337 aa, unidentified; identical to SEQ ID NO: 8339

SEQ ID NO: 9572 - protein, 337 aa, unidentified; identical to SEQ ID NO: 8339

SEQ ID NO: 9573 - protein, 199 aa, unidentified; identical to SEQ ID NO: 8585

SEQ ID NO: 9574 - protein, 194 aa, unidentified
GVAKGSRTIWYMWLGSRFLEFEALGFLNEERWASRDISGGGVEGIGINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDD

SEQ ID NO: 9575 - protein, 198 aa, unidentified; identical to SEQ ID NO: 9296

SEQ ID NO: 9576 - protein, 199 aa, unidentified; identical to SEQ ID NO: 8585

SEQ ID NO: 9577 - protein, 198 aa, unidentified; identical to SEQ ID NO: 9296

SEQ ID NO: 9578 - protein, 337 aa, unidentified; identical to SEQ ID NO: 8339

SEQ ID NO: 9579 - protein, 127 aa, unidentified; identical to SEQ ID NO: 8344

SEQ ID NO: 9580 - protein, 248 aa, unidentified; identical to SEQ ID NO: 8593

SEQ ID NO: 9581 - protein, 230 aa, unidentified; identical to SEQ ID NO: 9370

SEQ ID NO: 9582 - protein, 337 aa, unidentified; identical to SEQ ID NO: 8339

SEQ ID NO: 9583 - protein, 337 aa, unidentified; identical to SEQ ID NO: 8339

SEQ ID NO: 9584 - protein, 337 aa, unidentified; identical to SEQ ID NO: 8339

SEQ ID NO: 9585 - protein, 310 aa, unidentified; identical to SEQ ID NO: 9321

SEQ ID NO: 9586 - protein, 337 aa, unidentified; identical to SEQ ID NO: 8339

SEQ ID NO: 9587 - protein, 231 aa, unidentified; identical to SEQ ID NO: 9315

SEQ ID NO: 9588 - protein, 337 aa, unidentified; identical to SEQ ID NO: 8339

SEQ ID NO: 9589 - protein, 231 aa, unidentified; identical to SEQ ID NO: 9315

SEQ ID NO: 9590 - protein, 184 aa, unidentified
GVEGIGINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAW

SEQ ID NO: 9591 - protein, 333 aa, unidentified; identical to SEQ ID NO: 8351

SEQ ID NO: 9592 - protein, 337 aa, unidentified; identical to SEQ ID NO: 8339

SEQ ID NO: 9593 - protein, 337 aa, unidentified; identical to SEQ ID NO: 8339

SEQ ID NO: 9594 - protein, 337 aa, unidentified; identical to SEQ ID NO: 8339

SEQ ID NO: 9595 - protein, 337 aa, unidentified; identical to SEQ ID NO: 8339

SEQ ID NO: 9596 - protein, 337 aa, unidentified; identical to SEQ ID NO: 8339

SEQ ID NO: 9597 - protein, 337 aa, unidentified; identical to SEQ ID NO: 8339

SEQ ID NO: 9598 - protein, 337 aa, unidentified; identical to SEQ ID NO: 8339

SEQ ID NO: 9599 - protein, 337 aa, unidentified; identical to SEQ ID NO: 8339

SEQ ID NO: 9600 - protein, 337 aa, unidentified; identical to SEQ ID NO: 8339

SEQ ID NO: 9601 - protein, 303 aa, unidentified; identical to SEQ ID NO: 8684

SEQ ID NO: 9602 - protein, 337 aa, unidentified; identical to SEQ ID NO: 8339

SEQ ID NO: 9603 - protein, 337 aa, unidentified; identical to SEQ ID NO: 8339

SEQ ID NO: 9604 - protein, 337 aa, unidentified; identical to SEQ ID NO: 8339

SEQ ID NO: 9605 - protein, 238 aa, unidentified; identical to SEQ ID NO: 9388

SEQ ID NO: 9606 - protein, 337 aa, unidentified; identical to SEQ ID NO: 8339

SEQ ID NO: 9607 - protein, 199 aa, unidentified
EERWASRDISGGGVEGIGINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPS

SEQ ID NO: 9608 - protein, 337 aa, unidentified; identical to SEQ ID NO: 8339

SEQ ID NO: 9609 - protein, 231 aa, unidentified; identical to SEQ ID NO: 9315

SEQ ID NO: 9610 - protein, 337 aa, unidentified; identical to SEQ ID NO: 8339

SEQ ID NO: 9611 - protein, 337 aa, unidentified; identical to SEQ ID NO: 8339

SEQ ID NO: 9612 - protein, 33 aa, unidentified; identical to SEQ ID NO: 8702

SEQ ID NO: 9613 - protein, 337 aa, unidentified; identical to SEQ ID NO: 8339

SEQ ID NO: 9614 - protein, 231 aa, unidentified; identical to SEQ ID NO: 9315

SEQ ID NO: 9615 - protein, 337 aa, unidentified; identical to SEQ ID NO: 8339

SEQ ID NO: 9616 - protein, 337 aa, unidentified; identical to SEQ ID NO: 8339

SEQ ID NO: 9617 - protein, 337 aa, unidentified; identical to SEQ ID NO: 8339

SEQ ID NO: 9618 - protein, 337 aa, unidentified; identical to SEQ ID NO: 8339

SEQ ID NO: 9619 - protein, 337 aa, unidentified; identical to SEQ ID NO: 8339

SEQ ID NO: 9620 - protein, 337 aa, unidentified; identical to SEQ ID NO: 8339

SEQ ID NO: 9621 - protein, 62 aa, unidentified
GNLQMFGTNLVLNEEDGMKICHLNNECSLKLPVVRCMNSSLFRVTCGSTTRWWNISSIHSPL

SEQ ID NO: 9622 - protein, 332 aa, unidentified
KPGDFGVAKGSRTIWYMWLGSRFLEFESFGFLNEEHWASRELSGGGVEGIPLNYLGYHLREMAQKPGVLYADDTAGWDTRITMADLEDEGILLDMMSGEHKKLASALFSKAYKVKVALCPRPGPKGGTLMDVISRTDQRGSGQVVTYALNTLTNIKVQLIRMAEAEGVLGATFEDFGIDRWLQEHGEDRVERMLVSGDDCVVNAIDERFGSSLNWLNAMEKVRKDIDLWKPSPSFRNWERVEFCSNHFHEMTMKDGRVIVAPCRGQTELIARGTVNQGGCVGVESTGCLAKAYAQMWLLLYFHRRDLRTLALAVMSAVPSNWIPTGRTTWSL

SEQ ID NO: 9623 - protein, 335 aa, unidentified; identical to SEQ ID NO: 8722

SEQ ID NO: 9624 - protein, 295 aa, unidentified
SGGGVEGIGINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCSHHFHELFLRDGRKLIVPCRDQHELVGRSMVSQGGSSGVAGTACLAKAYAQMWLMSYFHRRDLRTLGFGIMSSVPKDWFPTGRTTWSVHANHE

SEQ ID NO: 9625 - protein, 337 aa, unidentified; identical to SEQ ID NO: 8339

SEQ ID NO: 9626 - protein, 337 aa, unidentified; identical to SEQ ID NO: 8339

SEQ ID NO: 9627 - protein, 337 aa, unidentified; identical to SEQ ID NO: 8339

SEQ ID NO: 9628 - protein, 337 aa, unidentified; identical to SEQ ID NO: 8339

SEQ ID NO: 9629 - protein, 337 aa, unidentified; identical to SEQ ID NO: 8339

SEQ ID NO: 9630 - protein, 333 aa, unidentified; identical to SEQ ID NO: 8351

SEQ ID NO: 9631 - protein, 333 aa, unidentified; identical to SEQ ID NO: 8351

SEQ ID NO: 9632 - protein, 174 aa, unidentified; identical to SEQ ID NO: 8195

SEQ ID NO: 9633 - protein, 174 aa, unidentified; identical to SEQ ID NO: 8195

SEQ ID NO: 9634 - protein, 337 aa, unidentified; identical to SEQ ID NO: 8339

SEQ ID NO: 9635 - protein, 337 aa, unidentified; identical to SEQ ID NO: 8339

SEQ ID NO: 9636 - protein, 333 aa, unidentified; identical to SEQ ID NO: 8351

SEQ ID NO: 9637 - protein, 333 aa, unidentified; identical to SEQ ID NO: 8351

SEQ ID NO: 9638 - protein, 337 aa, unidentified; identical to SEQ ID NO: 8339

SEQ ID NO: 9639 - protein, 337 aa, unidentified; identical to SEQ ID NO: 8339

SEQ ID NO: 9640 - protein, 337 aa, unidentified; identical to SEQ ID NO: 8339

SEQ ID NO: 9641 - protein, 337 aa, unidentified; identical to SEQ ID NO: 8339

SEQ ID NO: 9642 - protein, 337 aa, unidentified; identical to SEQ ID NO: 8339

SEQ ID NO: 9643 - protein, 337 aa, unidentified; identical to SEQ ID NO: 8339

SEQ ID NO: 9644 - protein, 337 aa, unidentified; identical to SEQ ID NO: 8339

SEQ ID NO: 9645 - protein, 335 aa, unidentified; identical to SEQ ID NO: 8722

SEQ ID NO: 9646 - protein, 337 aa, unidentified; identical to SEQ ID NO: 8339

SEQ ID NO: 9647 - protein, 335 aa, unidentified; identical to SEQ ID NO: 8722

SEQ ID NO: 9648 - protein, 337 aa, unidentified; identical to SEQ ID NO: 8339

SEQ ID NO: 9649 - protein, 337 aa, unidentified; identical to SEQ ID NO: 8339

SEQ ID NO: 9650 - protein, 337 aa, unidentified; identical to SEQ ID NO: 8339

SEQ ID NO: 9651 - protein, 337 aa, unidentified; identical to SEQ ID NO: 8339

SEQ ID NO: 9652 - protein, 337 aa, unidentified; identical to SEQ ID NO: 8339

SEQ ID NO: 9653 - protein, 337 aa, unidentified; identical to SEQ ID NO: 8339

SEQ ID NO: 9654 - protein, 337 aa, unidentified; identical to SEQ ID NO: 8339

SEQ ID NO: 9655 - protein, 337 aa, unidentified; identical to SEQ ID NO: 8339

SEQ ID NO: 9656 - protein, 337 aa, unidentified; identical to SEQ ID NO: 8339

SEQ ID NO: 9657 - protein, 337 aa, unidentified; identical to SEQ ID NO: 8339

SEQ ID NO: 9658 - protein, 337 aa, unidentified; identical to SEQ ID NO: 8339

SEQ ID NO: 9659 - protein, 337 aa, unidentified; identical to SEQ ID NO: 8339

SEQ ID NO: 9660 - protein, 337 aa, unidentified; identical to SEQ ID NO: 8339

SEQ ID NO: 9661 - protein, 241 aa, unidentified
DTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCSHHFHELFLRDGRKLIVPCRDQHELVGRSMVSQGGSSGVAGTACLAKAYAQMWLMSYFHRRDLRTLGFG

SEQ ID NO: 9662 - protein, 248 aa, unidentified; identical to SEQ ID NO: 8593

SEQ ID NO: 9663 - protein, 337 aa, unidentified; identical to SEQ ID NO: 8339

SEQ ID NO: 9664 - protein, 337 aa, unidentified; identical to SEQ ID NO: 8339

SEQ ID NO: 9665 - protein, 337 aa, unidentified; identical to SEQ ID NO: 8339

SEQ ID NO: 9666 - protein, 337 aa, unidentified; identical to SEQ ID NO: 8339

SEQ ID NO: 9667 - protein, 127 aa, unidentified; identical to SEQ ID NO: 8344

SEQ ID NO: 9668 - protein, 248 aa, unidentified; identical to SEQ ID NO: 8593

SEQ ID NO: 9669 - protein, 127 aa, unidentified; identical to SEQ ID NO: 8344

SEQ ID NO: 9670 - protein, 127 aa, unidentified; identical to SEQ ID NO: 8344

SEQ ID NO: 9671 - protein, 229 aa, unidentified; identical to SEQ ID NO: 8171

SEQ ID NO: 9672 - protein, 258 aa, unidentified; identical to SEQ ID NO: 8309

SEQ ID NO: 9673 - protein, 127 aa, unidentified; identical to SEQ ID NO: 8344

SEQ ID NO: 9674 - protein, 214 aa, unidentified
DTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCSHHFHELFLRDGRKLIVPCRDQHELVGRSMVSQGGSSGVAGT

SEQ ID NO: 9675 - protein, 258 aa, unidentified; identical to SEQ ID NO: 8309

SEQ ID NO: 9676 - protein, 174 aa, unidentified; identical to SEQ ID NO: 8195

SEQ ID NO: 9677 - protein, 174 aa, unidentified; identical to SEQ ID NO: 8195

SEQ ID NO: 9678 - protein, 127 aa, unidentified; identical to SEQ ID NO: 8344

SEQ ID NO: 9679 - protein, 173 aa, unidentified
DTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCS

SEQ ID NO: 9680 - protein, 174 aa, unidentified; identical to SEQ ID NO: 8195

SEQ ID NO: 9681 - protein, 258 aa, unidentified; identical to SEQ ID NO: 8309

SEQ ID NO: 9682 - protein, 154 aa, unidentified; identical to SEQ ID NO: 8743

SEQ ID NO: 9683 - protein, 127 aa, unidentified; identical to SEQ ID NO: 8594

SEQ ID NO: 9684 - protein, 258 aa, unidentified; identical to SEQ ID NO: 8309

SEQ ID NO: 9685 - protein, 258 aa, unidentified; identical to SEQ ID NO: 8309

SEQ ID NO: 9686 - protein, 127 aa, unidentified; identical to SEQ ID NO: 8344

SEQ ID NO: 9687 - protein, 127 aa, unidentified; identical to SEQ ID NO: 8344

SEQ ID NO: 9688 - protein, 258 aa, unidentified; identical to SEQ ID NO: 8309

SEQ ID NO: 9689 - protein, 213 aa, unidentified
DTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCSHHFHELFLRDGRKLIVPCRDQHELVGRSMVSQGGSSGVAG

SEQ ID NO: 9690 - protein, 258 aa, unidentified; identical to SEQ ID NO: 8309

SEQ ID NO: 9691 - protein, 154 aa, unidentified; identical to SEQ ID NO: 8743

SEQ ID NO: 9692 - protein, 174 aa, unidentified; identical to SEQ ID NO: 8195

SEQ ID NO: 9693 - protein, 154 aa, unidentified; identical to SEQ ID NO: 8743

SEQ ID NO: 9694 - protein, 248 aa, unidentified; identical to SEQ ID NO: 8593

SEQ ID NO: 9695 - protein, 337 aa, unidentified; identical to SEQ ID NO: 8339

SEQ ID NO: 9696 - protein, 337 aa, unidentified; identical to SEQ ID NO: 8339

SEQ ID NO: 9697 - protein, 337 aa, unidentified; identical to SEQ ID NO: 8339

SEQ ID NO: 9698 - protein, 337 aa, unidentified; identical to SEQ ID NO: 8339

SEQ ID NO: 9699 - protein, 337 aa, unidentified; identical to SEQ ID NO: 8339

SEQ ID NO: 9700 - protein, 337 aa, unidentified; identical to SEQ ID NO: 8339

SEQ ID NO: 9701 - protein, 337 aa, unidentified; identical to SEQ ID NO: 8339

SEQ ID NO: 9702 - protein, 337 aa, unidentified; identical to SEQ ID NO: 8339

SEQ ID NO: 9703 - protein, 312 aa, unidentified
FEALGFLNEERWASRDISGGGVEGIGINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCSHHFHELFLRDGRKLIVPCRDQHELVGRSMVSQGGSSGVAGTACLAKAYAQMWLMSYFHRRDLRTLGFGIMSSVPKDWFPTGRTTWSVHANHE

SEQ ID NO: 9704 - protein, 337 aa, unidentified; identical to SEQ ID NO: 8339

SEQ ID NO: 9705 - protein, 337 aa, unidentified; identical to SEQ ID NO: 8339

SEQ ID NO: 9706 - protein, 337 aa, unidentified; identical to SEQ ID NO: 8339

SEQ ID NO: 9707 - protein, 337 aa, unidentified; identical to SEQ ID NO: 8339

SEQ ID NO: 9708 - protein, 127 aa, unidentified; identical to SEQ ID NO: 8344

SEQ ID NO: 9709 - protein, 258 aa, unidentified; identical to SEQ ID NO: 8309

SEQ ID NO: 9710 - protein, 127 aa, unidentified; identical to SEQ ID NO: 8344

SEQ ID NO: 9711 - protein, 174 aa, unidentified; identical to SEQ ID NO: 8195

SEQ ID NO: 9712 - protein, 127 aa, unidentified; identical to SEQ ID NO: 8344

SEQ ID NO: 9713 - protein, 258 aa, unidentified; identical to SEQ ID NO: 8309

SEQ ID NO: 9714 - protein, 337 aa, unidentified; identical to SEQ ID NO: 8339

SEQ ID NO: 9715 - protein, 333 aa, unidentified; identical to SEQ ID NO: 8351

SEQ ID NO: 9716 - protein, 337 aa, unidentified; identical to SEQ ID NO: 8339

SEQ ID NO: 9717 - protein, 337 aa, unidentified; identical to SEQ ID NO: 8339

SEQ ID NO: 9718 - protein, 337 aa, unidentified; identical to SEQ ID NO: 8339

SEQ ID NO: 9719 - protein, 337 aa, unidentified; identical to SEQ ID NO: 8339

SEQ ID NO: 9720 - protein, 337 aa, unidentified; identical to SEQ ID NO: 8339

SEQ ID NO: 9721 - protein, 337 aa, unidentified; identical to SEQ ID NO: 8339

SEQ ID NO: 9722 - protein, 337 aa, unidentified; identical to SEQ ID NO: 8339

SEQ ID NO: 9723 - protein, 337 aa, unidentified; identical to SEQ ID NO: 8339

SEQ ID NO: 9724 - protein, 279 aa, unidentified
LGYHLEKMAEKAGILYADDTAGWDTRITMADLEDEYTLTELMEGEHKKLAETLFNFAYKNKVALCPRPGKNGGTVLDVISRTDQRGSGQVVTYALNTLTNIKVQLIRMAESEGVLDEEFHDNGMLKWLEKHGRDRLQRLMVSGDDCVVNAIDERFGKSLVWLNEMQKIRKDIDLWKPSAGHCNWEEVEFCSNHFHKLVMRDGRTLVVPCRHEVELVGRASVNQGGSTGISGTACLAKAYAQMWLLLYFHRRDLRILGMAICSAVPANWVPTGRTTWSLH

SEQ ID NO: 9725 - protein, 235 aa, unidentified; identical to SEQ ID NO: 9303

SEQ ID NO: 9726 - protein, 335 aa, unidentified; identical to SEQ ID NO: 8722

SEQ ID NO: 9727 - protein, 333 aa, unidentified; identical to SEQ ID NO: 8351

SEQ ID NO: 9728 - protein, 333 aa, unidentified; identical to SEQ ID NO: 8351

SEQ ID NO: 9729 - protein, 333 aa, unidentified; identical to SEQ ID NO: 8351

SEQ ID NO: 9730 - protein, 313 aa, unidentified
KGSRTIWYMWLGSRFLEFESFGFLNEEHWASRELSGGGVEGIPLNYLGYHLREMAQKPGVLYADDTAGWDTRITMADLEDEGILLDMMSGEHKKLASALFSKAYKVKVALCPRPGPKGGTLMDVISRTDQRGSGQVVTYALNTLTNIKVQLIRMAEAEGVLGATFEDFGIDRWLQEHGEDRVERMLVSGDDCVVNAIDERFGSSLNWLNAMEKVRKDIDLWKPSPSFRNWERVEFCSNHFHEMTMKDGRVIVAPCRGQTELIARGTVNQGGCVGVESTGCLAKAYAQMWLLLYFHRRDLRTLALAVMSAVPSN

SEQ ID NO: 9731 - protein, 234 aa, unidentified
GVEGIPLNYLGYHLREMAQKPGVLYADDTAGWDTRITMADLEDEGILLDMMSGEHKKLASALFSKAYKVKVALCPRPGPKGGTLMDVISRTDQRGSGQVVTYALNTLTNIKVQLIRMAEAEGVLGATFEDFGIDRWLQEHGEDRVERMLVSGDDCVVNAIDERFGSSLNWLNAMEKVRKDIDLWKPSPSFRNWERVEFCSNHFHEMTMKDGRVIVAPCRGQTELIARGTVNQGG

SEQ ID NO: 9732 - protein, 337 aa, unidentified; identical to SEQ ID NO: 8339

SEQ ID NO: 9733 - protein, 231 aa, unidentified
KPGEFGVAKGSRTIWYMWLGSRFLEFEALGFLNEERWASRDISGGGVEGIGINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKP

SEQ ID NO: 9734 - protein, 248 aa, unidentified
DTAGWDTRITMADLEDEYTLTELMEGEHKKLAETLFNFAYKNKVALCPRPGKNGGTVLDVISRTDQRGSGQVVTYALNTLTNIKVQLIRMAESEGVLDEEFHDNGMLKWLEKHGRDRLQRLMVSGDDCVVNAIDERFGKSLVWLNEMQKIRKDIDLWKPSAGHCNWEEVEFCSNHFHKLVMRDGRTLVVPCRHEVELVGRASVNQGGSTGISGTACLAKAYAQMWLLLYFHRRDLRILGMAICSAVPA

SEQ ID NO: 9735 - protein, 337 aa, unidentified; identical to SEQ ID NO: 8339

SEQ ID NO: 9736 - protein, 337 aa, unidentified; identical to SEQ ID NO: 8339

SEQ ID NO: 9737 - protein, 248 aa, unidentified; identical to SEQ ID NO: 9734

SEQ ID NO: 9738 - protein, 251 aa, unidentified; identical to SEQ ID NO: 8663

SEQ ID NO: 9739 - protein, 22 aa, unidentified
MVPQALLFVPLLVFPLCFGKFP

SEQ ID NO: 9740 - protein, 242 aa, unidentified; identical to SEQ ID NO: 9313

SEQ ID NO: 9741 - protein, 337 aa, unidentified; identical to SEQ ID NO: 8339

SEQ ID NO: 9742 - protein, 248 aa, unidentified; identical to SEQ ID NO: 9734

SEQ ID NO: 9743 - protein, 248 aa, unidentified; identical to SEQ ID NO: 9734

SEQ ID NO: 9744 - protein, 248 aa, unidentified; identical to SEQ ID NO: 9734

SEQ ID NO: 9745 - protein, 96 aa, unidentified
DTAGWDTRITEADLDDECILCDYMEDEHKQLALSLFELCYKNKVALCPRPGRHGGTVMDVIFRRDQRGSGQVVTYALNTLTNIKVQLIRLAESEGV

SEQ ID NO: 9746 - protein, 248 aa, unidentified; identical to SEQ ID NO: 9734

SEQ ID NO: 9747 - protein, 248 aa, unidentified; identical to SEQ ID NO: 9734

SEQ ID NO: 9748 - protein, 337 aa, unidentified; identical to SEQ ID NO: 8339

SEQ ID NO: 9749 - protein, 337 aa, unidentified; identical to SEQ ID NO: 8339

SEQ ID NO: 9750 - protein, 123 aa, unidentified; identical to SEQ ID NO: 9190

SEQ ID NO: 9751 - protein, 337 aa, unidentified; identical to SEQ ID NO: 8339

SEQ ID NO: 9752 - protein, 179 aa, unidentified
VLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCSH

SEQ ID NO: 9753 - protein, 127 aa, unidentified; identical to SEQ ID NO: 8344

SEQ ID NO: 9754 - protein, 258 aa, unidentified; identical to SEQ ID NO: 8309

SEQ ID NO: 9755 - protein, 258 aa, unidentified; identical to SEQ ID NO: 8309

SEQ ID NO: 9756 - protein, 174 aa, unidentified; identical to SEQ ID NO: 8195

SEQ ID NO: 9757 - protein, 248 aa, unidentified; identical to SEQ ID NO: 8593

SEQ ID NO: 9758 - protein, 298 aa, unidentified; identical to SEQ ID NO: 8537

SEQ ID NO: 9759 - protein, 324 aa, unidentified
KGSRTIWYMWLGSRFLEFESFGFLNEEHWASRELCGGGVEGIPLFYLGYHLEKMAEKAGILYADDTAGWDTRITMADLEDEYTLTELMEGEHKKLAETLFNFAYKNKVALCPRPGKNGGTVLDVISRTDQRGSGQVVTYALNTLTNIKVQLIRMAESEGVLDEEFHDNGMLKWLEKHGRDRLQRLMVSGDDCVVNAIDERFGKSLVWLNEMQKIRKDIDLWKPSAGHCNWEEVEFCSNHFHKLVMRDGRTLVVPCRHEVELVGRASVNQGGSTGISGTACLAKAYAQMWLLLYFHRRDLRILGMAICSAVPANWVPTGRTTWSL

SEQ ID NO: 9760 - protein, 335 aa, unidentified; identical to SEQ ID NO: 8722

SEQ ID NO: 9761 - protein, 337 aa, unidentified; identical to SEQ ID NO: 8339

SEQ ID NO: 9762 - protein, 337 aa, unidentified; identical to SEQ ID NO: 8339

SEQ ID NO: 9763 - protein, 324 aa, unidentified
IWYMWLGSRFLEFEALGFLNEERWASRDISGGGVEGIGINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCSHHFHELFLRDGRKLIVPCRDQHELVGRSMVSQGGSSGVAGTACLAKAYAQMWLMSYFHRRDLRTLGFGIMSSVPKDWFPTGRTTWSVHANHE

SEQ ID NO: 9764 - protein, 337 aa, unidentified; identical to SEQ ID NO: 8339

SEQ ID NO: 9765 - protein, 337 aa, unidentified; identical to SEQ ID NO: 8339

SEQ ID NO: 9766 - protein, 337 aa, unidentified; identical to SEQ ID NO: 8339

SEQ ID NO: 9767 - protein, 337 aa, unidentified; identical to SEQ ID NO: 8339

SEQ ID NO: 9768 - protein, 337 aa, unidentified; identical to SEQ ID NO: 8339

SEQ ID NO: 9769 - protein, 337 aa, unidentified; identical to SEQ ID NO: 8339

SEQ ID NO: 9770 - protein, 248 aa, unidentified; identical to SEQ ID NO: 8593

SEQ ID NO: 9771 - protein, 337 aa, unidentified; identical to SEQ ID NO: 8339

SEQ ID NO: 9772 - protein, 333 aa, unidentified; identical to SEQ ID NO: 8351

SEQ ID NO: 9773 - protein, 337 aa, unidentified; identical to SEQ ID NO: 8339

SEQ ID NO: 9774 - protein, 333 aa, unidentified; identical to SEQ ID NO: 8351

SEQ ID NO: 9775 - protein, 333 aa, unidentified; identical to SEQ ID NO: 8351

SEQ ID NO: 9776 - protein, 337 aa, unidentified; identical to SEQ ID NO: 8339

SEQ ID NO: 9777 - protein, 174 aa, unidentified; identical to SEQ ID NO: 8195

SEQ ID NO: 9778 - protein, 127 aa, unidentified; identical to SEQ ID NO: 8344

SEQ ID NO: 9779 - protein, 333 aa, unidentified; identical to SEQ ID NO: 8351

SEQ ID NO: 9780 - protein, 127 aa, unidentified; identical to SEQ ID NO: 8344

SEQ ID NO: 9781 - protein, 154 aa, unidentified; identical to SEQ ID NO: 8743

SEQ ID NO: 9782 - protein, 174 aa, unidentified; identical to SEQ ID NO: 8195

SEQ ID NO: 9783 - protein, 258 aa, unidentified; identical to SEQ ID NO: 8309

SEQ ID NO: 9784 - protein, 174 aa, unidentified; identical to SEQ ID NO: 8195

SEQ ID NO: 9785 - protein, 337 aa, unidentified; identical to SEQ ID NO: 8339

SEQ ID NO: 9786 - protein, 337 aa, unidentified; identical to SEQ ID NO: 8339

SEQ ID NO: 9787 - protein, 333 aa, unidentified; identical to SEQ ID NO: 8351

SEQ ID NO: 9788 - protein, 337 aa, unidentified; identical to SEQ ID NO: 8339

SEQ ID NO: 9789 - protein, 337 aa, unidentified; identical to SEQ ID NO: 8339

SEQ ID NO: 9790 - protein, 337 aa, unidentified; identical to SEQ ID NO: 8339

SEQ ID NO: 9791 - protein, 337 aa, unidentified; identical to SEQ ID NO: 8339

SEQ ID NO: 9792 - protein, 337 aa, unidentified; identical to SEQ ID NO: 8339

SEQ ID NO: 9793 - protein, 337 aa, unidentified; identical to SEQ ID NO: 8339

SEQ ID NO: 9794 - protein, 337 aa, unidentified; identical to SEQ ID NO: 8339

SEQ ID NO: 9795 - protein, 333 aa, unidentified; identical to SEQ ID NO: 8351

SEQ ID NO: 9796 - protein, 337 aa, unidentified; identical to SEQ ID NO: 8339

SEQ ID NO: 9797 - protein, 337 aa, unidentified; identical to SEQ ID NO: 8339

SEQ ID NO: 9798 - protein, 337 aa, unidentified; identical to SEQ ID NO: 8339

SEQ ID NO: 9799 - protein, 337 aa, unidentified; identical to SEQ ID NO: 8339

SEQ ID NO: 9800 - protein, 337 aa, unidentified; identical to SEQ ID NO: 8339

SEQ ID NO: 9801 - protein, 337 aa, unidentified; identical to SEQ ID NO: 8339

SEQ ID NO: 9802 - protein, 337 aa, unidentified; identical to SEQ ID NO: 8339

SEQ ID NO: 9803 - protein, 337 aa, unidentified; identical to SEQ ID NO: 8339

SEQ ID NO: 9804 - protein, 337 aa, unidentified; identical to SEQ ID NO: 8339

SEQ ID NO: 9805 - protein, 337 aa, unidentified; identical to SEQ ID NO: 8339

SEQ ID NO: 9806 - protein, 333 aa, unidentified; identical to SEQ ID NO: 8351

SEQ ID NO: 9807 - protein, 337 aa, unidentified; identical to SEQ ID NO: 8339

SEQ ID NO: 9808 - protein, 258 aa, unidentified; identical to SEQ ID NO: 8309

SEQ ID NO: 9809 - protein, 248 aa, unidentified; identical to SEQ ID NO: 8593

SEQ ID NO: 9810 - protein, 337 aa, unidentified; identical to SEQ ID NO: 8339

SEQ ID NO: 9811 - protein, 337 aa, unidentified; identical to SEQ ID NO: 8339

SEQ ID NO: 9812 - protein, 337 aa, unidentified; identical to SEQ ID NO: 8339

SEQ ID NO: 9813 - protein, 337 aa, unidentified; identical to SEQ ID NO: 8339

SEQ ID NO: 9814 - protein, 337 aa, unidentified; identical to SEQ ID NO: 8339

SEQ ID NO: 9815 - protein, 337 aa, unidentified; identical to SEQ ID NO: 8339

SEQ ID NO: 9816 - protein, 337 aa, unidentified; identical to SEQ ID NO: 8339

SEQ ID NO: 9817 - protein, 337 aa, unidentified; identical to SEQ ID NO: 8339

SEQ ID NO: 9818 - protein, 337 aa, unidentified; identical to SEQ ID NO: 8339

SEQ ID NO: 9819 - protein, 154 aa, unidentified; identical to SEQ ID NO: 8743

SEQ ID NO: 9820 - protein, 127 aa, unidentified; identical to SEQ ID NO: 8344

SEQ ID NO: 9821 - protein, 258 aa, unidentified; identical to SEQ ID NO: 8309

SEQ ID NO: 9822 - protein, 258 aa, unidentified; identical to SEQ ID NO: 8309

SEQ ID NO: 9823 - protein, 229 aa, unidentified; identical to SEQ ID NO: 8171

SEQ ID NO: 9824 - protein, 127 aa, unidentified; identical to SEQ ID NO: 8344

SEQ ID NO: 9825 - protein, 127 aa, unidentified; identical to SEQ ID NO: 8344

SEQ ID NO: 9826 - protein, 248 aa, unidentified; identical to SEQ ID NO: 8593

SEQ ID NO: 9827 - protein, 127 aa, unidentified; identical to SEQ ID NO: 8344

SEQ ID NO: 9828 - protein, 174 aa, unidentified; identical to SEQ ID NO: 8195

SEQ ID NO: 9829 - protein, 127 aa, unidentified; identical to SEQ ID NO: 8344

SEQ ID NO: 9830 - protein, 258 aa, unidentified; identical to SEQ ID NO: 8309

SEQ ID NO: 9831 - protein, 258 aa, unidentified; identical to SEQ ID NO: 8309

SEQ ID NO: 9832 - protein, 154 aa, unidentified; identical to SEQ ID NO: 8743

SEQ ID NO: 9833 - protein, 258 aa, unidentified; identical to SEQ ID NO: 8309

SEQ ID NO: 9834 - protein, 127 aa, unidentified; identical to SEQ ID NO: 8344

SEQ ID NO: 9835 - protein, 154 aa, unidentified; identical to SEQ ID NO: 8743

SEQ ID NO: 9836 - protein, 258 aa, unidentified; identical to SEQ ID NO: 8309

SEQ ID NO: 9837 - protein, 154 aa, unidentified; identical to SEQ ID NO: 8743

SEQ ID NO: 9838 - protein, 174 aa, unidentified; identical to SEQ ID NO: 8195

SEQ ID NO: 9839 - protein, 154 aa, unidentified; identical to SEQ ID NO: 8743

SEQ ID NO: 9840 - protein, 127 aa, unidentified; identical to SEQ ID NO: 8344

SEQ ID NO: 9841 - protein, 248 aa, unidentified; identical to SEQ ID NO: 8593

SEQ ID NO: 9842 - protein, 258 aa, unidentified; identical to SEQ ID NO: 8309

SEQ ID NO: 9843 - protein, 127 aa, unidentified; identical to SEQ ID NO: 8594

SEQ ID NO: 9844 - protein, 258 aa, unidentified; identical to SEQ ID NO: 8309

SEQ ID NO: 9845 - protein, 337 aa, unidentified; identical to SEQ ID NO: 8339

SEQ ID NO: 9846 - protein, 337 aa, unidentified; identical to SEQ ID NO: 8339

SEQ ID NO: 9847 - protein, 337 aa, unidentified; identical to SEQ ID NO: 8339

SEQ ID NO: 9848 - protein, 337 aa, unidentified; identical to SEQ ID NO: 8339

SEQ ID NO: 9849 - protein, 337 aa, unidentified; identical to SEQ ID NO: 8339

SEQ ID NO: 9850 - protein, 337 aa, unidentified; identical to SEQ ID NO: 8339

SEQ ID NO: 9851 - protein, 337 aa, unidentified; identical to SEQ ID NO: 8339

SEQ ID NO: 9852 - protein, 337 aa, unidentified; identical to SEQ ID NO: 8339

SEQ ID NO: 9853 - protein, 337 aa, unidentified; identical to SEQ ID NO: 8339

SEQ ID NO: 9854 - protein, 337 aa, unidentified; identical to SEQ ID NO: 8339

SEQ ID NO: 9855 - protein, 337 aa, unidentified; identical to SEQ ID NO: 8339

SEQ ID NO: 9856 - protein, 337 aa, unidentified; identical to SEQ ID NO: 8339

SEQ ID NO: 9857 - protein, 337 aa, unidentified; identical to SEQ ID NO: 8339

SEQ ID NO: 9858 - protein, 337 aa, unidentified; identical to SEQ ID NO: 8339

SEQ ID NO: 9859 - protein, 333 aa, unidentified
FGVAKGSRTIWYMWLGSRFLEFEALGFLNEERWASRDISGGGVEGIGINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCSHHFHELFLRDGRKLIVPCRDQHELVGRSMVSQGGSSGVAGTACLAKAYAQMWLMSYFHRRDLRTLGFGIMSSVPKDWFPTGRTTWSVHANHE

SEQ ID NO: 9860 - protein, 337 aa, unidentified; identical to SEQ ID NO: 8339

SEQ ID NO: 9861 - protein, 337 aa, unidentified; identical to SEQ ID NO: 8339

SEQ ID NO: 9862 - protein, 337 aa, unidentified; identical to SEQ ID NO: 8339

SEQ ID NO: 9863 - protein, 337 aa, unidentified; identical to SEQ ID NO: 8339

SEQ ID NO: 9864 - protein, 337 aa, unidentified; identical to SEQ ID NO: 8339

SEQ ID NO: 9865 - protein, 337 aa, unidentified; identical to SEQ ID NO: 8339

SEQ ID NO: 9866 - protein, 337 aa, unidentified; identical to SEQ ID NO: 8339

SEQ ID NO: 9867 - protein, 258 aa, unidentified; identical to SEQ ID NO: 8309

SEQ ID NO: 9868 - protein, 258 aa, unidentified; identical to SEQ ID NO: 8309

SEQ ID NO: 9869 - protein, 174 aa, unidentified; identical to SEQ ID NO: 8195

SEQ ID NO: 9870 - protein, 229 aa, unidentified; identical to SEQ ID NO: 8171

SEQ ID NO: 9871 - protein, 127 aa, unidentified; identical to SEQ ID NO: 8344

SEQ ID NO: 9872 - protein, 127 aa, unidentified; identical to SEQ ID NO: 8344

SEQ ID NO: 9873 - protein, 337 aa, unidentified; identical to SEQ ID NO: 8339

SEQ ID NO: 9874 - protein, 337 aa, unidentified; identical to SEQ ID NO: 8339

SEQ ID NO: 9875 - protein, 337 aa, unidentified; identical to SEQ ID NO: 8339

SEQ ID NO: 9876 - protein, 337 aa, unidentified; identical to SEQ ID NO: 8339

SEQ ID NO: 9877 - protein, 337 aa, unidentified; identical to SEQ ID NO: 8339

SEQ ID NO: 9878 - protein, 337 aa, unidentified; identical to SEQ ID NO: 8339

SEQ ID NO: 9879 - protein, 337 aa, unidentified; identical to SEQ ID NO: 8339

SEQ ID NO: 9880 - protein, 337 aa, unidentified; identical to SEQ ID NO: 8339

SEQ ID NO: 9881 - protein, 337 aa, unidentified; identical to SEQ ID NO: 8339

SEQ ID NO: 9882 - protein, 337 aa, unidentified; identical to SEQ ID NO: 8339

SEQ ID NO: 9883 - protein, 196 aa, unidentified
LEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCSHHFHELFLR

SEQ ID NO: 9884 - protein, 337 aa, unidentified; identical to SEQ ID NO: 8339

SEQ ID NO: 9885 - protein, 333 aa, unidentified; identical to SEQ ID NO: 8351

SEQ ID NO: 9886 - protein, 227 aa, unidentified
KPGEFGVAKGSRTIWYMWLGSRFLEFEALGFLNEERWASRDISGGGVEGIGINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIE

SEQ ID NO: 9887 - protein, 337 aa, unidentified; identical to SEQ ID NO: 8339

SEQ ID NO: 9888 - protein, 333 aa, unidentified; identical to SEQ ID NO: 8351

SEQ ID NO: 9889 - protein, 333 aa, unidentified; identical to SEQ ID NO: 8351

SEQ ID NO: 9890 - protein, 292 aa, unidentified
GVEGIGINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCSHHFHELFLRDGRKLIVPCRDQHELVGRSMVSQGGSSGVAGTACLAKAYAQMWLMSYFHRRDLRTLGFGIMSSVPKDWFPTGRTTWSVHANHE

SEQ ID NO: 9891 - protein, 333 aa, unidentified; identical to SEQ ID NO: 8351

SEQ ID NO: 9892 - protein, 313 aa, unidentified; identical to SEQ ID NO: 9730

SEQ ID NO: 9893 - protein, 335 aa, unidentified; identical to SEQ ID NO: 8722

SEQ ID NO: 9894 - protein, 335 aa, unidentified; identical to SEQ ID NO: 8722

SEQ ID NO: 9895 - protein, 160 aa, unidentified
SGGGVEGIGINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVV

SEQ ID NO: 9896 - protein, 337 aa, unidentified; identical to SEQ ID NO: 8339

SEQ ID NO: 9897 - protein, 166 aa, unidentified
VAKGSRTIWYMWLGSRFLEFESFGFLNEEHWASRELCGGGVEGIPLFYLGYHLEKMAEKAGILYADDTAGWDTRITMADLEDEYTLTELMEGEHKKLAETLFNFAYKNKVALCPRPGKNGGTVLDVISRTDQRGSGQVVTYALNTLTNIKVQLIRMAESEGVLDEE

SEQ ID NO: 9898 - protein, 242 aa, unidentified; identical to SEQ ID NO: 9313

SEQ ID NO: 9899 - protein, 57 aa, unidentified; identical to SEQ ID NO: 8179

SEQ ID NO: 9900 - protein, 255 aa, unidentified; identical to SEQ ID NO: 9104

SEQ ID NO: 9901 - protein, 258 aa, unidentified; identical to SEQ ID NO: 8309

SEQ ID NO: 9902 - protein, 242 aa, unidentified; identical to SEQ ID NO: 9313

SEQ ID NO: 9903 - protein, 337 aa, unidentified; identical to SEQ ID NO: 8339

SEQ ID NO: 9904 - protein, 242 aa, unidentified; identical to SEQ ID NO: 9313

SEQ ID NO: 9905 - protein, 337 aa, unidentified; identical to SEQ ID NO: 8339

SEQ ID NO: 9906 - protein, 337 aa, unidentified; identical to SEQ ID NO: 8339

SEQ ID NO: 9907 - protein, 242 aa, unidentified; identical to SEQ ID NO: 9313

SEQ ID NO: 9908 - protein, 229 aa, unidentified; identical to SEQ ID NO: 8171

SEQ ID NO: 9909 - protein, 333 aa, unidentified; identical to SEQ ID NO: 8351

SEQ ID NO: 9910 - protein, 258 aa, unidentified; identical to SEQ ID NO: 8309

SEQ ID NO: 9911 - protein, 258 aa, unidentified; identical to SEQ ID NO: 8309

SEQ ID NO: 9912 - protein, 258 aa, unidentified; identical to SEQ ID NO: 8309

SEQ ID NO: 9913 - protein, 255 aa, unidentified; identical to SEQ ID NO: 9104

SEQ ID NO: 9914 - protein, 258 aa, unidentified; identical to SEQ ID NO: 8309

SEQ ID NO: 9915 - protein, 127 aa, unidentified; identical to SEQ ID NO: 8344

SEQ ID NO: 9916 - protein, 248 aa, unidentified; identical to SEQ ID NO: 8593

SEQ ID NO: 9917 - protein, 174 aa, unidentified; identical to SEQ ID NO: 8195

SEQ ID NO: 9918 - protein, 174 aa, unidentified; identical to SEQ ID NO: 8195

SEQ ID NO: 9919 - protein, 229 aa, unidentified; identical to SEQ ID NO: 8171

SEQ ID NO: 9920 - protein, 258 aa, unidentified; identical to SEQ ID NO: 8309

SEQ ID NO: 9921 - protein, 127 aa, unidentified; identical to SEQ ID NO: 8344

SEQ ID NO: 9922 - protein, 258 aa, unidentified; identical to SEQ ID NO: 8309

SEQ ID NO: 9923 - protein, 174 aa, unidentified; identical to SEQ ID NO: 8195

SEQ ID NO: 9924 - protein, 258 aa, unidentified; identical to SEQ ID NO: 8309

SEQ ID NO: 9925 - protein, 127 aa, unidentified; identical to SEQ ID NO: 8594

SEQ ID NO: 9926 - protein, 258 aa, unidentified; identical to SEQ ID NO: 8309

SEQ ID NO: 9927 - protein, 127 aa, unidentified; identical to SEQ ID NO: 8344

SEQ ID NO: 9928 - protein, 127 aa, unidentified; identical to SEQ ID NO: 8344

SEQ ID NO: 9929 - protein, 229 aa, unidentified; identical to SEQ ID NO: 8171

SEQ ID NO: 9930 - protein, 127 aa, unidentified; identical to SEQ ID NO: 8344

SEQ ID NO: 9931 - protein, 174 aa, unidentified; identical to SEQ ID NO: 8195

SEQ ID NO: 9932 - protein, 127 aa, unidentified; identical to SEQ ID NO: 8344

SEQ ID NO: 9933 - protein, 127 aa, unidentified; identical to SEQ ID NO: 8344

SEQ ID NO: 9934 - protein, 258 aa, unidentified; identical to SEQ ID NO: 8309

SEQ ID NO: 9935 - protein, 127 aa, unidentified
DTAGWDTRITMADLEDEYTLTELMEGEHKKLAETLFNFAYKNKVALCPRPGKNGGTVLDVISRTDQRGSGQVVTYALNTLTNIKVQLIRMAESEGVLDEEFHDNGMLKWLEKHGRDRLQRLMVSGDD

SEQ ID NO: 9936 - protein, 258 aa, unidentified; identical to SEQ ID NO: 8309

SEQ ID NO: 9937 - protein, 127 aa, unidentified; identical to SEQ ID NO: 8344

SEQ ID NO: 9938 - protein, 174 aa, unidentified; identical to SEQ ID NO: 8195

SEQ ID NO: 9939 - protein, 174 aa, unidentified; identical to SEQ ID NO: 8195

SEQ ID NO: 9940 - protein, 87 aa, unidentified
DTAGWDTRVTQADLEDERELLHFMEGEHKRLAEAIFKLTYENKVALCPRPGSKGGTVMDVISRKDQRGSGQVVTYALNTLTNIKVQL

SEQ ID NO: 9941 - protein, 258 aa, unidentified; identical to SEQ ID NO: 8309

SEQ ID NO: 9942 - protein, 174 aa, unidentified; identical to SEQ ID NO: 8195

SEQ ID NO: 9943 - protein, 337 aa, unidentified; identical to SEQ ID NO: 8339

SEQ ID NO: 9944 - protein, 89 aa, unidentified; identical to SEQ ID NO: 8257

SEQ ID NO: 9945 - protein, 248 aa, unidentified; identical to SEQ ID NO: 8593

SEQ ID NO: 9946 - protein, 335 aa, unidentified; identical to SEQ ID NO: 8722

SEQ ID NO: 9947 - protein, 337 aa, unidentified; identical to SEQ ID NO: 8339

SEQ ID NO: 9948 - protein, 337 aa, unidentified; identical to SEQ ID NO: 8339

SEQ ID NO: 9949 - protein, 337 aa, unidentified; identical to SEQ ID NO: 8339

SEQ ID NO: 9950 - protein, 337 aa, unidentified; identical to SEQ ID NO: 8339

SEQ ID NO: 9951 - protein, 248 aa, unidentified; identical to SEQ ID NO: 8593

SEQ ID NO: 9952 - protein, 337 aa, unidentified; identical to SEQ ID NO: 8339

SEQ ID NO: 9953 - protein, 337 aa, unidentified; identical to SEQ ID NO: 8339

SEQ ID NO: 9954 - protein, 174 aa, unidentified; identical to SEQ ID NO: 8195

SEQ ID NO: 9955 - protein, 174 aa, unidentified; identical to SEQ ID NO: 8195

SEQ ID NO: 9956 - protein, 333 aa, unidentified; identical to SEQ ID NO: 8351

SEQ ID NO: 9957 - protein, 333 aa, unidentified; identical to SEQ ID NO: 8351

SEQ ID NO: 9958 - protein, 337 aa, unidentified; identical to SEQ ID NO: 8339

SEQ ID NO: 9959 - protein, 337 aa, unidentified; identical to SEQ ID NO: 8339

SEQ ID NO: 9960 - protein, 337 aa, unidentified; identical to SEQ ID NO: 8339

SEQ ID NO: 9961 - protein, 337 aa, unidentified; identical to SEQ ID NO: 8339

SEQ ID NO: 9962 - protein, 333 aa, unidentified; identical to SEQ ID NO: 8351

SEQ ID NO: 9963 - protein, 333 aa, unidentified; identical to SEQ ID NO: 8351

SEQ ID NO: 9964 - protein, 333 aa, unidentified; identical to SEQ ID NO: 8351

SEQ ID NO: 9965 - protein, 337 aa, unidentified; identical to SEQ ID NO: 8339

SEQ ID NO: 9966 - protein, 337 aa, unidentified; identical to SEQ ID NO: 8339

SEQ ID NO: 9967 - protein, 337 aa, unidentified; identical to SEQ ID NO: 8339

SEQ ID NO: 9968 - protein, 333 aa, unidentified; identical to SEQ ID NO: 8351

SEQ ID NO: 9969 - protein, 337 aa, unidentified; identical to SEQ ID NO: 8339

SEQ ID NO: 9970 - protein, 337 aa, unidentified; identical to SEQ ID NO: 8339

SEQ ID NO: 9971 - protein, 337 aa, unidentified; identical to SEQ ID NO: 8339

SEQ ID NO: 9972 - protein, 337 aa, unidentified; identical to SEQ ID NO: 8339

SEQ ID NO: 9973 - protein, 219 aa, unidentified
KPGEFGVAKGSRTIWYMWLGSRFLEFEALGFLNEERWASRDISGGGVEGIGINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTM

SEQ ID NO: 9974 - protein, 337 aa, unidentified; identical to SEQ ID NO: 8339

SEQ ID NO: 9975 - protein, 337 aa, unidentified; identical to SEQ ID NO: 8339

SEQ ID NO: 9976 - protein, 337 aa, unidentified; identical to SEQ ID NO: 8339

SEQ ID NO: 9977 - protein, 337 aa, unidentified; identical to SEQ ID NO: 8339

SEQ ID NO: 9978 - protein, 337 aa, unidentified; identical to SEQ ID NO: 8339

SEQ ID NO: 9979 - protein, 337 aa, unidentified; identical to SEQ ID NO: 8339

SEQ ID NO: 9980 - protein, 337 aa, unidentified; identical to SEQ ID NO: 8339

SEQ ID NO: 9981 - protein, 337 aa, unidentified; identical to SEQ ID NO: 8339

SEQ ID NO: 9982 - protein, 337 aa, unidentified; identical to SEQ ID NO: 8339

SEQ ID NO: 9983 - protein, 337 aa, unidentified; identical to SEQ ID NO: 8339

SEQ ID NO: 9984 - protein, 127 aa, unidentified; identical to SEQ ID NO: 8344

SEQ ID NO: 9985 - protein, 337 aa, unidentified; identical to SEQ ID NO: 8339

SEQ ID NO: 9986 - protein, 337 aa, unidentified; identical to SEQ ID NO: 8339

SEQ ID NO: 9987 - protein, 219 aa, unidentified; identical to SEQ ID NO: 9973

SEQ ID NO: 9988 - protein, 337 aa, unidentified; identical to SEQ ID NO: 8339

SEQ ID NO: 9989 - protein, 337 aa, unidentified; identical to SEQ ID NO: 8339

SEQ ID NO: 9990 - protein, 303 aa, unidentified
ERWASRDISGGGVEGIGINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCSHHFHELFLRDGRKLIVPCRDQHELVGRSMVSQGGSSGVAGTACLAKAYAQMWLMSYFHRRDLRTLGFGIMSSVPKDWFPTGRTTWSVHANHE

SEQ ID NO: 9991 - protein, 337 aa, unidentified; identical to SEQ ID NO: 8339

SEQ ID NO: 9992 - protein, 337 aa, unidentified; identical to SEQ ID NO: 8339

SEQ ID NO: 9993 - protein, 337 aa, unidentified; identical to SEQ ID NO: 8339

SEQ ID NO: 9994 - protein, 337 aa, unidentified; identical to SEQ ID NO: 8339

SEQ ID NO: 9995 - protein, 337 aa, unidentified; identical to SEQ ID NO: 8339

SEQ ID NO: 9996 - protein, 337 aa, unidentified; identical to SEQ ID NO: 8339

SEQ ID NO: 9997 - protein, 337 aa, unidentified; identical to SEQ ID NO: 8339

SEQ ID NO: 9998 - protein, 337 aa, unidentified; identical to SEQ ID NO: 8339

SEQ ID NO: 9999 - protein, 127 aa, unidentified; identical to SEQ ID NO: 8344

SEQ ID NO: 10000 - protein, 127 aa, unidentified; identical to SEQ ID NO: 8344

SEQ ID NO: 10001 - protein, 127 aa, unidentified; identical to SEQ ID NO: 8594

SEQ ID NO: 10002 - protein, 258 aa, unidentified; identical to SEQ ID NO: 8309

SEQ ID NO: 10003 - protein, 258 aa, unidentified; identical to SEQ ID NO: 8309

SEQ ID NO: 10004 - protein, 127 aa, unidentified; identical to SEQ ID NO: 8344

SEQ ID NO: 10005 - protein, 127 aa, unidentified; identical to SEQ ID NO: 9935

SEQ ID NO: 10006 - protein, 234 aa, unidentified
VLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCSHHFHELFLRDGRKLIVPCRDQHELVGRSMVSQGGSSGVAGTACLAKAYAQMWLMSY

SEQ ID NO: 10007 - protein, 229 aa, unidentified; identical to SEQ ID NO: 8171

SEQ ID NO: 10008 - protein, 248 aa, unidentified; identical to SEQ ID NO: 8593

SEQ ID NO: 10009 - protein, 258 aa, unidentified; identical to SEQ ID NO: 8309

SEQ ID NO: 10010 - protein, 127 aa, unidentified; identical to SEQ ID NO: 8344

SEQ ID NO: 10011 - protein, 333 aa, unidentified; identical to SEQ ID NO: 8351

SEQ ID NO: 10012 - protein, 337 aa, unidentified; identical to SEQ ID NO: 8339

SEQ ID NO: 10013 - protein, 337 aa, unidentified; identical to SEQ ID NO: 8339

SEQ ID NO: 10014 - protein, 337 aa, unidentified; identical to SEQ ID NO: 8339

SEQ ID NO: 10015 - protein, 337 aa, unidentified; identical to SEQ ID NO: 8339

SEQ ID NO: 10016 - protein, 337 aa, unidentified; identical to SEQ ID NO: 8339

SEQ ID NO: 10017 - protein, 337 aa, unidentified; identical to SEQ ID NO: 8339

SEQ ID NO: 10018 - protein, 337 aa, unidentified; identical to SEQ ID NO: 8339

SEQ ID NO: 10019 - protein, 238 aa, unidentified; identical to SEQ ID NO: 9388

SEQ ID NO: 10020 - protein, 333 aa, unidentified; identical to SEQ ID NO: 8351

SEQ ID NO: 10021 - protein, 337 aa, unidentified; identical to SEQ ID NO: 8339

SEQ ID NO: 10022 - protein, 232 aa, unidentified
KPGEFGVAKGSRTIWYMWLGSRFLEFEALGFLNEERWASRDISGGGVEGIGINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPS

SEQ ID NO: 10023 - protein, 206 aa, unidentified
KPGEFGVAKGSRTIWYMWLGSRFLEFEALGFLNEERWASRDISGGGVEGIGINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALD

SEQ ID NO: 10024 - protein, 239 aa, unidentified
KPGEFGVAKGSRTIWYMWLGSRFLEFEALGFLNEERWASRDISGGGVEGIGINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQ

SEQ ID NO: 10025 - protein, 274 aa, unidentified
EKMAEKAGILYADDTAGWDTRITMADLEDEYTLTELMEGEHKKLAETLFNFAYKNKVALCPRPGKNGGTVLDVISRTDQRGSGQVVTYALNTLTNIKVQLIRMAESEGVLDEEFHDNGMLKWLEKHGRDRLQRLMVSGDDCVVNAIDERFGKSLVWLNEMQKIRKDIDLWKPSAGHCNWEEVEFCSNHFHKLVMRDGRTLVVPCRHEVELVGRASVNQGGSTGISGTACLAKAYAQMWLLLYFHRRDLRILGMAICSAVPANWVPTGRTTWSLH

SEQ ID NO: 10026 - protein, 335 aa, unidentified; identical to SEQ ID NO: 8722

SEQ ID NO: 10027 - protein, 335 aa, unidentified; identical to SEQ ID NO: 8722

SEQ ID NO: 10028 - protein, 335 aa, unidentified; identical to SEQ ID NO: 8722

SEQ ID NO: 10029 - protein, 335 aa, unidentified; identical to SEQ ID NO: 8722

SEQ ID NO: 10030 - protein, 333 aa, unidentified; identical to SEQ ID NO: 8351

SEQ ID NO: 10031 - protein, 333 aa, unidentified; identical to SEQ ID NO: 8351

SEQ ID NO: 10032 - protein, 313 aa, unidentified; identical to SEQ ID NO: 9730

SEQ ID NO: 10033 - protein, 258 aa, unidentified; identical to SEQ ID NO: 8309

SEQ ID NO: 10034 - protein, 258 aa, unidentified; identical to SEQ ID NO: 8309

SEQ ID NO: 10035 - protein, 242 aa, unidentified; identical to SEQ ID NO: 9313

SEQ ID NO: 10036 - protein, 96 aa, unidentified; identical to SEQ ID NO: 9745

SEQ ID NO: 10037 - protein, 242 aa, unidentified; identical to SEQ ID NO: 9313

SEQ ID NO: 10038 - protein, 242 aa, unidentified; identical to SEQ ID NO: 9313

SEQ ID NO: 10039 - protein, 242 aa, unidentified; identical to SEQ ID NO: 9313

SEQ ID NO: 10040 - protein, 337 aa, unidentified; identical to SEQ ID NO: 8339

SEQ ID NO: 10041 - protein, 337 aa, unidentified; identical to SEQ ID NO: 8339

SEQ ID NO: 10042 - protein, 248 aa, unidentified; identical to SEQ ID NO: 9734

SEQ ID NO: 10043 - protein, 174 aa, unidentified; identical to SEQ ID NO: 8195

SEQ ID NO: 10044 - protein, 255 aa, unidentified; identical to SEQ ID NO: 9104

SEQ ID NO: 10045 - protein, 258 aa, unidentified; identical to SEQ ID NO: 8309

SEQ ID NO: 10046 - protein, 337 aa, unidentified; identical to SEQ ID NO: 8339

SEQ ID NO: 10047 - protein, 337 aa, unidentified; identical to SEQ ID NO: 8339

SEQ ID NO: 10048 - protein, 337 aa, unidentified; identical to SEQ ID NO: 8339

SEQ ID NO: 10049 - protein, 248 aa, unidentified; identical to SEQ ID NO: 8593

SEQ ID NO: 10050 - protein, 337 aa, unidentified; identical to SEQ ID NO: 8339

SEQ ID NO: 10051 - protein, 337 aa, unidentified; identical to SEQ ID NO: 8339

SEQ ID NO: 10052 - protein, 333 aa, unidentified; identical to SEQ ID NO: 8351

SEQ ID NO: 10053 - protein, 333 aa, unidentified; identical to SEQ ID NO: 8351

SEQ ID NO: 10054 - protein, 337 aa, unidentified; identical to SEQ ID NO: 8339

SEQ ID NO: 10055 - protein, 333 aa, unidentified; identical to SEQ ID NO: 8351

SEQ ID NO: 10056 - protein, 333 aa, unidentified; identical to SEQ ID NO: 8351

SEQ ID NO: 10057 - protein, 333 aa, unidentified; identical to SEQ ID NO: 8351

SEQ ID NO: 10058 - protein, 333 aa, unidentified; identical to SEQ ID NO: 8351

SEQ ID NO: 10059 - protein, 333 aa, unidentified; identical to SEQ ID NO: 8351

SEQ ID NO: 10060 - protein, 333 aa, unidentified; identical to SEQ ID NO: 8351

SEQ ID NO: 10061 - protein, 337 aa, unidentified; identical to SEQ ID NO: 8339

SEQ ID NO: 10062 - protein, 337 aa, unidentified; identical to SEQ ID NO: 8339

SEQ ID NO: 10063 - protein, 337 aa, unidentified; identical to SEQ ID NO: 8339

SEQ ID NO: 10064 - protein, 337 aa, unidentified; identical to SEQ ID NO: 8339

SEQ ID NO: 10065 - protein, 333 aa, unidentified; identical to SEQ ID NO: 8351

SEQ ID NO: 10066 - protein, 333 aa, unidentified; identical to SEQ ID NO: 8351

SEQ ID NO: 10067 - protein, 333 aa, unidentified; identical to SEQ ID NO: 8351

SEQ ID NO: 10068 - protein, 337 aa, unidentified; identical to SEQ ID NO: 8339

SEQ ID NO: 10069 - protein, 337 aa, unidentified; identical to SEQ ID NO: 8339

SEQ ID NO: 10070 - protein, 337 aa, unidentified; identical to SEQ ID NO: 8339

SEQ ID NO: 10071 - protein, 337 aa, unidentified; identical to SEQ ID NO: 8339

SEQ ID NO: 10072 - protein, 335 aa, unidentified; identical to SEQ ID NO: 8722

SEQ ID NO: 10073 - protein, 337 aa, unidentified; identical to SEQ ID NO: 8339

SEQ ID NO: 10074 - protein, 337 aa, unidentified; identical to SEQ ID NO: 8339

SEQ ID NO: 10075 - protein, 337 aa, unidentified; identical to SEQ ID NO: 8339

SEQ ID NO: 10076 - protein, 239 aa, unidentified; identical to SEQ ID NO: 10024

SEQ ID NO: 10077 - protein, 337 aa, unidentified; identical to SEQ ID NO: 8339

SEQ ID NO: 10078 - protein, 239 aa, unidentified; identical to SEQ ID NO: 10024

SEQ ID NO: 10079 - protein, 337 aa, unidentified; identical to SEQ ID NO: 8339

SEQ ID NO: 10080 - protein, 248 aa, unidentified; identical to SEQ ID NO: 8593

SEQ ID NO: 10081 - protein, 337 aa, unidentified; identical to SEQ ID NO: 8339

SEQ ID NO: 10082 - protein, 337 aa, unidentified; identical to SEQ ID NO: 8339

SEQ ID NO: 10083 - protein, 337 aa, unidentified; identical to SEQ ID NO: 8339

SEQ ID NO: 10084 - protein, 174 aa, unidentified; identical to SEQ ID NO: 8195

SEQ ID NO: 10085 - protein, 248 aa, unidentified; identical to SEQ ID NO: 8593

SEQ ID NO: 10086 - protein, 127 aa, unidentified; identical to SEQ ID NO: 8344

SEQ ID NO: 10087 - protein, 258 aa, unidentified; identical to SEQ ID NO: 8309

SEQ ID NO: 10088 - protein, 174 aa, unidentified; identical to SEQ ID NO: 8195

SEQ ID NO: 10089 - protein, 258 aa, unidentified; identical to SEQ ID NO: 8309

SEQ ID NO: 10090 - protein, 154 aa, unidentified; identical to SEQ ID NO: 8743

SEQ ID NO: 10091 - protein, 258 aa, unidentified; identical to SEQ ID NO: 8309

SEQ ID NO: 10092 - protein, 174 aa, unidentified; identical to SEQ ID NO: 8195

SEQ ID NO: 10093 - protein, 174 aa, unidentified; identical to SEQ ID NO: 8195

SEQ ID NO: 10094 - protein, 174 aa, unidentified; identical to SEQ ID NO: 8195

SEQ ID NO: 10095 - protein, 127 aa, unidentified; identical to SEQ ID NO: 8344

SEQ ID NO: 10096 - protein, 174 aa, unidentified; identical to SEQ ID NO: 8195

SEQ ID NO: 10097 - protein, 174 aa, unidentified; identical to SEQ ID NO: 8195

SEQ ID NO: 10098 - protein, 258 aa, unidentified; identical to SEQ ID NO: 8309

SEQ ID NO: 10099 - protein, 258 aa, unidentified; identical to SEQ ID NO: 8309

SEQ ID NO: 10100 - protein, 174 aa, unidentified; identical to SEQ ID NO: 8195

SEQ ID NO: 10101 - protein, 258 aa, unidentified; identical to SEQ ID NO: 8309

SEQ ID NO: 10102 - protein, 248 aa, unidentified; identical to SEQ ID NO: 8593

SEQ ID NO: 10103 - protein, 229 aa, unidentified; identical to SEQ ID NO: 8171

SEQ ID NO: 10104 - protein, 226 aa, unidentified
DTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCSHHFHELFLRDGRKLIVPCRDQHELVGRSMVSQGGSSGVAGTACLAKAYAQMWL

SEQ ID NO: 10105 - protein, 127 aa, unidentified; identical to SEQ ID NO: 8344

SEQ ID NO: 10106 - protein, 174 aa, unidentified; identical to SEQ ID NO: 8195

SEQ ID NO: 10107 - protein, 258 aa, unidentified; identical to SEQ ID NO: 8309

SEQ ID NO: 10108 - protein, 89 aa, unidentified; identical to SEQ ID NO: 8257

SEQ ID NO: 10109 - protein, 333 aa, unidentified; identical to SEQ ID NO: 8351

SEQ ID NO: 10110 - protein, 156 aa, unidentified; identical to SEQ ID NO: 8215

SEQ ID NO: 10111 - protein, 73 aa, unidentified; identical to SEQ ID NO: 8260

SEQ ID NO: 10112 - protein, 337 aa, unidentified; identical to SEQ ID NO: 8339

SEQ ID NO: 10113 - protein, 295 aa, unidentified; identical to SEQ ID NO: 9624

SEQ ID NO: 10114 - protein, 337 aa, unidentified; identical to SEQ ID NO: 8339

SEQ ID NO: 10115 - protein, 221 aa, unidentified; identical to SEQ ID NO: 9380

SEQ ID NO: 10116 - protein, 33 aa, unidentified
EVIDPIFYGTRCSPINSFDSHWFCKSVNNLIMW

SEQ ID NO: 10117 - protein, 337 aa, unidentified; identical to SEQ ID NO: 8339

SEQ ID NO: 10118 - protein, 337 aa, unidentified; identical to SEQ ID NO: 8339

SEQ ID NO: 10119 - protein, 337 aa, unidentified; identical to SEQ ID NO: 8339

SEQ ID NO: 10120 - protein, 337 aa, unidentified; identical to SEQ ID NO: 8339

SEQ ID NO: 10121 - protein, 324 aa, unidentified; identical to SEQ ID NO: 9763

SEQ ID NO: 10122 - protein, 337 aa, unidentified; identical to SEQ ID NO: 8339

SEQ ID NO: 10123 - protein, 301 aa, unidentified
KPGEFGVAKGSRTIWYMWLGSRFLEFEALGFLNEERWASRDISGGGVEGIGINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCSHHFHELFLRDGRKLIVPCRDQHELVGRSMVSQGGSSGVAGTACLAKAYAQMWLMSY

SEQ ID NO: 10124 - protein, 337 aa, unidentified; identical to SEQ ID NO: 8339

SEQ ID NO: 10125 - protein, 337 aa, unidentified; identical to SEQ ID NO: 8339

SEQ ID NO: 10126 - protein, 337 aa, unidentified; identical to SEQ ID NO: 8339

SEQ ID NO: 10127 - protein, 337 aa, unidentified; identical to SEQ ID NO: 8339

SEQ ID NO: 10128 - protein, 337 aa, unidentified; identical to SEQ ID NO: 8339

SEQ ID NO: 10129 - protein, 337 aa, unidentified; identical to SEQ ID NO: 8339

SEQ ID NO: 10130 - protein, 337 aa, unidentified; identical to SEQ ID NO: 8339

SEQ ID NO: 10131 - protein, 127 aa, unidentified; identical to SEQ ID NO: 8344

SEQ ID NO: 10132 - protein, 229 aa, unidentified; identical to SEQ ID NO: 8171

SEQ ID NO: 10133 - protein, 127 aa, unidentified; identical to SEQ ID NO: 8344

SEQ ID NO: 10134 - protein, 333 aa, unidentified; identical to SEQ ID NO: 8351

SEQ ID NO: 10135 - protein, 337 aa, unidentified; identical to SEQ ID NO: 8339

SEQ ID NO: 10136 - protein, 337 aa, unidentified; identical to SEQ ID NO: 8339

SEQ ID NO: 10137 - protein, 337 aa, unidentified; identical to SEQ ID NO: 8339

SEQ ID NO: 10138 - protein, 337 aa, unidentified; identical to SEQ ID NO: 8339

SEQ ID NO: 10139 - protein, 337 aa, unidentified; identical to SEQ ID NO: 8339

SEQ ID NO: 10140 - protein, 337 aa, unidentified; identical to SEQ ID NO: 8339

SEQ ID NO: 10141 - protein, 337 aa, unidentified; identical to SEQ ID NO: 8339

SEQ ID NO: 10142 - protein, 337 aa, unidentified; identical to SEQ ID NO: 8339

SEQ ID NO: 10143 - protein, 333 aa, unidentified; identical to SEQ ID NO: 8351

SEQ ID NO: 10144 - protein, 333 aa, unidentified; identical to SEQ ID NO: 8351

SEQ ID NO: 10145 - protein, 337 aa, unidentified; identical to SEQ ID NO: 8339

SEQ ID NO: 10146 - protein, 333 aa, unidentified; identical to SEQ ID NO: 8351

SEQ ID NO: 10147 - protein, 337 aa, unidentified; identical to SEQ ID NO: 8339

SEQ ID NO: 10148 - protein, 333 aa, unidentified; identical to SEQ ID NO: 8351

SEQ ID NO: 10149 - protein, 333 aa, unidentified; identical to SEQ ID NO: 8351

SEQ ID NO: 10150 - protein, 335 aa, unidentified; identical to SEQ ID NO: 8722

SEQ ID NO: 10151 - protein, 335 aa, unidentified; identical to SEQ ID NO: 8722

SEQ ID NO: 10152 - protein, 333 aa, unidentified; identical to SEQ ID NO: 8351

SEQ ID NO: 10153 - protein, 333 aa, unidentified; identical to SEQ ID NO: 8351

SEQ ID NO: 10154 - protein, 333 aa, unidentified; identical to SEQ ID NO: 8351

SEQ ID NO: 10155 - protein, 333 aa, unidentified; identical to SEQ ID NO: 8351

SEQ ID NO: 10156 - protein, 313 aa, unidentified; identical to SEQ ID NO: 9730

SEQ ID NO: 10157 - protein, 313 aa, unidentified; identical to SEQ ID NO: 9730

SEQ ID NO: 10158 - protein, 248 aa, unidentified; identical to SEQ ID NO: 9734

SEQ ID NO: 10159 - protein, 265 aa, unidentified
DTAGWDTRITMADLEDEGILLDMMSGEHKKLASALFSKAYKVKVALCPRPGPKGGTLMDVISRTDQRGSGQVVTYALNTLTNIKVQLIRMAEAEGVLGATFEDFGIDRWLQEHGEDRVERMLVSGDDCVVNAIDERFGSSLNWLNAMEKVRKDIDLWKPSPSFRNWERVEFCSNHFHEMTMKDGRVIVAPCRGQTELIARGTVNQGGCVGVESTGCLAKAYAQMWLLLYFHRRDLRTLALAVMSAVPSNWIPTGRTTWSLMVKGE

SEQ ID NO: 10160 - protein, 337 aa, unidentified; identical to SEQ ID NO: 8339

SEQ ID NO: 10161 - protein, 256 aa, unidentified; identical to SEQ ID NO: 9141

SEQ ID NO: 10162 - protein, 337 aa, unidentified; identical to SEQ ID NO: 8339

SEQ ID NO: 10163 - protein, 242 aa, unidentified; identical to SEQ ID NO: 9313

SEQ ID NO: 10164 - protein, 337 aa, unidentified; identical to SEQ ID NO: 8339

SEQ ID NO: 10165 - protein, 337 aa, unidentified; identical to SEQ ID NO: 8339

SEQ ID NO: 10166 - protein, 242 aa, unidentified; identical to SEQ ID NO: 9313

SEQ ID NO: 10167 - protein, 242 aa, unidentified; identical to SEQ ID NO: 9313

SEQ ID NO: 10168 - protein, 337 aa, unidentified; identical to SEQ ID NO: 8339

SEQ ID NO: 10169 - protein, 242 aa, unidentified; identical to SEQ ID NO: 9313

SEQ ID NO: 10170 - protein, 248 aa, unidentified; identical to SEQ ID NO: 9734

SEQ ID NO: 10171 - protein, 248 aa, unidentified; identical to SEQ ID NO: 9734

SEQ ID NO: 10172 - protein, 265 aa, unidentified; identical to SEQ ID NO: 10159

SEQ ID NO: 10173 - protein, 248 aa, unidentified; identical to SEQ ID NO: 9734

SEQ ID NO: 10174 - protein, 248 aa, unidentified; identical to SEQ ID NO: 9734

SEQ ID NO: 10175 - protein, 248 aa, unidentified; identical to SEQ ID NO: 9734

SEQ ID NO: 10176 - protein, 337 aa, unidentified; identical to SEQ ID NO: 8339

SEQ ID NO: 10177 - protein, 258 aa, unidentified; identical to SEQ ID NO: 8309

SEQ ID NO: 10178 - protein, 258 aa, unidentified; identical to SEQ ID NO: 8309

SEQ ID NO: 10179 - protein, 258 aa, unidentified; identical to SEQ ID NO: 8309

SEQ ID NO: 10180 - protein, 258 aa, unidentified; identical to SEQ ID NO: 8309

SEQ ID NO: 10181 - protein, 62 aa, unidentified
ANLSSNQMILSDQVTIDQSTIENILSDLTEHGLRLNEAEKSFNNSHLCIVRNETHDVNHLLR

SEQ ID NO: 10182 - protein, 179 aa, unidentified; identical to SEQ ID NO: 9752

SEQ ID NO: 10183 - protein, 258 aa, unidentified; identical to SEQ ID NO: 8309

SEQ ID NO: 10184 - protein, 127 aa, unidentified; identical to SEQ ID NO: 8594

SEQ ID NO: 10185 - protein, 127 aa, unidentified; identical to SEQ ID NO: 8344

SEQ ID NO: 10186 - protein, 199 aa, unidentified; identical to SEQ ID NO: 8585

SEQ ID NO: 10187 - protein, 310 aa, unidentified; identical to SEQ ID NO: 8617

SEQ ID NO: 10188 - protein, 337 aa, unidentified; identical to SEQ ID NO: 8339

SEQ ID NO: 10189 - protein, 337 aa, unidentified; identical to SEQ ID NO: 8339

SEQ ID NO: 10190 - protein, 337 aa, unidentified; identical to SEQ ID NO: 8339

SEQ ID NO: 10191 - protein, 229 aa, unidentified; identical to SEQ ID NO: 8171

SEQ ID NO: 10192 - protein, 229 aa, unidentified; identical to SEQ ID NO: 8171

SEQ ID NO: 10193 - protein, 258 aa, unidentified; identical to SEQ ID NO: 8309

SEQ ID NO: 10194 - protein, 258 aa, unidentified; identical to SEQ ID NO: 8309

SEQ ID NO: 10195 - protein, 57 aa, unidentified; identical to SEQ ID NO: 8179

SEQ ID NO: 10196 - protein, 248 aa, unidentified; identical to SEQ ID NO: 8593

SEQ ID NO: 10197 - protein, 258 aa, unidentified; identical to SEQ ID NO: 8309

SEQ ID NO: 10198 - protein, 258 aa, unidentified; identical to SEQ ID NO: 8309

SEQ ID NO: 10199 - protein, 310 aa, unidentified; identical to SEQ ID NO: 9321

SEQ ID NO: 10200 - protein, 231 aa, unidentified; identical to SEQ ID NO: 9315

SEQ ID NO: 10201 - protein, 231 aa, unidentified; identical to SEQ ID NO: 9315

SEQ ID NO: 10202 - protein, 33 aa, unidentified; identical to SEQ ID NO: 8702

SEQ ID NO: 10203 - protein, 33 aa, unidentified; identical to SEQ ID NO: 8702

SEQ ID NO: 10204 - protein, 187 aa, unidentified
DDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCSHHFHELFLRDGRK

SEQ ID NO: 10205 - protein, 317 aa, unidentified
KGSRTIWYMWLGSRFLEFESFGFLNEEHWASRELCGGGVEGIPLFYLGYHLEKMAEKAGILYADDTAGWDTRITMADLEDEYTLTELMEGEHKKLAETLFNFAYKNKVALCPRPGKNGGTVLDVISRTDQRGSGQVVTYALNTLTNIKVQLIRMAESEGVLDEEFHDNGMLKWLEKHGRDRLQRLMVSGDDCVVNAIDERFGKSLVWLNEMQKIRKDIDLWKPSAGHCNWEEVEFCSNHFHKLVMRDGRTLVVPCRHEVELVGRASVNQGGSTGISGTACLAKAYAQMWLLLYFHRRDLRILGMAICSAVPANWVPT

SEQ ID NO: 10206 - protein, 249 aa, unidentified
KPGEFGVAKGSRTIWYMWLGSRFLEFEALGFLNEERWASRDISGGGVEGIGINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCSHHFH

SEQ ID NO: 10207 - protein, 337 aa, unidentified; identical to SEQ ID NO: 8339

SEQ ID NO: 10208 - protein, 268 aa, unidentified; identical to SEQ ID NO: 9364

SEQ ID NO: 10209 - protein, 310 aa, unidentified; identical to SEQ ID NO: 8617

SEQ ID NO: 10210 - protein, 199 aa, unidentified; identical to SEQ ID NO: 8585

SEQ ID NO: 10211 - protein, 337 aa, unidentified; identical to SEQ ID NO: 8339

SEQ ID NO: 10212 - protein, 199 aa, unidentified; identical to SEQ ID NO: 8585

SEQ ID NO: 10213 - protein, 127 aa, unidentified; identical to SEQ ID NO: 8344

SEQ ID NO: 10214 - protein, 127 aa, unidentified; identical to SEQ ID NO: 8344

SEQ ID NO: 10215 - protein, 337 aa, unidentified; identical to SEQ ID NO: 8339

SEQ ID NO: 10216 - protein, 337 aa, unidentified; identical to SEQ ID NO: 8339

SEQ ID NO: 10217 - protein, 337 aa, unidentified
KPGDFGVAKGSRTIWYMWLGSRFLEFESFGFLNEEHWASRELSGGGVEGIPLNYLGYHLREMAQKPGVLYADDTAGWDTRITMADLEDEGILLDMMSGEHKKLASALFSKAYKVKVALCPRPGPKGGTLMDVISRTDQRGSGQVVTYALNTLTNIKVQLIRMAEAEGVLGATFEDFGIDRWLQEHGEDRVERMLVSGDDCVVNAIDERFGSSLNWLNAMEKVRKDIDLWKPSPSFRNWERVEFCSNHFHEMTMKDGRVIVAPCRGQTELIARGTVNQGGCVGVESTGCLAKAYAQMWLLLYFHRRDLRTLALAVMSAVPSNWIPTGRTTWSLMVKGE

SEQ ID NO: 10218 - protein, 337 aa, unidentified; identical to SEQ ID NO: 8339

SEQ ID NO: 10219 - protein, 333 aa, unidentified; identical to SEQ ID NO: 8351

SEQ ID NO: 10220 - protein, 333 aa, unidentified; identical to SEQ ID NO: 8351

SEQ ID NO: 10221 - protein, 96 aa, unidentified; identical to SEQ ID NO: 8176

SEQ ID NO: 10222 - protein, 127 aa, unidentified; identical to SEQ ID NO: 8344

SEQ ID NO: 10223 - protein, 258 aa, unidentified; identical to SEQ ID NO: 8309

SEQ ID NO: 10224 - protein, 258 aa, unidentified; identical to SEQ ID NO: 8309

SEQ ID NO: 10225 - protein, 229 aa, unidentified; identical to SEQ ID NO: 8171

SEQ ID NO: 10226 - protein, 258 aa, unidentified; identical to SEQ ID NO: 8309

SEQ ID NO: 10227 - protein, 258 aa, unidentified; identical to SEQ ID NO: 8309

SEQ ID NO: 10228 - protein, 127 aa, unidentified; identical to SEQ ID NO: 8344

SEQ ID NO: 10229 - protein, 127 aa, unidentified; identical to SEQ ID NO: 8344

SEQ ID NO: 10230 - protein, 172 aa, unidentified
DTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFC

SEQ ID NO: 10231 - protein, 248 aa, unidentified; identical to SEQ ID NO: 8593

SEQ ID NO: 10232 - protein, 127 aa, unidentified; identical to SEQ ID NO: 8344

SEQ ID NO: 10233 - protein, 248 aa, unidentified; identical to SEQ ID NO: 8593

SEQ ID NO: 10234 - protein, 246 aa, unidentified
DTAGWDTRITEADLDDECILCDYMEDEHKQLALSLFELCYKNKVALCPRPGRHGGTVMDVIFRRDQRGSGQVVTYALNTLTNIKVQLIRLAESEGVLDEDFNDHGIETWLNHYGEERLSRLLISGDDCLVNAFDERFGKALTWLNTMEKIRKDIDLCAPSNGYENFEKVEFCSNHFHELMLKDGRQLVVPCRSQNELVGRASVNQGGSATVAGTACLAKAYAQMWNLLYFHRRDLRLLGFAIMSAT

SEQ ID NO: 10235 - protein, 248 aa, unidentified; identical to SEQ ID NO: 8593

SEQ ID NO: 10236 - protein, 258 aa, unidentified; identical to SEQ ID NO: 8309

SEQ ID NO: 10237 - protein, 258 aa, unidentified; identical to SEQ ID NO: 8309

SEQ ID NO: 10238 - protein, 258 aa, unidentified; identical to SEQ ID NO: 8309

SEQ ID NO: 10239 - protein, 337 aa, unidentified; identical to SEQ ID NO: 8339

SEQ ID NO: 10240 - protein, 258 aa, unidentified; identical to SEQ ID NO: 8309

SEQ ID NO: 10241 - protein, 229 aa, unidentified; identical to SEQ ID NO: 8171

SEQ ID NO: 10242 - protein, 258 aa, unidentified; identical to SEQ ID NO: 8309

SEQ ID NO: 10243 - protein, 258 aa, unidentified; identical to SEQ ID NO: 8309

SEQ ID NO: 10244 - protein, 57 aa, unidentified; identical to SEQ ID NO: 8179

SEQ ID NO: 10245 - protein, 278 aa, unidentified; identical to SEQ ID NO: 8332

SEQ ID NO: 10246 - protein, 258 aa, unidentified; identical to SEQ ID NO: 8309

SEQ ID NO: 10247 - protein, 248 aa, unidentified; identical to SEQ ID NO: 8593

SEQ ID NO: 10248 - protein, 337 aa, unidentified; identical to SEQ ID NO: 8339

SEQ ID NO: 10249 - protein, 258 aa, unidentified; identical to SEQ ID NO: 8309

SEQ ID NO: 10250 - protein, 258 aa, unidentified; identical to SEQ ID NO: 8309

SEQ ID NO: 10251 - protein, 258 aa, unidentified; identical to SEQ ID NO: 8309

SEQ ID NO: 10252 - protein, 258 aa, unidentified; identical to SEQ ID NO: 8309

SEQ ID NO: 10253 - protein, 258 aa, unidentified; identical to SEQ ID NO: 8309

SEQ ID NO: 10254 - protein, 57 aa, unidentified; identical to SEQ ID NO: 8179

SEQ ID NO: 10255 - protein, 248 aa, unidentified; identical to SEQ ID NO: 8593

SEQ ID NO: 10256 - protein, 258 aa, unidentified; identical to SEQ ID NO: 8309

SEQ ID NO: 10257 - protein, 174 aa, unidentified; identical to SEQ ID NO: 8195

SEQ ID NO: 10258 - protein, 258 aa, unidentified; identical to SEQ ID NO: 8309

SEQ ID NO: 10259 - protein, 258 aa, unidentified; identical to SEQ ID NO: 8309

SEQ ID NO: 10260 - protein, 258 aa, unidentified; identical to SEQ ID NO: 8309

SEQ ID NO: 10261 - protein, 246 aa, unidentified; identical to SEQ ID NO: 10234

SEQ ID NO: 10262 - protein, 258 aa, unidentified; identical to SEQ ID NO: 8309

SEQ ID NO: 10263 - protein, 248 aa, unidentified; identical to SEQ ID NO: 8593

SEQ ID NO: 10264 - protein, 258 aa, unidentified; identical to SEQ ID NO: 8309

SEQ ID NO: 10265 - protein, 258 aa, unidentified; identical to SEQ ID NO: 8309

SEQ ID NO: 10266 - protein, 258 aa, unidentified; identical to SEQ ID NO: 8309

SEQ ID NO: 10267 - protein, 127 aa, unidentified; identical to SEQ ID NO: 8344

SEQ ID NO: 10268 - protein, 57 aa, unidentified; identical to SEQ ID NO: 8179

SEQ ID NO: 10269 - protein, 219 aa, unidentified
DTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCSHHFHELFLRDGRKLIVPCRDQHELVGRSMVSQGGSSGVAGTACLAK

SEQ ID NO: 10270 - protein, 60 aa, unidentified; identical to SEQ ID NO: 8986

SEQ ID NO: 10271 - protein, 337 aa, unidentified; identical to SEQ ID NO: 8339

SEQ ID NO: 10272 - protein, 248 aa, unidentified; identical to SEQ ID NO: 8593

SEQ ID NO: 10273 - protein, 248 aa, unidentified; identical to SEQ ID NO: 8593

SEQ ID NO: 10274 - protein, 258 aa, unidentified; identical to SEQ ID NO: 8309

SEQ ID NO: 10275 - protein, 220 aa, unidentified; identical to SEQ ID NO: 9246

SEQ ID NO: 10276 - protein, 337 aa, unidentified; identical to SEQ ID NO: 8339

SEQ ID NO: 10277 - protein, 255 aa, unidentified; identical to SEQ ID NO: 9104

SEQ ID NO: 10278 - protein, 255 aa, unidentified; identical to SEQ ID NO: 9104

SEQ ID NO: 10279 - protein, 248 aa, unidentified; identical to SEQ ID NO: 8593

SEQ ID NO: 10280 - protein, 248 aa, unidentified; identical to SEQ ID NO: 8593

SEQ ID NO: 10281 - protein, 248 aa, unidentified; identical to SEQ ID NO: 8593

SEQ ID NO: 10282 - protein, 127 aa, unidentified; identical to SEQ ID NO: 8594

SEQ ID NO: 10283 - protein, 248 aa, unidentified; identical to SEQ ID NO: 8593

SEQ ID NO: 10284 - protein, 266 aa, unidentified; identical to SEQ ID NO: 8360

SEQ ID NO: 10285 - protein, 266 aa, unidentified; identical to SEQ ID NO: 8360

SEQ ID NO: 10286 - protein, 258 aa, unidentified; identical to SEQ ID NO: 8309

SEQ ID NO: 10287 - protein, 231 aa, unidentified; identical to SEQ ID NO: 9315

SEQ ID NO: 10288 - protein, 231 aa, unidentified; identical to SEQ ID NO: 9315

SEQ ID NO: 10289 - protein, 337 aa, unidentified; identical to SEQ ID NO: 8339

SEQ ID NO: 10290 - protein, 242 aa, unidentified; identical to SEQ ID NO: 9313

SEQ ID NO: 10291 - protein, 242 aa, unidentified; identical to SEQ ID NO: 9313

SEQ ID NO: 10292 - protein, 231 aa, unidentified; identical to SEQ ID NO: 9315

SEQ ID NO: 10293 - protein, 266 aa, unidentified; identical to SEQ ID NO: 8360

SEQ ID NO: 10294 - protein, 248 aa, unidentified; identical to SEQ ID NO: 8593

SEQ ID NO: 10295 - protein, 231 aa, unidentified; identical to SEQ ID NO: 9315

SEQ ID NO: 10296 - protein, 187 aa, unidentified; identical to SEQ ID NO: 10204

SEQ ID NO: 10297 - protein, 337 aa, unidentified; identical to SEQ ID NO: 10217

SEQ ID NO: 10298 - protein, 33 aa, unidentified; identical to SEQ ID NO: 8702

SEQ ID NO: 10299 - protein, 145 aa, unidentified
LGYHLREMAQKPGVLYADDTAGWDTRITMADLEDEGILLDMMSGEHKKLASALFSKAYKVKVALCPRPGPKGGTLMDVISRTDQRGSGQVVTYALNTLTNIKVQLIRMAEAEGVLGATFEDFGIDRWLQEHGEDRVERMLVSGDD

SEQ ID NO: 10300 - protein, 242 aa, unidentified; identical to SEQ ID NO: 9313

SEQ ID NO: 10301 - protein, 231 aa, unidentified; identical to SEQ ID NO: 9315

SEQ ID NO: 10302 - protein, 337 aa, unidentified; identical to SEQ ID NO: 8339

SEQ ID NO: 10303 - protein, 261 aa, unidentified
RTIWYMWLGSRFLEFEALGFLNEERWASRDISGGGVEGIGINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCSHHFHELFLRDGRKLIVPCRDQHELVGR

SEQ ID NO: 10304 - protein, 261 aa, unidentified; identical to SEQ ID NO: 10303

SEQ ID NO: 10305 - protein, 337 aa, unidentified; identical to SEQ ID NO: 8339

SEQ ID NO: 10306 - protein, 337 aa, unidentified; identical to SEQ ID NO: 8339

SEQ ID NO: 10307 - protein, 310 aa, unidentified; identical to SEQ ID NO: 8617

SEQ ID NO: 10308 - protein, 320 aa, unidentified; identical to SEQ ID NO: 8962

SEQ ID NO: 10309 - protein, 269 aa, unidentified; identical to SEQ ID NO: 8320

SEQ ID NO: 10310 - protein, 302 aa, unidentified
KPGEFGVAKGSRTIWYMWLGSRFLEFEALGFLNEERWASRDISGGGVEGIGINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCSHHFHELFLRDGRKLIVPCRDQHELVGRSMVSQGGSSGVAGTACLAKAYAQMWLMSYF

SEQ ID NO: 10311 - protein, 337 aa, unidentified; identical to SEQ ID NO: 8339

SEQ ID NO: 10312 - protein, 337 aa, unidentified; identical to SEQ ID NO: 8339

SEQ ID NO: 10313 - protein, 337 aa, unidentified; identical to SEQ ID NO: 8339

SEQ ID NO: 10314 - protein, 199 aa, unidentified; identical to SEQ ID NO: 8585

SEQ ID NO: 10315 - protein, 249 aa, unidentified; identical to SEQ ID NO: 10206

SEQ ID NO: 10316 - protein, 310 aa, unidentified; identical to SEQ ID NO: 8617

SEQ ID NO: 10317 - protein, 310 aa, unidentified; identical to SEQ ID NO: 8617

SEQ ID NO: 10318 - protein, 231 aa, unidentified; identical to SEQ ID NO: 9315

SEQ ID NO: 10319 - protein, 258 aa, unidentified; identical to SEQ ID NO: 8309

SEQ ID NO: 10320 - protein, 229 aa, unidentified; identical to SEQ ID NO: 8171

SEQ ID NO: 10321 - protein, 83 aa, unidentified
PQGRCKDVYCKTVHPNMFWITENLSPPSCDDLRLGRASILLDEYQGFAYSLIDTAYIPPLPLQTGCKGISYCGHMGLRLDTGF

SEQ ID NO: 10322 - protein, 180 aa, unidentified
HRALIAVTMRLAYQNIAAVFPRTQSKYGSGFVMDFLGRRDQRGSGQVVTFALNTITNGKVQVARVLESEGLLHADESVLDAWLEKHLEEALGNMVIAGEEVVVSTTNRDFSSALEYLELTGKTRKNVPQGAPSRMESDWEKVEFCFHHYHEMCLKDGRILIAPCRHENEVLGRSRLQKGG

SEQ ID NO: 10323 - protein, 310 aa, unidentified; identical to SEQ ID NO: 8617

SEQ ID NO: 10324 - protein, 320 aa, unidentified; identical to SEQ ID NO: 8962

SEQ ID NO: 10325 - protein, 266 aa, unidentified; identical to SEQ ID NO: 8360

SEQ ID NO: 10326 - protein, 144 aa, unidentified
LEKMAEKAGILYADDTAGWDTRITMADLEDEYTLTELMEGEHKKLAETLFNFAYKNKVALCPRPGKNGGTVLDVISRTDQRGSGQVVTYALNTLTNIKVQLIRMAESEGVLDEEFHDNGMLKWLEKHGRDRLQRLMVSGDDCVV

SEQ ID NO: 10327 - protein, 333 aa, unidentified; identical to SEQ ID NO: 8351

SEQ ID NO: 10328 - protein, 337 aa, unidentified; identical to SEQ ID NO: 8339

SEQ ID NO: 10329 - protein, 254 aa, unidentified
HLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCSHHFHELFLRDGRKLIVPCRDQHELVGRSMVSQGGSSGVAGTACLAKAYAQMWLMSYFHRRDLRTLG

SEQ ID NO: 10330 - protein, 337 aa, unidentified; identical to SEQ ID NO: 8339

SEQ ID NO: 10331 - protein, 337 aa, unidentified; identical to SEQ ID NO: 8339

SEQ ID NO: 10332 - protein, 57 aa, unidentified; identical to SEQ ID NO: 8179

SEQ ID NO: 10333 - protein, 266 aa, unidentified; identical to SEQ ID NO: 8360

SEQ ID NO: 10334 - protein, 337 aa, unidentified; identical to SEQ ID NO: 8339

SEQ ID NO: 10335 - protein, 20 aa, unidentified
YMWLGSRFLEFEALGFLNEE

SEQ ID NO: 10336 - protein, 335 aa, unidentified; identical to SEQ ID NO: 8722

SEQ ID NO: 10337 - protein, 337 aa, unidentified; identical to SEQ ID NO: 8339

SEQ ID NO: 10338 - protein, 247 aa, unidentified
DTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCSHHFHELFLRDGRKLIVPCRDQHELVGRSMVSQGGSSGVAGTACLAKAYAQMWLMSYFHRRDLRTLGFGIMSSVP

SEQ ID NO: 10339 - protein, 255 aa, unidentified; identical to SEQ ID NO: 9104

SEQ ID NO: 10340 - protein, 229 aa, unidentified; identical to SEQ ID NO: 8171

SEQ ID NO: 10341 - protein, 229 aa, unidentified; identical to SEQ ID NO: 8171

SEQ ID NO: 10342 - protein, 215 aa, unidentified
DTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCSHHFHELFLRDGRKLIVPCRDQHELVGRSMVSQGGSSGVAGTA

SEQ ID NO: 10343 - protein, 258 aa, unidentified; identical to SEQ ID NO: 8309

SEQ ID NO: 10344 - protein, 248 aa, unidentified; identical to SEQ ID NO: 8593

SEQ ID NO: 10345 - protein, 333 aa, unidentified; identical to SEQ ID NO: 8351

SEQ ID NO: 10346 - protein, 333 aa, unidentified; identical to SEQ ID NO: 8351

SEQ ID NO: 10347 - protein, 337 aa, unidentified; identical to SEQ ID NO: 8339

SEQ ID NO: 10348 - protein, 333 aa, unidentified; identical to SEQ ID NO: 8351

SEQ ID NO: 10349 - protein, 333 aa, unidentified; identical to SEQ ID NO: 8351

SEQ ID NO: 10350 - protein, 248 aa, unidentified; identical to SEQ ID NO: 8593

SEQ ID NO: 10351 - protein, 22 aa, unidentified
RDLQRENTVPTPPPDTVPTTLI

SEQ ID NO: 10352 - protein, 258 aa, unidentified; identical to SEQ ID NO: 8309

SEQ ID NO: 10353 - protein, 231 aa, unidentified; identical to SEQ ID NO: 9315

SEQ ID NO: 10354 - protein, 313 aa, unidentified
GVAKGSRTIWYMWLGSRFLEFESFGFLNEEHWASRELSGGGVEGIPLNYLGYHLREMAQKPGVLYADDTAGWDTRITMADLEDEGILLDMMSGEHKKLASALFSKAYKVKVALCPRPGPKGGTLMDVISRTDQRGSGQVVTYALNTLTNIKVQLIRMAEAEGVLGATFEDFGIDRWLQEHGEDRVERMLVSGDDCVVNAIDERFGSSLNWLNAMEKVRKDIDLWKPSPSFRNWERVEFCSNHFHEMTMKDGRVIVAPCRGQTELIARGTVNQGGCVGVESTGCLAKAYAQMWLLLYFHRRDLRTLALAVMSAV

SEQ ID NO: 10355 - protein, 258 aa, unidentified; identical to SEQ ID NO: 8309

SEQ ID NO: 10356 - protein, 229 aa, unidentified; identical to SEQ ID NO: 8171

SEQ ID NO: 10357 - protein, 258 aa, unidentified; identical to SEQ ID NO: 8309

SEQ ID NO: 10358 - protein, 248 aa, unidentified; identical to SEQ ID NO: 8593

SEQ ID NO: 10359 - protein, 127 aa, unidentified; identical to SEQ ID NO: 8594

SEQ ID NO: 10360 - protein, 258 aa, unidentified; identical to SEQ ID NO: 8309

SEQ ID NO: 10361 - protein, 248 aa, unidentified; identical to SEQ ID NO: 8593

SEQ ID NO: 10362 - protein, 246 aa, unidentified; identical to SEQ ID NO: 10234

SEQ ID NO: 10363 - protein, 154 aa, unidentified; identical to SEQ ID NO: 8743

SEQ ID NO: 10364 - protein, 226 aa, unidentified
KPGEFGVAKGSRTIWYMWLGSRFLEFEALGFLNEERWASRDISGGGVEGIGINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDI

SEQ ID NO: 10365 - protein, 258 aa, unidentified; identical to SEQ ID NO: 8309

SEQ ID NO: 10366 - protein, 187 aa, unidentified; identical to SEQ ID NO: 10204

SEQ ID NO: 10367 - protein, 187 aa, unidentified; identical to SEQ ID NO: 10204

SEQ ID NO: 10368 - protein, 231 aa, unidentified; identical to SEQ ID NO: 9315

SEQ ID NO: 10369 - protein, 337 aa, unidentified; identical to SEQ ID NO: 8339

SEQ ID NO: 10370 - protein, 226 aa, unidentified; identical to SEQ ID NO: 10364

SEQ ID NO: 10371 - protein, 337 aa, unidentified; identical to SEQ ID NO: 8339

SEQ ID NO: 10372 - protein, 310 aa, unidentified; identical to SEQ ID NO: 8617

SEQ ID NO: 10373 - protein, 84 aa, unidentified
NEEMVESVHLTEHKVGYDPYNGHFVDQIFLKGACDSSLCETDHSTVYWLKDPDVENLPECGELVVEEAELMTEARRNYADEFKD

SEQ ID NO: 10374 - protein, 316 aa, unidentified
GSRTIWYMWLGSRFLEFESFGFLNEEHWASRELSGGGVEGIPLNYLGYHLREMAQKPGVLYADDTAGWDTRITMADLEDEGILLDMMSGEHKKLASALFSKAYKVKVALCPRPGPKGGTLMDVISRTDQRGSGQVVTYALNTLTNIKVQLIRMAEAEGVLGATFEDFGIDRWLQEHGEDRVERMLVSGDDCVVNAIDERFGSSLNWLNAMEKVRKDIDLWKPSPSFRNWERVEFCSNHFHEMTMKDGRVIVAPCRGQTELIARGTVNQGGCVGVESTGCLAKAYAQMWLLLYFHRRDLRTLALAVMSAVPSNWIPT

SEQ ID NO: 10375 - protein, 257 aa, unidentified
MAKKPGKLYADDTAGWDTRITEADLDDECILCDYMEDEHKQLALSLFELCYKNKVALCPRPGRHGGTVMDVIFRRDQRGSGQVVTYALNTLTNIKVQLIRLAESEGVLDEDFNDHGIETWLNHYGEERLSRLLISGDDCLVNAFDERFGKALTWLNTMEKIRKDIDLCAPSNGYENFEKVEFCSNHFHELMLKDGRQLVVPCRSQNELVGRASVNQGGSATVAGTACLAKAYAQMWNLLYFHRRDLRLLGFAIMSAT

SEQ ID NO: 10376 - protein, 337 aa, unidentified; identical to SEQ ID NO: 8339

SEQ ID NO: 10377 - protein, 310 aa, unidentified
VAKGSRTIWYMWLGSRFLEFEALGFLNEERWASRDISGGGVEGIGINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCSHHFHELFLRDGRKLIVPCRDQHELVGRSMVSQGGSSGVAGTACLAKAYAQMWLMSYFHRRDLRTLGFGIMS

SEQ ID NO: 10378 - protein, 337 aa, unidentified; identical to SEQ ID NO: 8339

SEQ ID NO: 10379 - protein, 337 aa, unidentified; identical to SEQ ID NO: 8339

SEQ ID NO: 10380 - protein, 310 aa, unidentified; identical to SEQ ID NO: 8617

SEQ ID NO: 10381 - protein, 222 aa, unidentified
PLFYLGYHLREMAKKPGKLYADDTAGWDTRITEADLDDECILCDYMEDEHKQLALSLFELCYKNKVALCPRPGRHGGTVMDVIFRRDQRGSGQVVTYALNTLTNIKVQLIRLAESEGVLDEDFNDHGIETWLNHYGEERLSRLLISGDDCLVNAFDERFGKALTWLNTMEKIRKDIDLCAPSNGYENFEKVEFCSNHFHELMLKDGRQLVVPCRSQNELVGR

SEQ ID NO: 10382 - protein, 337 aa, unidentified; identical to SEQ ID NO: 8339

SEQ ID NO: 10383 - protein, 337 aa, unidentified; identical to SEQ ID NO: 8339

SEQ ID NO: 10384 - protein, 231 aa, unidentified; identical to SEQ ID NO: 9315

SEQ ID NO: 10385 - protein, 337 aa, unidentified; identical to SEQ ID NO: 8339

SEQ ID NO: 10386 - protein, 337 aa, unidentified; identical to SEQ ID NO: 10217

SEQ ID NO: 10387 - protein, 337 aa, unidentified; identical to SEQ ID NO: 8339

SEQ ID NO: 10388 - protein, 231 aa, unidentified; identical to SEQ ID NO: 9315

SEQ ID NO: 10389 - protein, 337 aa, unidentified; identical to SEQ ID NO: 10217

SEQ ID NO: 10390 - protein, 42 aa, unidentified
GRIIYPIRYLLGDEWNPEMHALQYVKFMPHPLLHPYSHQIKD

SEQ ID NO: 10391 - protein, 187 aa, unidentified; identical to SEQ ID NO: 10204

SEQ ID NO: 10392 - protein, 72 aa, unidentified
EVIDPIFYGTRCSPINNFDSHWFCKSVNNLIMWMSDKDQFKSPHCDIHTWDCIVVKTYVSWDEDHDTHKYLR

SEQ ID NO: 10393 - protein, 229 aa, unidentified; identical to SEQ ID NO: 8171

SEQ ID NO: 10394 - protein, 248 aa, unidentified; identical to SEQ ID NO: 8593

SEQ ID NO: 10395 - protein, 258 aa, unidentified; identical to SEQ ID NO: 8309

SEQ ID NO: 10396 - protein, 229 aa, unidentified; identical to SEQ ID NO: 8171

SEQ ID NO: 10397 - protein, 57 aa, unidentified; identical to SEQ ID NO: 8179

SEQ ID NO: 10398 - protein, 248 aa, unidentified; identical to SEQ ID NO: 8593

SEQ ID NO: 10399 - protein, 174 aa, unidentified; identical to SEQ ID NO: 8195

SEQ ID NO: 10400 - protein, 229 aa, unidentified; identical to SEQ ID NO: 8171

SEQ ID NO: 10401 - protein, 258 aa, unidentified; identical to SEQ ID NO: 8309

SEQ ID NO: 10402 - protein, 258 aa, unidentified; identical to SEQ ID NO: 8309

SEQ ID NO: 10403 - protein, 258 aa, unidentified; identical to SEQ ID NO: 8309

SEQ ID NO: 10404 - protein, 258 aa, unidentified; identical to SEQ ID NO: 8309

SEQ ID NO: 10405 - protein, 60 aa, unidentified; identical to SEQ ID NO: 8986

SEQ ID NO: 10406 - protein, 258 aa, unidentified; identical to SEQ ID NO: 8309

SEQ ID NO: 10407 - protein, 258 aa, unidentified; identical to SEQ ID NO: 8309

SEQ ID NO: 10408 - protein, 247 aa, unidentified
KPGDFGVAKGSRTIWYMWLGSRFLEFESFGFLNEEHWASRELSGGGVEGIPLNYLGYHLREMAQKPGVLYADDTAGWDTRITMADLEDEGILLDMMSGEHKKLASALFSKAYKVKVALCPRPGPKGGTLMDVISRTDQRGSGQVVTYALNTLTNIKVQLIRMAEAEGVLGATFEDFGIDRWLQEHGEDRVERMLVSGDDCVVNAIDERFGSSLNWLNAMEKVRKDIDLWKPSPSFRNWERVEFCSNH

SEQ ID NO: 10409 - protein, 248 aa, unidentified; identical to SEQ ID NO: 8593

SEQ ID NO: 10410 - protein, 258 aa, unidentified; identical to SEQ ID NO: 8309

SEQ ID NO: 10411 - protein, 258 aa, unidentified; identical to SEQ ID NO: 8309

SEQ ID NO: 10412 - protein, 127 aa, unidentified; identical to SEQ ID NO: 8594

SEQ ID NO: 10413 - protein, 248 aa, unidentified; identical to SEQ ID NO: 8593

SEQ ID NO: 10414 - protein, 258 aa, unidentified; identical to SEQ ID NO: 8309

SEQ ID NO: 10415 - protein, 258 aa, unidentified; identical to SEQ ID NO: 8309

SEQ ID NO: 10416 - protein, 57 aa, unidentified; identical to SEQ ID NO: 8179

SEQ ID NO: 10417 - protein, 57 aa, unidentified; identical to SEQ ID NO: 8179

SEQ ID NO: 10418 - protein, 57 aa, unidentified; identical to SEQ ID NO: 8179

SEQ ID NO: 10419 - protein, 333 aa, unidentified; identical to SEQ ID NO: 8351

SEQ ID NO: 10420 - protein, 57 aa, unidentified; identical to SEQ ID NO: 8179

SEQ ID NO: 10421 - protein, 258 aa, unidentified; identical to SEQ ID NO: 8309

SEQ ID NO: 10422 - protein, 231 aa, unidentified; identical to SEQ ID NO: 9733

SEQ ID NO: 10423 - protein, 190 aa, unidentified; identical to SEQ ID NO: 9131

SEQ ID NO: 10424 - protein, 255 aa, unidentified; identical to SEQ ID NO: 9104

SEQ ID NO: 10425 - protein, 258 aa, unidentified; identical to SEQ ID NO: 8309

SEQ ID NO: 10426 - protein, 248 aa, unidentified; identical to SEQ ID NO: 8593

SEQ ID NO: 10427 - protein, 248 aa, unidentified; identical to SEQ ID NO: 8593

SEQ ID NO: 10428 - protein, 248 aa, unidentified; identical to SEQ ID NO: 8593

SEQ ID NO: 10429 - protein, 174 aa, unidentified; identical to SEQ ID NO: 8195

SEQ ID NO: 10430 - protein, 266 aa, unidentified; identical to SEQ ID NO: 8360

SEQ ID NO: 10431 - protein, 278 aa, unidentified; identical to SEQ ID NO: 8332

SEQ ID NO: 10432 - protein, 337 aa, unidentified; identical to SEQ ID NO: 8339

SEQ ID NO: 10433 - protein, 337 aa, unidentified; identical to SEQ ID NO: 8339

SEQ ID NO: 10434 - protein, 127 aa, unidentified; identical to SEQ ID NO: 8344

SEQ ID NO: 10435 - protein, 258 aa, unidentified; identical to SEQ ID NO: 8309

SEQ ID NO: 10436 - protein, 248 aa, unidentified; identical to SEQ ID NO: 8593

SEQ ID NO: 10437 - protein, 174 aa, unidentified; identical to SEQ ID NO: 8195

SEQ ID NO: 10438 - protein, 96 aa, unidentified; identical to SEQ ID NO: 8176

SEQ ID NO: 10439 - protein, 248 aa, unidentified; identical to SEQ ID NO: 8593

SEQ ID NO: 10440 - protein, 258 aa, unidentified; identical to SEQ ID NO: 8309

SEQ ID NO: 10441 - protein, 258 aa, unidentified; identical to SEQ ID NO: 8309

SEQ ID NO: 10442 - protein, 337 aa, unidentified; identical to SEQ ID NO: 8339

SEQ ID NO: 10443 - protein, 33 aa, unidentified; identical to SEQ ID NO: 8702

SEQ ID NO: 10444 - protein, 231 aa, unidentified; identical to SEQ ID NO: 9733

SEQ ID NO: 10445 - protein, 231 aa, unidentified; identical to SEQ ID NO: 9315

SEQ ID NO: 10446 - protein, 231 aa, unidentified; identical to SEQ ID NO: 9733

SEQ ID NO: 10447 - protein, 187 aa, unidentified
PHHRALIAVTMRLAYQNIAAVFPRTQSKYGSGFVMDFLGRRDQRGSGQVVTFALNTITNGKVQVARVLESEGLLHADESVLDAWLEKHLEEALGNMVIAGEEVVVSTTNRDFSSALEYLELTGKTRKNVPQGAPSRMESDWEKVEFCFHHYHEMCLKDGRILIAPCRHENEVLGRSRLQKGGVVSIP

SEQ ID NO: 10448 - protein, 337 aa, unidentified; identical to SEQ ID NO: 8339

SEQ ID NO: 10449 - protein, 202 aa, unidentified
KPGEFGVAKGSRTIWYMWLGSRFLEFEALGFLNEERWASRDISGGGVEGIGINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVV

SEQ ID NO: 10450 - protein, 231 aa, unidentified; identical to SEQ ID NO: 9315

SEQ ID NO: 10451 - protein, 231 aa, unidentified; identical to SEQ ID NO: 9315

SEQ ID NO: 10452 - protein, 187 aa, unidentified; identical to SEQ ID NO: 10204

SEQ ID NO: 10453 - protein, 337 aa, unidentified; identical to SEQ ID NO: 8339

SEQ ID NO: 10454 - protein, 231 aa, unidentified; identical to SEQ ID NO: 9315

SEQ ID NO: 10455 - protein, 231 aa, unidentified; identical to SEQ ID NO: 9315

SEQ ID NO: 10456 - protein, 337 aa, unidentified; identical to SEQ ID NO: 8339

SEQ ID NO: 10457 - protein, 231 aa, unidentified; identical to SEQ ID NO: 9733

SEQ ID NO: 10458 - protein, 33 aa, unidentified; identical to SEQ ID NO: 8702

SEQ ID NO: 10459 - protein, 337 aa, unidentified; identical to SEQ ID NO: 8339

SEQ ID NO: 10460 - protein, 231 aa, unidentified; identical to SEQ ID NO: 9315

SEQ ID NO: 10461 - protein, 226 aa, unidentified; identical to SEQ ID NO: 10364

SEQ ID NO: 10462 - protein, 231 aa, unidentified; identical to SEQ ID NO: 9315

SEQ ID NO: 10463 - protein, 156 aa, unidentified
GYHLEKMAEKAGILYADDTAGWDTRITMADLEDEYTLTELMEGEHKKLAETLFNFAYKNKVALCPRPGKNGGTVLDVISRTDQRGSGQVVTYALNTLTNIKVQLIRMAESEGVLDEEFHDNGMLKWLEKHGRDRLQRLMVSGDDCVVNAIDERFGK

SEQ ID NO: 10464 - protein, 333 aa, unidentified; identical to SEQ ID NO: 8351

SEQ ID NO: 10465 - protein, 337 aa, unidentified; identical to SEQ ID NO: 8339

SEQ ID NO: 10466 - protein, 231 aa, unidentified; identical to SEQ ID NO: 9315

SEQ ID NO: 10467 - protein, 310 aa, unidentified; identical to SEQ ID NO: 8617

SEQ ID NO: 10468 - protein, 310 aa, unidentified; identical to SEQ ID NO: 8617

SEQ ID NO: 10469 - protein, 242 aa, unidentified; identical to SEQ ID NO: 9313

SEQ ID NO: 10470 - protein, 267 aa, unidentified
MAKKPGKLYADDTAGWDTRITEADLDDECILCDYMEDEHKQLALSLFELCYKNKVALCPRPGRHGGTVMDVIFRRDQRGSGQVVTYALNTLTNIKVQLIRLAESEGVLDEDFNDHGIETWLNHYGEERLSRLLISGDDCLVNAFDERFGKALTWLNTMEKIRKDIDLCAPSNGYENFEKVEFCSNHFHELMLKDGRQLVVPCRSQNELVGRASVNQGGSATVAGTACLAKAYAQMWNLLYFHRRDLRLLGFAIMSATPSNWIPTGRT

SEQ ID NO: 10471 - protein, 272 aa, unidentified; identical to SEQ ID NO: 8319

SEQ ID NO: 10472 - protein, 242 aa, unidentified; identical to SEQ ID NO: 9313

SEQ ID NO: 10473 - protein, 310 aa, unidentified; identical to SEQ ID NO: 8617

SEQ ID NO: 10474 - protein, 337 aa, unidentified; identical to SEQ ID NO: 8339

SEQ ID NO: 10475 - protein, 242 aa, unidentified; identical to SEQ ID NO: 9313

SEQ ID NO: 10476 - protein, 337 aa, unidentified; identical to SEQ ID NO: 8339

SEQ ID NO: 10477 - protein, 196 aa, unidentified
VAKGSRTIWYMWLGSRFLEFEALGFLNEERWASRDISGGGVEGIGINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVV

SEQ ID NO: 10478 - protein, 311 aa, unidentified; identical to SEQ ID NO: 9371

SEQ ID NO: 10479 - protein, 320 aa, unidentified; identical to SEQ ID NO: 8962

SEQ ID NO: 10480 - protein, 272 aa, unidentified; identical to SEQ ID NO: 8319

SEQ ID NO: 10481 - protein, 337 aa, unidentified; identical to SEQ ID NO: 8339

SEQ ID NO: 10482 - protein, 310 aa, unidentified; identical to SEQ ID NO: 8617

SEQ ID NO: 10483 - protein, 310 aa, unidentified; identical to SEQ ID NO: 8617

SEQ ID NO: 10484 - protein, 249 aa, unidentified; identical to SEQ ID NO: 10206

SEQ ID NO: 10485 - protein, 337 aa, unidentified; identical to SEQ ID NO: 8339

SEQ ID NO: 10486 - protein, 310 aa, unidentified; identical to SEQ ID NO: 8617

SEQ ID NO: 10487 - protein, 302 aa, unidentified
YMWLGSRFLEFESFGFLNEEHWASRELCGGGVEGIPLFYLGYHLEKMAEKAGILYADDTAGWDTRITMADLEDEYTLTELMEGEHKKLAETLFNFAYKNKVALCPRPGKNGGTVLDVISRTDQRGSGQVVTYALNTLTNIKVQLIRMAESEGVLDEEFHDNGMLKWLEKHGRDRLQRLMVSGDDCVVNAIDERFGKSLVWLNEMQKIRKDIDLWKPSAGHCNWEEVEFCSNHFHKLVMRDGRTLVVPCRHEVELVGRASVNQGGSTGISGTACLAKAYAQMWLLLYFHRRDLRILGMAICSA

SEQ ID NO: 10488 - protein, 257 aa, unidentified; identical to SEQ ID NO: 10375

SEQ ID NO: 10489 - protein, 217 aa, unidentified
VAKGSRTIWYMWLGSRFLEFESFGFLNEEHWASRELCGGGVEGIPLFYLGYHLEKMAEKAGILYADDTAGWDTRITMADLEDEYTLTELMEGEHKKLAETLFNFAYKNKVALCPRPGKNGGTVLDVISRTDQRGSGQVVTYALNTLTNIKVQLIRMAESEGVLDEEFHDNGMLKWLEKHGRDRLQRLMVSGDDCVVNAIDERFGKSLVWLNEMQKIR

SEQ ID NO: 10490 - protein, 248 aa, unidentified; identical to SEQ ID NO: 8593

SEQ ID NO: 10491 - protein, 258 aa, unidentified; identical to SEQ ID NO: 8309

SEQ ID NO: 10492 - protein, 229 aa, unidentified; identical to SEQ ID NO: 8171

SEQ ID NO: 10493 - protein, 258 aa, unidentified; identical to SEQ ID NO: 8309

SEQ ID NO: 10494 - protein, 258 aa, unidentified; identical to SEQ ID NO: 8309

SEQ ID NO: 10495 - protein, 258 aa, unidentified; identical to SEQ ID NO: 8309

SEQ ID NO: 10496 - protein, 127 aa, unidentified; identical to SEQ ID NO: 8344

SEQ ID NO: 10497 - protein, 258 aa, unidentified; identical to SEQ ID NO: 8309

SEQ ID NO: 10498 - protein, 229 aa, unidentified; identical to SEQ ID NO: 8171

SEQ ID NO: 10499 - protein, 198 aa, unidentified
KPGEFGVAKGSRTIWYMWLGSRFLEFEALGFLNEERWASRDISGGGVEGIGINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGD

SEQ ID NO: 10500 - protein, 198 aa, unidentified; identical to SEQ ID NO: 10499

SEQ ID NO: 10501 - protein, 337 aa, unidentified; identical to SEQ ID NO: 8339

SEQ ID NO: 10502 - protein, 72 aa, unidentified; identical to SEQ ID NO: 10392

SEQ ID NO: 10503 - protein, 335 aa, unidentified; identical to SEQ ID NO: 8722

SEQ ID NO: 10504 - protein, 337 aa, unidentified; identical to SEQ ID NO: 10217

SEQ ID NO: 10505 - protein, 337 aa, unidentified; identical to SEQ ID NO: 8339

SEQ ID NO: 10506 - protein, 251 aa, unidentified
GSRFLEFEALGFLNEERWASRDISGGGVEGIGINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCSHHFHELFLRDGRKLIVPCRDQHELV

SEQ ID NO: 10507 - protein, 337 aa, unidentified; identical to SEQ ID NO: 8339

SEQ ID NO: 10508 - protein, 76 aa, unidentified; identical to SEQ ID NO: 8186

SEQ ID NO: 10509 - protein, 337 aa, unidentified; identical to SEQ ID NO: 10217

SEQ ID NO: 10510 - protein, 314 aa, unidentified
LGSRFLEFESFGFLNEEHWASRELSGGGVEGIPLNYLGYHLREMAQKPGVLYADDTAGWDTRITMADLEDEGILLDMMSGEHKKLASALFSKAYKVKVALCPRPGPKGGTLMDVISRTDQRGSGQVVTYALNTLTNIKVQLIRMAEAEGVLGATFEDFGIDRWLQEHGEDRVERMLVSGDDCVVNAIDERFGSSLNWLNAMEKVRKDIDLWKPSPSFRNWERVEFCSNHFHEMTMKDGRVIVAPCRGQTELIARGTVNQGGCVGVESTGCLAKAYAQMWLLLYFHRRDLRTLALAVMSAVPSNWIPTGRTTWSL

SEQ ID NO: 10511 - protein, 33 aa, unidentified; identical to SEQ ID NO: 8702

SEQ ID NO: 10512 - protein, 57 aa, unidentified; identical to SEQ ID NO: 8179

SEQ ID NO: 10513 - protein, 337 aa, unidentified; identical to SEQ ID NO: 8339

SEQ ID NO: 10514 - protein, 337 aa, unidentified; identical to SEQ ID NO: 8339

SEQ ID NO: 10515 - protein, 258 aa, unidentified; identical to SEQ ID NO: 8309

SEQ ID NO: 10516 - protein, 248 aa, unidentified; identical to SEQ ID NO: 8593

SEQ ID NO: 10517 - protein, 337 aa, unidentified; identical to SEQ ID NO: 8339

SEQ ID NO: 10518 - protein, 337 aa, unidentified; identical to SEQ ID NO: 8339

SEQ ID NO: 10519 - protein, 261 aa, unidentified
LGSRFLEFEALGFLNEERWASRDISGGGVEGIGINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCSHHFHELFLRDGRKLIVPCRDQHELVGRSMVSQGG

SEQ ID NO: 10520 - protein, 248 aa, unidentified; identical to SEQ ID NO: 8593

SEQ ID NO: 10521 - protein, 258 aa, unidentified; identical to SEQ ID NO: 8309

SEQ ID NO: 10522 - protein, 248 aa, unidentified; identical to SEQ ID NO: 8593

SEQ ID NO: 10523 - protein, 258 aa, unidentified; identical to SEQ ID NO: 8309

SEQ ID NO: 10524 - protein, 248 aa, unidentified; identical to SEQ ID NO: 8593

SEQ ID NO: 10525 - protein, 337 aa, unidentified; identical to SEQ ID NO: 8339

SEQ ID NO: 10526 - protein, 57 aa, unidentified; identical to SEQ ID NO: 8179

SEQ ID NO: 10527 - protein, 57 aa, unidentified; identical to SEQ ID NO: 8179

SEQ ID NO: 10528 - protein, 33 aa, unidentified; identical to SEQ ID NO: 8702

SEQ ID NO: 10529 - protein, 248 aa, unidentified; identical to SEQ ID NO: 8593

SEQ ID NO: 10530 - protein, 248 aa, unidentified; identical to SEQ ID NO: 8593

SEQ ID NO: 10531 - protein, 337 aa, unidentified; identical to SEQ ID NO: 8339

SEQ ID NO: 10532 - protein, 335 aa, unidentified; identical to SEQ ID NO: 8722

SEQ ID NO: 10533 - protein, 33 aa, unidentified; identical to SEQ ID NO: 8702

SEQ ID NO: 10534 - protein, 337 aa, unidentified; identical to SEQ ID NO: 8339

SEQ ID NO: 10535 - protein, 337 aa, unidentified; identical to SEQ ID NO: 8339

SEQ ID NO: 10536 - protein, 320 aa, unidentified; identical to SEQ ID NO: 8962

SEQ ID NO: 10537 - protein, 337 aa, unidentified; identical to SEQ ID NO: 8339

SEQ ID NO: 10538 - protein, 310 aa, unidentified; identical to SEQ ID NO: 8617

SEQ ID NO: 10539 - protein, 337 aa, unidentified; identical to SEQ ID NO: 8339

SEQ ID NO: 10540 - protein, 33 aa, unidentified; identical to SEQ ID NO: 8702

SEQ ID NO: 10541 - protein, 310 aa, unidentified; identical to SEQ ID NO: 8617

SEQ ID NO: 10542 - protein, 57 aa, unidentified; identical to SEQ ID NO: 8179

SEQ ID NO: 10543 - protein, 57 aa, unidentified; identical to SEQ ID NO: 8179

SEQ ID NO: 10544 - protein, 337 aa, unidentified; identical to SEQ ID NO: 8339

SEQ ID NO: 10545 - protein, 337 aa, unidentified; identical to SEQ ID NO: 10217

SEQ ID NO: 10546 - protein, 264 aa, unidentified
KPGDFGVAKGSRTIWYMWLGSRFLEFESFGFLNEEHWASRELSGGGVEGIPLNYLGYHLREMAQKPGVLYADDTAGWDTRITMADLEDEGILLDMMSGEHKKLASALFSKAYKVKVALCPRPGPKGGTLMDVISRTDQRGSGQVVTYALNTLTNIKVQLIRMAEAEGVLGATFEDFGIDRWLQEHGEDRVERMLVSGDDCVVNAIDERFGSSLNWLNAMEKVRKDIDLWKPSPSFRNWERVEFCSNHFHEMTMKDGRVIVAPCR

SEQ ID NO: 10547 - protein, 229 aa, unidentified; identical to SEQ ID NO: 8171

SEQ ID NO: 10548 - protein, 229 aa, unidentified; identical to SEQ ID NO: 8171

SEQ ID NO: 10549 - protein, 174 aa, unidentified; identical to SEQ ID NO: 8195

SEQ ID NO: 10550 - protein, 229 aa, unidentified; identical to SEQ ID NO: 8171

SEQ ID NO: 10551 - protein, 258 aa, unidentified; identical to SEQ ID NO: 8309

SEQ ID NO: 10552 - protein, 248 aa, unidentified; identical to SEQ ID NO: 8593

SEQ ID NO: 10553 - protein, 258 aa, unidentified; identical to SEQ ID NO: 8309

SEQ ID NO: 10554 - protein, 248 aa, unidentified; identical to SEQ ID NO: 8593

SEQ ID NO: 10555 - protein, 258 aa, unidentified; identical to SEQ ID NO: 8309

SEQ ID NO: 10556 - protein, 229 aa, unidentified; identical to SEQ ID NO: 8171

SEQ ID NO: 10557 - protein, 229 aa, unidentified; identical to SEQ ID NO: 8171

SEQ ID NO: 10558 - protein, 248 aa, unidentified; identical to SEQ ID NO: 8593

SEQ ID NO: 10559 - protein, 174 aa, unidentified; identical to SEQ ID NO: 8195

SEQ ID NO: 10560 - protein, 248 aa, unidentified; identical to SEQ ID NO: 8593

SEQ ID NO: 10561 - protein, 258 aa, unidentified; identical to SEQ ID NO: 8309

SEQ ID NO: 10562 - protein, 154 aa, unidentified; identical to SEQ ID NO: 8743

SEQ ID NO: 10563 - protein, 154 aa, unidentified; identical to SEQ ID NO: 8743

SEQ ID NO: 10564 - protein, 139 aa, unidentified
EMAQKPGVLYADDTAGWDTRITMADLEDEGILLDMMSGEHKKLASALFSKAYKVKVALCPRPGPKGGTLMDVISRTDQRGSGQVVTYALNTLTNIKVQLIRMAEAEGVLGATFEDFGIDRWLQEHGEDRVERMLVSGDD

SEQ ID NO: 10565 - protein, 248 aa, unidentified; identical to SEQ ID NO: 8593

SEQ ID NO: 10566 - protein, 127 aa, unidentified; identical to SEQ ID NO: 8344

SEQ ID NO: 10567 - protein, 258 aa, unidentified; identical to SEQ ID NO: 8309

SEQ ID NO: 10568 - protein, 229 aa, unidentified; identical to SEQ ID NO: 8171

SEQ ID NO: 10569 - protein, 258 aa, unidentified; identical to SEQ ID NO: 8309

SEQ ID NO: 10570 - protein, 229 aa, unidentified; identical to SEQ ID NO: 8171

SEQ ID NO: 10571 - protein, 229 aa, unidentified; identical to SEQ ID NO: 8171

SEQ ID NO: 10572 - protein, 248 aa, unidentified; identical to SEQ ID NO: 8593

SEQ ID NO: 10573 - protein, 248 aa, unidentified; identical to SEQ ID NO: 8593

SEQ ID NO: 10574 - protein, 57 aa, unidentified; identical to SEQ ID NO: 8179

SEQ ID NO: 10575 - protein, 248 aa, unidentified; identical to SEQ ID NO: 8593

SEQ ID NO: 10576 - protein, 127 aa, unidentified; identical to SEQ ID NO: 8594

SEQ ID NO: 10577 - protein, 258 aa, unidentified; identical to SEQ ID NO: 8309

SEQ ID NO: 10578 - protein, 258 aa, unidentified; identical to SEQ ID NO: 8309

SEQ ID NO: 10579 - protein, 248 aa, unidentified; identical to SEQ ID NO: 8593

SEQ ID NO: 10580 - protein, 258 aa, unidentified; identical to SEQ ID NO: 8309

SEQ ID NO: 10581 - protein, 258 aa, unidentified; identical to SEQ ID NO: 8309

SEQ ID NO: 10582 - protein, 60 aa, unidentified; identical to SEQ ID NO: 8986

SEQ ID NO: 10583 - protein, 337 aa, unidentified; identical to SEQ ID NO: 8339

SEQ ID NO: 10584 - protein, 248 aa, unidentified; identical to SEQ ID NO: 8593

SEQ ID NO: 10585 - protein, 337 aa, unidentified; identical to SEQ ID NO: 8339

SEQ ID NO: 10586 - protein, 57 aa, unidentified; identical to SEQ ID NO: 8179

SEQ ID NO: 10587 - protein, 248 aa, unidentified; identical to SEQ ID NO: 8593

SEQ ID NO: 10588 - protein, 248 aa, unidentified; identical to SEQ ID NO: 8593

SEQ ID NO: 10589 - protein, 248 aa, unidentified; identical to SEQ ID NO: 8593

SEQ ID NO: 10590 - protein, 258 aa, unidentified; identical to SEQ ID NO: 8309

SEQ ID NO: 10591 - protein, 337 aa, unidentified; identical to SEQ ID NO: 8339

SEQ ID NO: 10592 - protein, 229 aa, unidentified; identical to SEQ ID NO: 8171

SEQ ID NO: 10593 - protein, 258 aa, unidentified; identical to SEQ ID NO: 8309

SEQ ID NO: 10594 - protein, 57 aa, unidentified; identical to SEQ ID NO: 8179

SEQ ID NO: 10595 - protein, 174 aa, unidentified; identical to SEQ ID NO: 8195

SEQ ID NO: 10596 - protein, 258 aa, unidentified; identical to SEQ ID NO: 8309

SEQ ID NO: 10597 - protein, 258 aa, unidentified; identical to SEQ ID NO: 8309

SEQ ID NO: 10598 - protein, 258 aa, unidentified; identical to SEQ ID NO: 8309

SEQ ID NO: 10599 - protein, 57 aa, unidentified; identical to SEQ ID NO: 8179

SEQ ID NO: 10600 - protein, 248 aa, unidentified; identical to SEQ ID NO: 8593

SEQ ID NO: 10601 - protein, 258 aa, unidentified; identical to SEQ ID NO: 8309

SEQ ID NO: 10602 - protein, 266 aa, unidentified; identical to SEQ ID NO: 8360

SEQ ID NO: 10603 - protein, 174 aa, unidentified; identical to SEQ ID NO: 8195

SEQ ID NO: 10604 - protein, 248 aa, unidentified; identical to SEQ ID NO: 8593

SEQ ID NO: 10605 - protein, 258 aa, unidentified; identical to SEQ ID NO: 8309

SEQ ID NO: 10606 - protein, 258 aa, unidentified; identical to SEQ ID NO: 8309

SEQ ID NO: 10607 - protein, 337 aa, unidentified; identical to SEQ ID NO: 8339

SEQ ID NO: 10608 - protein, 258 aa, unidentified; identical to SEQ ID NO: 8309

SEQ ID NO: 10609 - protein, 266 aa, unidentified; identical to SEQ ID NO: 8360

SEQ ID NO: 10610 - protein, 258 aa, unidentified; identical to SEQ ID NO: 8309

SEQ ID NO: 10611 - protein, 266 aa, unidentified; identical to SEQ ID NO: 8360

SEQ ID NO: 10612 - protein, 248 aa, unidentified; identical to SEQ ID NO: 8593

SEQ ID NO: 10613 - protein, 127 aa, unidentified; identical to SEQ ID NO: 8344

SEQ ID NO: 10614 - protein, 248 aa, unidentified; identical to SEQ ID NO: 8593

SEQ ID NO: 10615 - protein, 174 aa, unidentified; identical to SEQ ID NO: 8195

SEQ ID NO: 10616 - protein, 266 aa, unidentified; identical to SEQ ID NO: 8360

SEQ ID NO: 10617 - protein, 311 aa, unidentified
AKGSRTIWYMWLGSRFLEFEALGFLNEERWASRDISGGGVEGIGINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCSHHFHELFLRDGRKLIVPCRDQHELVGRSMVSQGGSSGVAGTACLAKAYAQMWLMSYFHRRDLRTLGFGIMSSV

SEQ ID NO: 10618 - protein, 248 aa, unidentified; identical to SEQ ID NO: 8593

SEQ ID NO: 10619 - protein, 231 aa, unidentified; identical to SEQ ID NO: 9733

SEQ ID NO: 10620 - protein, 242 aa, unidentified; identical to SEQ ID NO: 9313

SEQ ID NO: 10621 - protein, 320 aa, unidentified; identical to SEQ ID NO: 8962

SEQ ID NO: 10622 - protein, 174 aa, unidentified; identical to SEQ ID NO: 8195

SEQ ID NO: 10623 - protein, 320 aa, unidentified; identical to SEQ ID NO: 8962

SEQ ID NO: 10624 - protein, 33 aa, unidentified; identical to SEQ ID NO: 8702

SEQ ID NO: 10625 - protein, 311 aa, unidentified; identical to SEQ ID NO: 9371

SEQ ID NO: 10626 - protein, 202 aa, unidentified
VESIPLFYLGYHLREMAKKPGKLYADDTAGWDTRITEADLDDECILCDYMEDEHKQLALSLFELCYKNKVALCPRPGRHGGTVMDVIFRRDQRGSGQVVTYALNTLTNIKVQLIRLAESEGVLDEDFNDHGIETWLNHYGEERLSRLLISGDDCLVNAFDERFGKALTWLNTMEKIRKDIDLCAPSNGYENFEKVEFCSNHF

SEQ ID NO: 10627 - protein, 231 aa, unidentified; identical to SEQ ID NO: 9315

SEQ ID NO: 10628 - protein, 337 aa, unidentified; identical to SEQ ID NO: 8339

SEQ ID NO: 10629 - protein, 251 aa, unidentified; identical to SEQ ID NO: 8663

SEQ ID NO: 10630 - protein, 337 aa, unidentified; identical to SEQ ID NO: 8339

SEQ ID NO: 10631 - protein, 337 aa, unidentified; identical to SEQ ID NO: 8339

SEQ ID NO: 10632 - protein, 231 aa, unidentified; identical to SEQ ID NO: 9315

SEQ ID NO: 10633 - protein, 337 aa, unidentified; identical to SEQ ID NO: 8339

SEQ ID NO: 10634 - protein, 337 aa, unidentified; identical to SEQ ID NO: 8339

SEQ ID NO: 10635 - protein, 231 aa, unidentified; identical to SEQ ID NO: 9315

SEQ ID NO: 10636 - protein, 231 aa, unidentified; identical to SEQ ID NO: 9315

SEQ ID NO: 10637 - protein, 337 aa, unidentified; identical to SEQ ID NO: 8339

SEQ ID NO: 10638 - protein, 303 aa, unidentified
KPGEFGVAKGSRTIWYMWLGSRFLEFEALGFLNEERWASRDISGGGVEGIGINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCSHHFHELFLRDGRKLIVPCRDQHELVGRSMVSQGGSSGVAGTACLAKAYAQMWLMSYFH

SEQ ID NO: 10639 - protein, 310 aa, unidentified; identical to SEQ ID NO: 8617

SEQ ID NO: 10640 - protein, 266 aa, unidentified
KGSRTIWYMWLGSRFLEFESFGFLNEEHWASRELSGGGVESIPLFYLGYHLREMAKKPGKLYADDTAGWDTRITEADLDDECILCDYMEDEHKQLALSLFELCYKNKVALCPRPGRHGGTVMDVIFRRDQRGSGQVVTYALNTLTNIKVQLIRLAESEGVLDEDFNDHGIETWLNHYGEERLSRLLISGDDCLVNAFDERFGKALTWLNTMEKIRKDIDLCAPSNGYENFEKVEFCSNHFHELMLKDGRQLVVPCRSQNELVGRAS

SEQ ID NO: 10641 - protein, 310 aa, unidentified; identical to SEQ ID NO: 8617

SEQ ID NO: 10642 - protein, 267 aa, unidentified
KGSRTIWYMWLGSRFLEFESFGFLNEEHWASRELSGGGVESIPLFYLGYHLREMAKKPGKLYADDTAGWDTRITEADLDDECILCDYMEDEHKQLALSLFELCYKNKVALCPRPGRHGGTVMDVIFRRDQRGSGQVVTYALNTLTNIKVQLIRLAESEGVLDEDFNDHGIETWLNHYGEERLSRLLISGDDCLVNAFDERFGKALTWLNTMEKIRKDIDLCAPSNGYENFEKVEFCSNHFHELMLKDGRQLVVPCRSQNELVGRASV

SEQ ID NO: 10643 - protein, 311 aa, unidentified; identical to SEQ ID NO: 9371

SEQ ID NO: 10644 - protein, 337 aa, unidentified; identical to SEQ ID NO: 8339

SEQ ID NO: 10645 - protein, 252 aa, unidentified
GSRFLEFEALGFLNEERWASRDISGGGVEGIGINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCSHHFHELFLRDGRKLIVPCRDQHELVG

SEQ ID NO: 10646 - protein, 154 aa, unidentified
GIGINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVV

SEQ ID NO: 10647 - protein, 337 aa, unidentified; identical to SEQ ID NO: 8339

SEQ ID NO: 10648 - protein, 337 aa, unidentified; identical to SEQ ID NO: 8339

SEQ ID NO: 10649 - protein, 251 aa, unidentified
EDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCSHHFHELFLRDGRKLIVPCRDQHELVGRSMVSQGGSSGVAGTACLAKAYAQMWLMSYFHRRDLRTLGFGIMSSVPKDWFPTGRTTWSVHANHE

SEQ ID NO: 10650 - protein, 311 aa, unidentified
GSRTIWYMWLGSRFLEFESFGFLNEEHWASRELSGGGVEGIPLNYLGYHLREMAQKPGVLYADDTAGWDTRITMADLEDEGILLDMMSGEHKKLASALFSKAYKVKVALCPRPGPKGGTLMDVISRTDQRGSGQVVTYALNTLTNIKVQLIRMAEAEGVLGATFEDFGIDRWLQEHGEDRVERMLVSGDDCVVNAIDERFGSSLNWLNAMEKVRKDIDLWKPSPSFRNWERVEFCSNHFHEMTMKDGRVIVAPCRGQTELIARGTVNQGGCVGVESTGCLAKAYAQMWLLLYFHRRDLRTLALAVMSAVPS

SEQ ID NO: 10651 - protein, 335 aa, unidentified; identical to SEQ ID NO: 8722

SEQ ID NO: 10652 - protein, 337 aa, unidentified; identical to SEQ ID NO: 8339

SEQ ID NO: 10653 - protein, 337 aa, unidentified; identical to SEQ ID NO: 8339

SEQ ID NO: 10654 - protein, 57 aa, unidentified; identical to SEQ ID NO: 8179

SEQ ID NO: 10655 - protein, 231 aa, unidentified; identical to SEQ ID NO: 9315

SEQ ID NO: 10656 - protein, 231 aa, unidentified; identical to SEQ ID NO: 9315

SEQ ID NO: 10657 - protein, 231 aa, unidentified; identical to SEQ ID NO: 9315

SEQ ID NO: 10658 - protein, 337 aa, unidentified; identical to SEQ ID NO: 8339

SEQ ID NO: 10659 - protein, 318 aa, unidentified; identical to SEQ ID NO: 8615

SEQ ID NO: 10660 - protein, 337 aa, unidentified; identical to SEQ ID NO: 8339

SEQ ID NO: 10661 - protein, 258 aa, unidentified; identical to SEQ ID NO: 8309

SEQ ID NO: 10662 - protein, 248 aa, unidentified; identical to SEQ ID NO: 8593

SEQ ID NO: 10663 - protein, 258 aa, unidentified; identical to SEQ ID NO: 8309

SEQ ID NO: 10664 - protein, 258 aa, unidentified; identical to SEQ ID NO: 8309

SEQ ID NO: 10665 - protein, 154 aa, unidentified; identical to SEQ ID NO: 8743

SEQ ID NO: 10666 - protein, 333 aa, unidentified; identical to SEQ ID NO: 8351

SEQ ID NO: 10667 - protein, 337 aa, unidentified; identical to SEQ ID NO: 8339

SEQ ID NO: 10668 - protein, 248 aa, unidentified; identical to SEQ ID NO: 8593

SEQ ID NO: 10669 - protein, 248 aa, unidentified; identical to SEQ ID NO: 8593

SEQ ID NO: 10670 - protein, 258 aa, unidentified; identical to SEQ ID NO: 8309

SEQ ID NO: 10671 - protein, 258 aa, unidentified; identical to SEQ ID NO: 8309

SEQ ID NO: 10672 - protein, 255 aa, unidentified; identical to SEQ ID NO: 9104

SEQ ID NO: 10673 - protein, 33 aa, unidentified; identical to SEQ ID NO: 8702

SEQ ID NO: 10674 - protein, 248 aa, unidentified; identical to SEQ ID NO: 8593

SEQ ID NO: 10675 - protein, 33 aa, unidentified; identical to SEQ ID NO: 8702

SEQ ID NO: 10676 - protein, 231 aa, unidentified; identical to SEQ ID NO: 9315

SEQ ID NO: 10677 - protein, 231 aa, unidentified; identical to SEQ ID NO: 9315

SEQ ID NO: 10678 - protein, 231 aa, unidentified; identical to SEQ ID NO: 9315

SEQ ID NO: 10679 - protein, 231 aa, unidentified; identical to SEQ ID NO: 9315

SEQ ID NO: 10680 - protein, 310 aa, unidentified; identical to SEQ ID NO: 8617

SEQ ID NO: 10681 - protein, 337 aa, unidentified; identical to SEQ ID NO: 8339

SEQ ID NO: 10682 - protein, 279 aa, unidentified
KPGEFGVAKGSRTIWYMWLGSRFLEFEALGFLNEERWASRDISGGGVEGIGINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCSHHFHELFLRDGRKLIVPCRDQHELVGRSMVSQGG

SEQ ID NO: 10683 - protein, 310 aa, unidentified; identical to SEQ ID NO: 8617

SEQ ID NO: 10684 - protein, 310 aa, unidentified; identical to SEQ ID NO: 8617

SEQ ID NO: 10685 - protein, 317 aa, unidentified; identical to SEQ ID NO: 10205

SEQ ID NO: 10686 - protein, 246 aa, unidentified; identical to SEQ ID NO: 10234

SEQ ID NO: 10687 - protein, 310 aa, unidentified; identical to SEQ ID NO: 8617

SEQ ID NO: 10688 - protein, 202 aa, unidentified; identical to SEQ ID NO: 10449

SEQ ID NO: 10689 - protein, 222 aa, unidentified
DTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCSHHFHELFLRDGRKLIVPCRDQHELVGRSMVSQGGSSGVAGTACLAKAYA

SEQ ID NO: 10690 - protein, 258 aa, unidentified; identical to SEQ ID NO: 8309

SEQ ID NO: 10691 - protein, 248 aa, unidentified; identical to SEQ ID NO: 8593

SEQ ID NO: 10692 - protein, 248 aa, unidentified; identical to SEQ ID NO: 8593

SEQ ID NO: 10693 - protein, 258 aa, unidentified; identical to SEQ ID NO: 8309

SEQ ID NO: 10694 - protein, 319 aa, unidentified
KPGEFGVAKGSRTIWYMWLGSRFLEFEALGFLNEERWASRDISGGGVEGIGINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCSHHFHELFLRDGRKLIVPCRDQHELVGRSMVSQGGSSGVAGTACLAKAYAQMWLMSYFHRRDLRTLGFGIMSSVP

SEQ ID NO: 10695 - protein, 248 aa, unidentified; identical to SEQ ID NO: 8593

SEQ ID NO: 10696 - protein, 127 aa, unidentified; identical to SEQ ID NO: 8344

SEQ ID NO: 10697 - protein, 248 aa, unidentified; identical to SEQ ID NO: 8593

SEQ ID NO: 10698 - protein, 248 aa, unidentified; identical to SEQ ID NO: 8593

SEQ ID NO: 10699 - protein, 127 aa, unidentified; identical to SEQ ID NO: 8344

SEQ ID NO: 10700 - protein, 229 aa, unidentified; identical to SEQ ID NO: 8171

SEQ ID NO: 10701 - protein, 154 aa, unidentified; identical to SEQ ID NO: 8743

SEQ ID NO: 10702 - protein, 96 aa, unidentified; identical to SEQ ID NO: 8176

SEQ ID NO: 10703 - protein, 154 aa, unidentified; identical to SEQ ID NO: 8743

SEQ ID NO: 10704 - protein, 174 aa, unidentified; identical to SEQ ID NO: 8195

SEQ ID NO: 10705 - protein, 258 aa, unidentified; identical to SEQ ID NO: 8309

SEQ ID NO: 10706 - protein, 258 aa, unidentified; identical to SEQ ID NO: 8309

SEQ ID NO: 10707 - protein, 229 aa, unidentified; identical to SEQ ID NO: 8171

SEQ ID NO: 10708 - protein, 258 aa, unidentified; identical to SEQ ID NO: 8309

SEQ ID NO: 10709 - protein, 258 aa, unidentified; identical to SEQ ID NO: 8309

SEQ ID NO: 10710 - protein, 258 aa, unidentified; identical to SEQ ID NO: 8309

SEQ ID NO: 10711 - protein, 174 aa, unidentified; identical to SEQ ID NO: 8195

SEQ ID NO: 10712 - protein, 258 aa, unidentified; identical to SEQ ID NO: 8309

SEQ ID NO: 10713 - protein, 248 aa, unidentified; identical to SEQ ID NO: 8593

SEQ ID NO: 10714 - protein, 258 aa, unidentified; identical to SEQ ID NO: 8309

SEQ ID NO: 10715 - protein, 248 aa, unidentified; identical to SEQ ID NO: 8593

SEQ ID NO: 10716 - protein, 248 aa, unidentified; identical to SEQ ID NO: 8593

SEQ ID NO: 10717 - protein, 258 aa, unidentified; identical to SEQ ID NO: 8309

SEQ ID NO: 10718 - protein, 337 aa, unidentified; identical to SEQ ID NO: 8339

SEQ ID NO: 10719 - protein, 248 aa, unidentified; identical to SEQ ID NO: 8593

SEQ ID NO: 10720 - protein, 258 aa, unidentified; identical to SEQ ID NO: 8309

SEQ ID NO: 10721 - protein, 258 aa, unidentified; identical to SEQ ID NO: 8309

SEQ ID NO: 10722 - protein, 248 aa, unidentified; identical to SEQ ID NO: 8593

SEQ ID NO: 10723 - protein, 258 aa, unidentified; identical to SEQ ID NO: 8309

SEQ ID NO: 10724 - protein, 258 aa, unidentified; identical to SEQ ID NO: 8309

SEQ ID NO: 10725 - protein, 248 aa, unidentified; identical to SEQ ID NO: 8593

SEQ ID NO: 10726 - protein, 57 aa, unidentified; identical to SEQ ID NO: 8179

SEQ ID NO: 10727 - protein, 258 aa, unidentified; identical to SEQ ID NO: 8309

SEQ ID NO: 10728 - protein, 248 aa, unidentified; identical to SEQ ID NO: 8593

SEQ ID NO: 10729 - protein, 258 aa, unidentified; identical to SEQ ID NO: 8309

SEQ ID NO: 10730 - protein, 258 aa, unidentified; identical to SEQ ID NO: 8309

SEQ ID NO: 10731 - protein, 258 aa, unidentified; identical to SEQ ID NO: 8309

SEQ ID NO: 10732 - protein, 127 aa, unidentified; identical to SEQ ID NO: 8344

SEQ ID NO: 10733 - protein, 258 aa, unidentified; identical to SEQ ID NO: 8309

SEQ ID NO: 10734 - protein, 248 aa, unidentified; identical to SEQ ID NO: 8593

SEQ ID NO: 10735 - protein, 258 aa, unidentified; identical to SEQ ID NO: 8309

SEQ ID NO: 10736 - protein, 258 aa, unidentified; identical to SEQ ID NO: 8309

SEQ ID NO: 10737 - protein, 258 aa, unidentified; identical to SEQ ID NO: 8309

SEQ ID NO: 10738 - protein, 258 aa, unidentified; identical to SEQ ID NO: 8309

SEQ ID NO: 10739 - protein, 337 aa, unidentified; identical to SEQ ID NO: 8339

SEQ ID NO: 10740 - protein, 258 aa, unidentified; identical to SEQ ID NO: 8309

SEQ ID NO: 10741 - protein, 258 aa, unidentified; identical to SEQ ID NO: 8309

SEQ ID NO: 10742 - protein, 248 aa, unidentified; identical to SEQ ID NO: 8593

SEQ ID NO: 10743 - protein, 333 aa, unidentified; identical to SEQ ID NO: 8351

SEQ ID NO: 10744 - protein, 258 aa, unidentified; identical to SEQ ID NO: 8309

SEQ ID NO: 10745 - protein, 248 aa, unidentified; identical to SEQ ID NO: 8593

SEQ ID NO: 10746 - protein, 248 aa, unidentified; identical to SEQ ID NO: 8593

SEQ ID NO: 10747 - protein, 258 aa, unidentified; identical to SEQ ID NO: 8309

SEQ ID NO: 10748 - protein, 330 aa, unidentified; identical to SEQ ID NO: 9109

SEQ ID NO: 10749 - protein, 266 aa, unidentified
KPGEFGVAKGSRTIWYMWLGSRFLEFEALGFLNEERWASRDISGGGVEGIGINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCSHHFHELFLRDGRKLIVPCRDQ

SEQ ID NO: 10750 - protein, 248 aa, unidentified; identical to SEQ ID NO: 8593

SEQ ID NO: 10751 - protein, 127 aa, unidentified; identical to SEQ ID NO: 9935

SEQ ID NO: 10752 - protein, 266 aa, unidentified; identical to SEQ ID NO: 8360

SEQ ID NO: 10753 - protein, 248 aa, unidentified; identical to SEQ ID NO: 8593

SEQ ID NO: 10754 - protein, 266 aa, unidentified; identical to SEQ ID NO: 8360

SEQ ID NO: 10755 - protein, 248 aa, unidentified; identical to SEQ ID NO: 8593

SEQ ID NO: 10756 - protein, 127 aa, unidentified; identical to SEQ ID NO: 8344

SEQ ID NO: 10757 - protein, 337 aa, unidentified; identical to SEQ ID NO: 8339

SEQ ID NO: 10758 - protein, 248 aa, unidentified; identical to SEQ ID NO: 8593

SEQ ID NO: 10759 - protein, 248 aa, unidentified; identical to SEQ ID NO: 8593

SEQ ID NO: 10760 - protein, 246 aa, unidentified; identical to SEQ ID NO: 10234

SEQ ID NO: 10761 - protein, 229 aa, unidentified; identical to SEQ ID NO: 8171

SEQ ID NO: 10762 - protein, 229 aa, unidentified; identical to SEQ ID NO: 8171

SEQ ID NO: 10763 - protein, 229 aa, unidentified; identical to SEQ ID NO: 8171

SEQ ID NO: 10764 - protein, 258 aa, unidentified; identical to SEQ ID NO: 8309

SEQ ID NO: 10765 - protein, 258 aa, unidentified; identical to SEQ ID NO: 8309

SEQ ID NO: 10766 - protein, 248 aa, unidentified; identical to SEQ ID NO: 8593

SEQ ID NO: 10767 - protein, 258 aa, unidentified; identical to SEQ ID NO: 8309

SEQ ID NO: 10768 - protein, 248 aa, unidentified; identical to SEQ ID NO: 8593

SEQ ID NO: 10769 - protein, 231 aa, unidentified; identical to SEQ ID NO: 9315

SEQ ID NO: 10770 - protein, 337 aa, unidentified; identical to SEQ ID NO: 8339

SEQ ID NO: 10771 - protein, 231 aa, unidentified; identical to SEQ ID NO: 9733

SEQ ID NO: 10772 - protein, 33 aa, unidentified; identical to SEQ ID NO: 8702

SEQ ID NO: 10773 - protein, 231 aa, unidentified; identical to SEQ ID NO: 9315

SEQ ID NO: 10774 - protein, 187 aa, unidentified; identical to SEQ ID NO: 10204

SEQ ID NO: 10775 - protein, 33 aa, unidentified; identical to SEQ ID NO: 8702

SEQ ID NO: 10776 - protein, 313 aa, unidentified; identical to SEQ ID NO: 10354

SEQ ID NO: 10777 - protein, 231 aa, unidentified; identical to SEQ ID NO: 9315

SEQ ID NO: 10778 - protein, 171 aa, unidentified
LGFLNEERWASRDISGGGVEGIGINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDD

SEQ ID NO: 10779 - protein, 231 aa, unidentified; identical to SEQ ID NO: 9733

SEQ ID NO: 10780 - protein, 187 aa, unidentified; identical to SEQ ID NO: 10447

SEQ ID NO: 10781 - protein, 231 aa, unidentified; identical to SEQ ID NO: 9315

SEQ ID NO: 10782 - protein, 231 aa, unidentified; identical to SEQ ID NO: 9315

SEQ ID NO: 10783 - protein, 313 aa, unidentified; identical to SEQ ID NO: 10354

SEQ ID NO: 10784 - protein, 231 aa, unidentified; identical to SEQ ID NO: 9315

SEQ ID NO: 10785 - protein, 231 aa, unidentified; identical to SEQ ID NO: 9315

SEQ ID NO: 10786 - protein, 313 aa, unidentified; identical to SEQ ID NO: 10354

SEQ ID NO: 10787 - protein, 231 aa, unidentified; identical to SEQ ID NO: 9315

SEQ ID NO: 10788 - protein, 335 aa, unidentified; identical to SEQ ID NO: 8722

SEQ ID NO: 10789 - protein, 249 aa, unidentified; identical to SEQ ID NO: 10206

SEQ ID NO: 10790 - protein, 231 aa, unidentified; identical to SEQ ID NO: 9315

SEQ ID NO: 10791 - protein, 317 aa, unidentified; identical to SEQ ID NO: 10205

SEQ ID NO: 10792 - protein, 317 aa, unidentified; identical to SEQ ID NO: 10205

SEQ ID NO: 10793 - protein, 112 aa, unidentified; identical to SEQ ID NO: 9483

SEQ ID NO: 10794 - protein, 337 aa, unidentified; identical to SEQ ID NO: 8339

SEQ ID NO: 10795 - protein, 310 aa, unidentified; identical to SEQ ID NO: 8617

SEQ ID NO: 10796 - protein, 337 aa, unidentified; identical to SEQ ID NO: 8339

SEQ ID NO: 10797 - protein, 247 aa, unidentified
DDTAGWDTRITEADLDDECILCDYMEDEHKQLALSLFELCYKNKVALCPRPGRHGGTVMDVIFRRDQRGSGQVVTYALNTLTNIKVQLIRLAESEGVLDEDFNDHGIETWLNHYGEERLSRLLISGDDCLVNAFDERFGKALTWLNTMEKIRKDIDLCAPSNGYENFEKVEFCSNHFHELMLKDGRQLVVPCRSQNELVGRASVNQGGSATVAGTACLAKAYAQMWNLLYFHRRDLRLLGFAIMSAT

SEQ ID NO: 10798 - protein, 231 aa, unidentified; identical to SEQ ID NO: 9315

SEQ ID NO: 10799 - protein, 337 aa, unidentified; identical to SEQ ID NO: 8339

SEQ ID NO: 10800 - protein, 310 aa, unidentified; identical to SEQ ID NO: 8617

SEQ ID NO: 10801 - protein, 337 aa, unidentified; identical to SEQ ID NO: 8339

SEQ ID NO: 10802 - protein, 224 aa, unidentified
KPGEFGVAKGSRTIWYMWLGSRFLEFEALGFLNEERWASRDISGGGVEGIGINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTRE

SEQ ID NO: 10803 - protein, 262 aa, unidentified
MAKKPGKLYADDTAGWDTRITEADLDDECILCDYMEDEHKQLALSLFELCYKNKVALCPRPGRHGGTVMDVIFRRDQRGSGQVVTYALNTLTNIKVQLIRLAESEGVLDEDFNDHGIETWLNHYGEERLSRLLISGDDCLVNAFDERFGKALTWLNTMEKIRKDIDLCAPSNGYENFEKVEFCSNHFHELMLKDGRQLVVPCRSQNELVGRASVNQGGSATVAGTACLAKAYAQMWNLLYFHRRDLRLLGFAIMSATPSNWI

SEQ ID NO: 10804 - protein, 310 aa, unidentified; identical to SEQ ID NO: 8617

SEQ ID NO: 10805 - protein, 310 aa, unidentified; identical to SEQ ID NO: 8617

SEQ ID NO: 10806 - protein, 57 aa, unidentified; identical to SEQ ID NO: 8179

SEQ ID NO: 10807 - protein, 57 aa, unidentified; identical to SEQ ID NO: 8179

SEQ ID NO: 10808 - protein, 242 aa, unidentified; identical to SEQ ID NO: 9313

SEQ ID NO: 10809 - protein, 242 aa, unidentified; identical to SEQ ID NO: 9313

SEQ ID NO: 10810 - protein, 337 aa, unidentified; identical to SEQ ID NO: 8339

SEQ ID NO: 10811 - protein, 303 aa, unidentified
GSRTIWYMWLGSRFLEFEALGFLNEERWASRDISGGGVEGIGINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCSHHFHELFLRDGRKLIVPCRDQHELVGRSMVSQGGSSGVAGTACLAKAYAQMWLMSYFHRRDLRTLGF

SEQ ID NO: 10812 - protein, 337 aa, unidentified; identical to SEQ ID NO: 8339

SEQ ID NO: 10813 - protein, 333 aa, unidentified; identical to SEQ ID NO: 8351

SEQ ID NO: 10814 - protein, 337 aa, unidentified; identical to SEQ ID NO: 8339

SEQ ID NO: 10815 - protein, 337 aa, unidentified; identical to SEQ ID NO: 8339

SEQ ID NO: 10816 - protein, 271 aa, unidentified
GVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCSHHFHELFLRDGRKLIVPCRDQHELVGRSMVSQGGSSGVAGTACLAKAYAQMWLMSYFHRRDLRTLGFGIMSSVPKDWFPTGRTTWSVHANHE

SEQ ID NO: 10817 - protein, 333 aa, unidentified; identical to SEQ ID NO: 8351

SEQ ID NO: 10818 - protein, 337 aa, unidentified; identical to SEQ ID NO: 8339

SEQ ID NO: 10819 - protein, 57 aa, unidentified; identical to SEQ ID NO: 8179

SEQ ID NO: 10820 - protein, 242 aa, unidentified; identical to SEQ ID NO: 9313

SEQ ID NO: 10821 - protein, 310 aa, unidentified; identical to SEQ ID NO: 8697

SEQ ID NO: 10822 - protein, 337 aa, unidentified; identical to SEQ ID NO: 8339

SEQ ID NO: 10823 - protein, 337 aa, unidentified; identical to SEQ ID NO: 8339

SEQ ID NO: 10824 - protein, 132 aa, unidentified; identical to SEQ ID NO: 8689

SEQ ID NO: 10825 - protein, 262 aa, unidentified; identical to SEQ ID NO: 9207

SEQ ID NO: 10826 - protein, 231 aa, unidentified; identical to SEQ ID NO: 9315

SEQ ID NO: 10827 - protein, 231 aa, unidentified; identical to SEQ ID NO: 9733

SEQ ID NO: 10828 - protein, 337 aa, unidentified; identical to SEQ ID NO: 8339

SEQ ID NO: 10829 - protein, 231 aa, unidentified; identical to SEQ ID NO: 9315

SEQ ID NO: 10830 - protein, 230 aa, unidentified; identical to SEQ ID NO: 9370

SEQ ID NO: 10831 - protein, 180 aa, unidentified
YADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCSHHFH

SEQ ID NO: 10832 - protein, 254 aa, unidentified
MWLGSRFLEFEALGFLNEERWASRDISGGGVEGIGINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCSHHFHELFLRDGRKLIVPCRDQHELV

SEQ ID NO: 10833 - protein, 202 aa, unidentified; identical to SEQ ID NO: 10449

SEQ ID NO: 10834 - protein, 337 aa, unidentified; identical to SEQ ID NO: 8339

SEQ ID NO: 10835 - protein, 333 aa, unidentified; identical to SEQ ID NO: 8351

SEQ ID NO: 10836 - protein, 254 aa, unidentified; identical to SEQ ID NO: 10832

SEQ ID NO: 10837 - protein, 270 aa, unidentified; identical to SEQ ID NO: 8331

SEQ ID NO: 10838 - protein, 270 aa, unidentified; identical to SEQ ID NO: 8331

SEQ ID NO: 10839 - protein, 109 aa, unidentified
PAECNITLMTHDPTPLHAKAEKCYVYVCTTSFGFWGVYSESREITRTLHRDECNFVEEIPEDPYQCDYWWCQYNVKTEKCLCITENVTVVGLPNGHLYCSFEDCSTLSS

SEQ ID NO: 10840 - protein, 337 aa, unidentified; identical to SEQ ID NO: 8339

SEQ ID NO: 10841 - protein, 317 aa, unidentified
MWLGSRFLEFESFGFLNEEHWASRELCGGGVEGIPLFYLGYHLEKMAEKAGILYADDTAGWDTRITMADLEDEYTLTELMEGEHKKLAETLFNFAYKNKVALCPRPGKNGGTVLDVISRTDQRGSGQVVTYALNTLTNIKVQLIRMAESEGVLDEEFHDNGMLKWLEKHGRDRLQRLMVSGDDCVVNAIDERFGKSLVWLNEMQKIRKDIDLWKPSAGHCNWEEVEFCSNHFHKLVMRDGRTLVVPCRHEVELVGRASVNQGGSTGISGTACLAKAYAQMWLLLYFHRRDLRILGMAICSAVPANWVPTGRTTWSLH

SEQ ID NO: 10842 - protein, 254 aa, unidentified; identical to SEQ ID NO: 10832

SEQ ID NO: 10843 - protein, 215 aa, unidentified
KPGEFGVAKGSRTIWYMWLGSRFLEFEALGFLNEERWASRDISGGGVEGIGINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTW

SEQ ID NO: 10844 - protein, 254 aa, unidentified; identical to SEQ ID NO: 10832

SEQ ID NO: 10845 - protein, 333 aa, unidentified; identical to SEQ ID NO: 8351

SEQ ID NO: 10846 - protein, 337 aa, unidentified; identical to SEQ ID NO: 8339

SEQ ID NO: 10847 - protein, 199 aa, unidentified; identical to SEQ ID NO: 8585

SEQ ID NO: 10848 - protein, 204 aa, unidentified
GVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCSHHFHELFLRDGRKLIVPCRDQHELV

SEQ ID NO: 10849 - protein, 194 aa, unidentified
LYADDTAGWDTRITEADLDDECILCDYMEDEHKQLALSLFELCYKNKVALCPRPGRHGGTVMDVIFRRDQRGSGQVVTYALNTLTNIKVQLIRLAESEGVLDEDFNDHGIETWLNHYGEERLSRLLISGDDCLVNAFDERFGKALTWLNTMEKIRKDIDLCAPSNGYENFEKVEFCSNHFHELMLKDGRQLVVP

SEQ ID NO: 10850 - protein, 313 aa, unidentified; identical to SEQ ID NO: 8418

SEQ ID NO: 10851 - protein, 333 aa, unidentified; identical to SEQ ID NO: 8351

SEQ ID NO: 10852 - protein, 242 aa, unidentified; identical to SEQ ID NO: 9313

SEQ ID NO: 10853 - protein, 190 aa, unidentified
LEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCSHHF

SEQ ID NO: 10854 - protein, 311 aa, unidentified; identical to SEQ ID NO: 9484

SEQ ID NO: 10855 - protein, 311 aa, unidentified; identical to SEQ ID NO: 9495

SEQ ID NO: 10856 - protein, 302 aa, unidentified; identical to SEQ ID NO: 10310

SEQ ID NO: 10857 - protein, 311 aa, unidentified; identical to SEQ ID NO: 9495

SEQ ID NO: 10858 - protein, 311 aa, unidentified; identical to SEQ ID NO: 9495

SEQ ID NO: 10859 - protein, 316 aa, unidentified; identical to SEQ ID NO: 8732

SEQ ID NO: 10860 - protein, 231 aa, unidentified; identical to SEQ ID NO: 9733

SEQ ID NO: 10861 - protein, 337 aa, unidentified; identical to SEQ ID NO: 8339

SEQ ID NO: 10862 - protein, 100 aa, unidentified
PHHRALIAVTMRLAYQNIAAVFPRTQSKYGSGFVMDFLGRRDQRGSGQVVTFALNTITNGKVQVARVLESEGLLHADESVLDAWLEKHLEEALGNMVIAG

SEQ ID NO: 10863 - protein, 337 aa, unidentified; identical to SEQ ID NO: 8339

SEQ ID NO: 10864 - protein, 231 aa, unidentified; identical to SEQ ID NO: 9733

SEQ ID NO: 10865 - protein, 242 aa, unidentified; identical to SEQ ID NO: 9313

SEQ ID NO: 10866 - protein, 60 aa, unidentified; identical to SEQ ID NO: 8986

SEQ ID NO: 10867 - protein, 231 aa, unidentified; identical to SEQ ID NO: 9315

SEQ ID NO: 10868 - protein, 235 aa, unidentified; identical to SEQ ID NO: 9303

SEQ ID NO: 10869 - protein, 235 aa, unidentified; identical to SEQ ID NO: 9303

SEQ ID NO: 10870 - protein, 243 aa, unidentified
KGSRTIWYMWLGSRFLEFESFGFLNEEHWASRELCGGGVEGIPLFYLGYHLEKMAEKAGILYADDTAGWDTRITMADLEDEYTLTELMEGEHKKLAETLFNFAYKNKVALCPRPGKNGGTVLDVISRTDQRGSGQVVTYALNTLTNIKVQLIRMAESEGVLDEEFHDNGMLKWLEKHGRDRLQRLMVSGDDCVVNAIDERFGKSLVWLNEMQKIRKDIDLWKPSAGHCNWEEVEFCSNHFHKL

SEQ ID NO: 10871 - protein, 242 aa, unidentified; identical to SEQ ID NO: 9313

SEQ ID NO: 10872 - protein, 231 aa, unidentified; identical to SEQ ID NO: 9315

SEQ ID NO: 10873 - protein, 231 aa, unidentified; identical to SEQ ID NO: 9315

SEQ ID NO: 10874 - protein, 337 aa, unidentified; identical to SEQ ID NO: 8339

SEQ ID NO: 10875 - protein, 226 aa, unidentified; identical to SEQ ID NO: 10364

SEQ ID NO: 10876 - protein, 231 aa, unidentified; identical to SEQ ID NO: 9315

SEQ ID NO: 10877 - protein, 231 aa, unidentified; identical to SEQ ID NO: 9315

SEQ ID NO: 10878 - protein, 337 aa, unidentified; identical to SEQ ID NO: 8339

SEQ ID NO: 10879 - protein, 226 aa, unidentified; identical to SEQ ID NO: 10364

SEQ ID NO: 10880 - protein, 231 aa, unidentified; identical to SEQ ID NO: 9315

SEQ ID NO: 10881 - protein, 249 aa, unidentified; identical to SEQ ID NO: 10206

SEQ ID NO: 10882 - protein, 90 aa, unidentified
LTPLSIQALTSVLQGTSGVLMNSTNSTLTQPMDLLATGLITGQIISVNMTSLQLIIATFMPSIAELPNAVLHSFFRITTSVNLTEVMIQS

SEQ ID NO: 10883 - protein, 337 aa, unidentified; identical to SEQ ID NO: 8339

SEQ ID NO: 10884 - protein, 337 aa, unidentified; identical to SEQ ID NO: 8339

SEQ ID NO: 10885 - protein, 333 aa, unidentified; identical to SEQ ID NO: 8351

SEQ ID NO: 10886 - protein, 319 aa, unidentified; identical to SEQ ID NO: 8858

SEQ ID NO: 10887 - protein, 333 aa, unidentified; identical to SEQ ID NO: 8351

SEQ ID NO: 10888 - protein, 333 aa, unidentified; identical to SEQ ID NO: 8351

SEQ ID NO: 10889 - protein, 333 aa, unidentified; identical to SEQ ID NO: 8351

SEQ ID NO: 10890 - protein, 333 aa, unidentified; identical to SEQ ID NO: 8351

SEQ ID NO: 10891 - protein, 337 aa, unidentified; identical to SEQ ID NO: 8339

SEQ ID NO: 10892 - protein, 60 aa, unidentified
YNKVPTKTLRRLIADEILSGAESIYEAMWKVLSSLFGGVAKIIMIGTIIFLVFCILKLTS

SEQ ID NO: 10893 - protein, 60 aa, unidentified; identical to SEQ ID NO: 10892

SEQ ID NO: 10894 - protein, 320 aa, unidentified; identical to SEQ ID NO: 8962

SEQ ID NO: 10895 - protein, 179 aa, unidentified
LYLQPPRYGLQNVNLTSLYGIARIGAYRVLYPEQYNATIFCSDQLYGNWWYLNRTSEQKEETYRKKMLNLTENNSSILKDRALPPTWTPKGQARLFRELNPLDFCTKPEAVMLLNQSYYTWSLWEGDCYVYSRNISFPPECINYTRIANKTAHPYACRHWRLLSTNNEGKDEIKCSEYG

SEQ ID NO: 10896 - protein, 231 aa, unidentified; identical to SEQ ID NO: 9315

SEQ ID NO: 10897 - protein, 333 aa, unidentified; identical to SEQ ID NO: 8351

SEQ ID NO: 10898 - protein, 242 aa, unidentified; identical to SEQ ID NO: 9313

SEQ ID NO: 10899 - protein, 333 aa, unidentified; identical to SEQ ID NO: 8351

SEQ ID NO: 10900 - protein, 337 aa, unidentified; identical to SEQ ID NO: 8339

SEQ ID NO: 10901 - protein, 337 aa, unidentified; identical to SEQ ID NO: 8339

SEQ ID NO: 10902 - protein, 242 aa, unidentified; identical to SEQ ID NO: 9313

SEQ ID NO: 10903 - protein, 337 aa, unidentified; identical to SEQ ID NO: 8339

SEQ ID NO: 10904 - protein, 333 aa, unidentified; identical to SEQ ID NO: 8351

SEQ ID NO: 10905 - protein, 337 aa, unidentified; identical to SEQ ID NO: 8339

SEQ ID NO: 10906 - protein, 332 aa, unidentified; identical to SEQ ID NO: 9622

SEQ ID NO: 10907 - protein, 332 aa, unidentified; identical to SEQ ID NO: 9622

SEQ ID NO: 10908 - protein, 231 aa, unidentified; identical to SEQ ID NO: 9315

SEQ ID NO: 10909 - protein, 337 aa, unidentified; identical to SEQ ID NO: 8339

SEQ ID NO: 10910 - protein, 337 aa, unidentified; identical to SEQ ID NO: 8339

SEQ ID NO: 10911 - protein, 337 aa, unidentified; identical to SEQ ID NO: 8339

SEQ ID NO: 10912 - protein, 231 aa, unidentified; identical to SEQ ID NO: 9733

SEQ ID NO: 10913 - protein, 319 aa, unidentified; identical to SEQ ID NO: 8858

SEQ ID NO: 10914 - protein, 333 aa, unidentified; identical to SEQ ID NO: 8351

SEQ ID NO: 10915 - protein, 204 aa, unidentified
LYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCSHHFHELFLRDGRKLIVPCRDQHELVGR

SEQ ID NO: 10916 - protein, 319 aa, unidentified; identical to SEQ ID NO: 8858

SEQ ID NO: 10917 - protein, 319 aa, unidentified; identical to SEQ ID NO: 8858

SEQ ID NO: 10918 - protein, 123 aa, unidentified; identical to SEQ ID NO: 9190

SEQ ID NO: 10919 - protein, 337 aa, unidentified; identical to SEQ ID NO: 8339

SEQ ID NO: 10920 - protein, 319 aa, unidentified; identical to SEQ ID NO: 8858

SEQ ID NO: 10921 - protein, 333 aa, unidentified; identical to SEQ ID NO: 8351

SEQ ID NO: 10922 - protein, 304 aa, unidentified
KGSRTIWYMWLGSRFLEFEALGFLNEERWASRDISGGGVEGIGINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCSHHFHELFLRDGRKLIVPCRDQHELVGRSMVSQGGSSGVAGTACLAKAYAQMWLMSYFHRRDLRTLGF

SEQ ID NO: 10923 - protein, 319 aa, unidentified; identical to SEQ ID NO: 8858

SEQ ID NO: 10924 - protein, 42 aa, unidentified; identical to SEQ ID NO: 8181

SEQ ID NO: 10925 - protein, 337 aa, unidentified; identical to SEQ ID NO: 8339

SEQ ID NO: 10926 - protein, 231 aa, unidentified; identical to SEQ ID NO: 9733

SEQ ID NO: 10927 - protein, 152 aa, unidentified; identical to SEQ ID NO: 8178

SEQ ID NO: 10928 - protein, 57 aa, unidentified; identical to SEQ ID NO: 8179

SEQ ID NO: 10929 - protein, 335 aa, unidentified; identical to SEQ ID NO: 8722

SEQ ID NO: 10930 - protein, 96 aa, unidentified; identical to SEQ ID NO: 8176

SEQ ID NO: 10931 - protein, 57 aa, unidentified; identical to SEQ ID NO: 8179

SEQ ID NO: 10932 - protein, 92 aa, unidentified
EAIKRLKIEANKSINLITSAVNSLINDQLIIKNHLRDLMGIPYCNYSKFWFLNHTMSNRTSLPRCWLISNGSYLNETEFSSDIEQEANNLIT

SEQ ID NO: 10933 - protein, 170 aa, unidentified; identical to SEQ ID NO: 8202

SEQ ID NO: 10934 - protein, 337 aa, unidentified; identical to SEQ ID NO: 10217

SEQ ID NO: 10935 - protein, 224 aa, unidentified; identical to SEQ ID NO: 10802

SEQ ID NO: 10936 - protein, 337 aa, unidentified; identical to SEQ ID NO: 10217

SEQ ID NO: 10937 - protein, 298 aa, unidentified; identical to SEQ ID NO: 8537

SEQ ID NO: 10938 - protein, 337 aa, unidentified; identical to SEQ ID NO: 10217

SEQ ID NO: 10939 - protein, 306 aa, unidentified
LNEERWASRDISGGGVEGIGINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCSHHFHELFLRDGRKLIVPCRDQHELVGRSMVSQGGSSGVAGTACLAKAYAQMWLMSYFHRRDLRTLGFGIMSSVPKDWFPTGRTTWSVHANHE

SEQ ID NO: 10940 - protein, 42 aa, unidentified; identical to SEQ ID NO: 8181

SEQ ID NO: 10941 - protein, 96 aa, unidentified; identical to SEQ ID NO: 8176

SEQ ID NO: 10942 - protein, 42 aa, unidentified; identical to SEQ ID NO: 8181

SEQ ID NO: 10943 - protein, 337 aa, unidentified; identical to SEQ ID NO: 8339

SEQ ID NO: 10944 - protein, 57 aa, unidentified; identical to SEQ ID NO: 8179

SEQ ID NO: 10945 - protein, 337 aa, unidentified; identical to SEQ ID NO: 8339

SEQ ID NO: 10946 - protein, 337 aa, unidentified; identical to SEQ ID NO: 8339

SEQ ID NO: 10947 - protein, 337 aa, unidentified; identical to SEQ ID NO: 8339

SEQ ID NO: 10948 - protein, 337 aa, unidentified; identical to SEQ ID NO: 8339

SEQ ID NO: 10949 - protein, 337 aa, unidentified; identical to SEQ ID NO: 8339

SEQ ID NO: 10950 - protein, 337 aa, unidentified; identical to SEQ ID NO: 8339

SEQ ID NO: 10951 - protein, 337 aa, unidentified; identical to SEQ ID NO: 10217

SEQ ID NO: 10952 - protein, 335 aa, unidentified; identical to SEQ ID NO: 8722

SEQ ID NO: 10953 - protein, 298 aa, unidentified; identical to SEQ ID NO: 8537

SEQ ID NO: 10954 - protein, 337 aa, unidentified; identical to SEQ ID NO: 8339

SEQ ID NO: 10955 - protein, 337 aa, unidentified; identical to SEQ ID NO: 8339

SEQ ID NO: 10956 - protein, 337 aa, unidentified; identical to SEQ ID NO: 8339

SEQ ID NO: 10957 - protein, 337 aa, unidentified; identical to SEQ ID NO: 8339

SEQ ID NO: 10958 - protein, 337 aa, unidentified; identical to SEQ ID NO: 8339

SEQ ID NO: 10959 - protein, 337 aa, unidentified; identical to SEQ ID NO: 10217

SEQ ID NO: 10960 - protein, 337 aa, unidentified; identical to SEQ ID NO: 8339

SEQ ID NO: 10961 - protein, 294 aa, unidentified
SRELSGGGVEGIPLNYLGYHLREMAQKPGVLYADDTAGWDTRITMADLEDEGILLDMMSGEHKKLASALFSKAYKVKVALCPRPGPKGGTLMDVISRTDQRGSGQVVTYALNTLTNIKVQLIRMAEAEGVLGATFEDFGIDRWLQEHGEDRVERMLVSGDDCVVNAIDERFGSSLNWLNAMEKVRKDIDLWKPSPSFRNWERVEFCSNHFHEMTMKDGRVIVAPCRGQTELIARGTVNQGGCVGVESTGCLAKAYAQMWLLLYFHRRDLRTLALAVMSAVPSNWIPTGRTTWSL

SEQ ID NO: 10962 - protein, 337 aa, unidentified; identical to SEQ ID NO: 8339

SEQ ID NO: 10963 - protein, 337 aa, unidentified; identical to SEQ ID NO: 8339

SEQ ID NO: 10964 - protein, 337 aa, unidentified; identical to SEQ ID NO: 8339

SEQ ID NO: 10965 - protein, 337 aa, unidentified; identical to SEQ ID NO: 10217

SEQ ID NO: 10966 - protein, 333 aa, unidentified; identical to SEQ ID NO: 8351

SEQ ID NO: 10967 - protein, 337 aa, unidentified; identical to SEQ ID NO: 8339

SEQ ID NO: 10968 - protein, 295 aa, unidentified; identical to SEQ ID NO: 9624

SEQ ID NO: 10969 - protein, 337 aa, unidentified; identical to SEQ ID NO: 8339

SEQ ID NO: 10970 - protein, 274 aa, unidentified
RKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCSHHFHELFLRDGRKLIVPCRDQHELVGRSMVSQGGSSGVAGTACLAKAYAQMWLMSYFHRRDLRTLGFGIMSSVPKDWFPTGRTTWSVHANHE

SEQ ID NO: 10971 - protein, 337 aa, unidentified; identical to SEQ ID NO: 8339

SEQ ID NO: 10972 - protein, 332 aa, unidentified; identical to SEQ ID NO: 9622

SEQ ID NO: 10973 - protein, 337 aa, unidentified; identical to SEQ ID NO: 8339

SEQ ID NO: 10974 - protein, 298 aa, unidentified; identical to SEQ ID NO: 8537

SEQ ID NO: 10975 - protein, 337 aa, unidentified; identical to SEQ ID NO: 10217

SEQ ID NO: 10976 - protein, 333 aa, unidentified; identical to SEQ ID NO: 8351

SEQ ID NO: 10977 - protein, 258 aa, unidentified; identical to SEQ ID NO: 8309

SEQ ID NO: 10978 - protein, 335 aa, unidentified; identical to SEQ ID NO: 8722

SEQ ID NO: 10979 - protein, 337 aa, unidentified; identical to SEQ ID NO: 8339

SEQ ID NO: 10980 - protein, 337 aa, unidentified; identical to SEQ ID NO: 8339

SEQ ID NO: 10981 - protein, 337 aa, unidentified; identical to SEQ ID NO: 8339

SEQ ID NO: 10982 - protein, 337 aa, unidentified; identical to SEQ ID NO: 8339

SEQ ID NO: 10983 - protein, 337 aa, unidentified; identical to SEQ ID NO: 8339

SEQ ID NO: 10984 - protein, 298 aa, unidentified; identical to SEQ ID NO: 8537

SEQ ID NO: 10985 - protein, 337 aa, unidentified; identical to SEQ ID NO: 8339

SEQ ID NO: 10986 - protein, 332 aa, unidentified; identical to SEQ ID NO: 9622

SEQ ID NO: 10987 - protein, 217 aa, unidentified
KPGEFGVAKGSRTIWYMWLGSRFLEFEALGFLNEERWASRDISGGGVEGIGINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLN

SEQ ID NO: 10988 - protein, 335 aa, unidentified; identical to SEQ ID NO: 8722

SEQ ID NO: 10989 - protein, 337 aa, unidentified; identical to SEQ ID NO: 8339

SEQ ID NO: 10990 - protein, 337 aa, unidentified; identical to SEQ ID NO: 10217

SEQ ID NO: 10991 - protein, 337 aa, unidentified; identical to SEQ ID NO: 8339

SEQ ID NO: 10992 - protein, 337 aa, unidentified; identical to SEQ ID NO: 8339

SEQ ID NO: 10993 - protein, 46 aa, unidentified
LEGDPKLHCQPKRSTNAEFTLQLNISRRHTNDHYRERIETGIRHMF

SEQ ID NO: 10994 - protein, 298 aa, unidentified; identical to SEQ ID NO: 8537

SEQ ID NO: 10995 - protein, 333 aa, unidentified; identical to SEQ ID NO: 8351

SEQ ID NO: 10996 - protein, 337 aa, unidentified; identical to SEQ ID NO: 8339

SEQ ID NO: 10997 - protein, 337 aa, unidentified; identical to SEQ ID NO: 8339

SEQ ID NO: 10998 - protein, 337 aa, unidentified; identical to SEQ ID NO: 8339

SEQ ID NO: 10999 - protein, 337 aa, unidentified; identical to SEQ ID NO: 8339

SEQ ID NO: 11000 - protein, 337 aa, unidentified; identical to SEQ ID NO: 8339

SEQ ID NO: 11001 - protein, 308 aa, unidentified
GFLNEERWASRDISGGGVEGIGINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCSHHFHELFLRDGRKLIVPCRDQHELVGRSMVSQGGSSGVAGTACLAKAYAQMWLMSYFHRRDLRTLGFGIMSSVPKDWFPTGRTTWSVHANHE

SEQ ID NO: 11002 - protein, 337 aa, unidentified; identical to SEQ ID NO: 10217

SEQ ID NO: 11003 - protein, 337 aa, unidentified; identical to SEQ ID NO: 8339

SEQ ID NO: 11004 - protein, 337 aa, unidentified; identical to SEQ ID NO: 8339

SEQ ID NO: 11005 - protein, 298 aa, unidentified; identical to SEQ ID NO: 8537

SEQ ID NO: 11006 - protein, 337 aa, unidentified; identical to SEQ ID NO: 8339

SEQ ID NO: 11007 - protein, 337 aa, unidentified; identical to SEQ ID NO: 8339

SEQ ID NO: 11008 - protein, 337 aa, unidentified; identical to SEQ ID NO: 8339

SEQ ID NO: 11009 - protein, 337 aa, unidentified; identical to SEQ ID NO: 8339

SEQ ID NO: 11010 - protein, 337 aa, unidentified; identical to SEQ ID NO: 8339

SEQ ID NO: 11011 - protein, 337 aa, unidentified; identical to SEQ ID NO: 10217

SEQ ID NO: 11012 - protein, 337 aa, unidentified; identical to SEQ ID NO: 8339

SEQ ID NO: 11013 - protein, 298 aa, unidentified; identical to SEQ ID NO: 8537

SEQ ID NO: 11014 - protein, 303 aa, unidentified; identical to SEQ ID NO: 8684

SEQ ID NO: 11015 - protein, 337 aa, unidentified; identical to SEQ ID NO: 8339

SEQ ID NO: 11016 - protein, 337 aa, unidentified; identical to SEQ ID NO: 8339

SEQ ID NO: 11017 - protein, 337 aa, unidentified; identical to SEQ ID NO: 8339

SEQ ID NO: 11018 - protein, 337 aa, unidentified; identical to SEQ ID NO: 8339

SEQ ID NO: 11019 - protein, 337 aa, unidentified; identical to SEQ ID NO: 8339

SEQ ID NO: 11020 - protein, 332 aa, unidentified; identical to SEQ ID NO: 9622

SEQ ID NO: 11021 - protein, 337 aa, unidentified; identical to SEQ ID NO: 8339

SEQ ID NO: 11022 - protein, 337 aa, unidentified; identical to SEQ ID NO: 8339

SEQ ID NO: 11023 - protein, 337 aa, unidentified; identical to SEQ ID NO: 8339

SEQ ID NO: 11024 - protein, 337 aa, unidentified; identical to SEQ ID NO: 8339

SEQ ID NO: 11025 - protein, 337 aa, unidentified; identical to SEQ ID NO: 8339

SEQ ID NO: 11026 - protein, 318 aa, unidentified
RTIWYMWLGSRFLEFESFGFLNEEHWASRELCGGGVEGIPLFYLGYHLEKMAEKAGILYADDTAGWDTRITMADLEDEYTLTELMEGEHKKLAETLFNFAYKNKVALCPRPGKNGGTVLDVISRTDQRGSGQVVTYALNTLTNIKVQLIRMAESEGVLDEEFHDNGMLKWLEKHGRDRLQRLMVSGDDCVVNAIDERFGKSLVWLNEMQKIRKDIDLWKPSAGHCNWEEVEFCSNHFHKLVMRDGRTLVVPCRHEVELVGRASVNQGGSTGISGTACLAKAYAQMWLLLYFHRRDLRILGMAICSAVPANWVPTGRTT

SEQ ID NO: 11027 - protein, 298 aa, unidentified; identical to SEQ ID NO: 8537

SEQ ID NO: 11028 - protein, 337 aa, unidentified; identical to SEQ ID NO: 8339

SEQ ID NO: 11029 - protein, 337 aa, unidentified; identical to SEQ ID NO: 8339

SEQ ID NO: 11030 - protein, 337 aa, unidentified; identical to SEQ ID NO: 8339

SEQ ID NO: 11031 - protein, 298 aa, unidentified; identical to SEQ ID NO: 8537

SEQ ID NO: 11032 - protein, 337 aa, unidentified; identical to SEQ ID NO: 8339

SEQ ID NO: 11033 - protein, 337 aa, unidentified; identical to SEQ ID NO: 8339

SEQ ID NO: 11034 - protein, 337 aa, unidentified; identical to SEQ ID NO: 8339

SEQ ID NO: 11035 - protein, 337 aa, unidentified; identical to SEQ ID NO: 8339

SEQ ID NO: 11036 - protein, 337 aa, unidentified; identical to SEQ ID NO: 8339

SEQ ID NO: 11037 - protein, 337 aa, unidentified; identical to SEQ ID NO: 8339

SEQ ID NO: 11038 - protein, 337 aa, unidentified; identical to SEQ ID NO: 8339

SEQ ID NO: 11039 - protein, 298 aa, unidentified; identical to SEQ ID NO: 8537

SEQ ID NO: 11040 - protein, 337 aa, unidentified; identical to SEQ ID NO: 8339

SEQ ID NO: 11041 - protein, 337 aa, unidentified; identical to SEQ ID NO: 8339

SEQ ID NO: 11042 - protein, 298 aa, unidentified; identical to SEQ ID NO: 8537

SEQ ID NO: 11043 - protein, 295 aa, unidentified; identical to SEQ ID NO: 9624

SEQ ID NO: 11044 - protein, 337 aa, unidentified; identical to SEQ ID NO: 8339

SEQ ID NO: 11045 - protein, 337 aa, unidentified; identical to SEQ ID NO: 8339

SEQ ID NO: 11046 - protein, 337 aa, unidentified; identical to SEQ ID NO: 8339

SEQ ID NO: 11047 - protein, 332 aa, unidentified; identical to SEQ ID NO: 9622

SEQ ID NO: 11048 - protein, 337 aa, unidentified; identical to SEQ ID NO: 8339

SEQ ID NO: 11049 - protein, 337 aa, unidentified; identical to SEQ ID NO: 8339

SEQ ID NO: 11050 - protein, 337 aa, unidentified; identical to SEQ ID NO: 8339

SEQ ID NO: 11051 - protein, 337 aa, unidentified; identical to SEQ ID NO: 8339

SEQ ID NO: 11052 - protein, 337 aa, unidentified; identical to SEQ ID NO: 8339

SEQ ID NO: 11053 - protein, 337 aa, unidentified; identical to SEQ ID NO: 8339

SEQ ID NO: 11054 - protein, 332 aa, unidentified; identical to SEQ ID NO: 9622

SEQ ID NO: 11055 - protein, 337 aa, unidentified; identical to SEQ ID NO: 8339

SEQ ID NO: 11056 - protein, 337 aa, unidentified; identical to SEQ ID NO: 8339

SEQ ID NO: 11057 - protein, 337 aa, unidentified; identical to SEQ ID NO: 8339

SEQ ID NO: 11058 - protein, 337 aa, unidentified; identical to SEQ ID NO: 8339

SEQ ID NO: 11059 - protein, 337 aa, unidentified; identical to SEQ ID NO: 8339

SEQ ID NO: 11060 - protein, 337 aa, unidentified; identical to SEQ ID NO: 8339

SEQ ID NO: 11061 - protein, 337 aa, unidentified; identical to SEQ ID NO: 8339

SEQ ID NO: 11062 - protein, 337 aa, unidentified; identical to SEQ ID NO: 8339

SEQ ID NO: 11063 - protein, 337 aa, unidentified; identical to SEQ ID NO: 8339

SEQ ID NO: 11064 - protein, 337 aa, unidentified; identical to SEQ ID NO: 8339

SEQ ID NO: 11065 - protein, 277 aa, unidentified
KPGEFGVAKGSRTIWYMWLGSRFLEFEALGFLNEERWASRDISGGGVEGIGINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCSHHFHELFLRDGRKLIVPCRDQHELVGRSMVSQ

SEQ ID NO: 11066 - protein, 337 aa, unidentified; identical to SEQ ID NO: 8339

SEQ ID NO: 11067 - protein, 337 aa, unidentified; identical to SEQ ID NO: 8339

SEQ ID NO: 11068 - protein, 333 aa, unidentified; identical to SEQ ID NO: 8351

SEQ ID NO: 11069 - protein, 337 aa, unidentified; identical to SEQ ID NO: 8339

SEQ ID NO: 11070 - protein, 337 aa, unidentified; identical to SEQ ID NO: 8339

SEQ ID NO: 11071 - protein, 337 aa, unidentified; identical to SEQ ID NO: 8339

SEQ ID NO: 11072 - protein, 337 aa, unidentified; identical to SEQ ID NO: 8339

SEQ ID NO: 11073 - protein, 332 aa, unidentified; identical to SEQ ID NO: 9622

SEQ ID NO: 11074 - protein, 337 aa, unidentified; identical to SEQ ID NO: 8339

SEQ ID NO: 11075 - protein, 337 aa, unidentified; identical to SEQ ID NO: 8339

SEQ ID NO: 11076 - protein, 209 aa, unidentified; identical to SEQ ID NO: 9505

SEQ ID NO: 11077 - protein, 337 aa, unidentified; identical to SEQ ID NO: 8339

SEQ ID NO: 11078 - protein, 337 aa, unidentified; identical to SEQ ID NO: 8339

SEQ ID NO: 11079 - protein, 337 aa, unidentified; identical to SEQ ID NO: 8339

SEQ ID NO: 11080 - protein, 337 aa, unidentified; identical to SEQ ID NO: 8339

SEQ ID NO: 11081 - protein, 337 aa, unidentified; identical to SEQ ID NO: 8339

SEQ ID NO: 11082 - protein, 337 aa, unidentified; identical to SEQ ID NO: 8339

SEQ ID NO: 11083 - protein, 337 aa, unidentified; identical to SEQ ID NO: 8339

SEQ ID NO: 11084 - protein, 337 aa, unidentified; identical to SEQ ID NO: 8339

SEQ ID NO: 11085 - protein, 337 aa, unidentified; identical to SEQ ID NO: 8339

SEQ ID NO: 11086 - protein, 337 aa, unidentified; identical to SEQ ID NO: 8339

SEQ ID NO: 11087 - protein, 298 aa, unidentified; identical to SEQ ID NO: 8537

SEQ ID NO: 11088 - protein, 332 aa, unidentified; identical to SEQ ID NO: 9622

SEQ ID NO: 11089 - protein, 337 aa, unidentified; identical to SEQ ID NO: 8339

SEQ ID NO: 11090 - protein, 337 aa, unidentified; identical to SEQ ID NO: 8339

SEQ ID NO: 11091 - protein, 337 aa, unidentified; identical to SEQ ID NO: 8339

SEQ ID NO: 11092 - protein, 337 aa, unidentified; identical to SEQ ID NO: 8339

SEQ ID NO: 11093 - protein, 337 aa, unidentified; identical to SEQ ID NO: 8339

SEQ ID NO: 11094 - protein, 332 aa, unidentified; identical to SEQ ID NO: 9622

SEQ ID NO: 11095 - protein, 337 aa, unidentified; identical to SEQ ID NO: 8339

SEQ ID NO: 11096 - protein, 337 aa, unidentified; identical to SEQ ID NO: 8339

SEQ ID NO: 11097 - protein, 315 aa, unidentified
FLEFEALGFLNEERWASRDISGGGVEGIGINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCSHHFHELFLRDGRKLIVPCRDQHELVGRSMVSQGGSSGVAGTACLAKAYAQMWLMSYFHRRDLRTLGFGIMSSVPKDWFPTGRTTWSVHANHE

SEQ ID NO: 11098 - protein, 337 aa, unidentified; identical to SEQ ID NO: 8339

SEQ ID NO: 11099 - protein, 333 aa, unidentified; identical to SEQ ID NO: 8351

SEQ ID NO: 11100 - protein, 337 aa, unidentified; identical to SEQ ID NO: 8339

SEQ ID NO: 11101 - protein, 337 aa, unidentified; identical to SEQ ID NO: 8339

SEQ ID NO: 11102 - protein, 332 aa, unidentified; identical to SEQ ID NO: 9622

SEQ ID NO: 11103 - protein, 337 aa, unidentified; identical to SEQ ID NO: 8339

SEQ ID NO: 11104 - protein, 337 aa, unidentified; identical to SEQ ID NO: 8339

SEQ ID NO: 11105 - protein, 258 aa, unidentified; identical to SEQ ID NO: 8309

SEQ ID NO: 11106 - protein, 337 aa, unidentified; identical to SEQ ID NO: 8339

SEQ ID NO: 11107 - protein, 337 aa, unidentified; identical to SEQ ID NO: 8339

SEQ ID NO: 11108 - protein, 337 aa, unidentified; identical to SEQ ID NO: 8339

SEQ ID NO: 11109 - protein, 337 aa, unidentified; identical to SEQ ID NO: 8339

SEQ ID NO: 11110 - protein, 306 aa, unidentified; identical to SEQ ID NO: 10939

SEQ ID NO: 11111 - protein, 332 aa, unidentified; identical to SEQ ID NO: 9622

SEQ ID NO: 11112 - protein, 278 aa, unidentified; identical to SEQ ID NO: 8332

SEQ ID NO: 11113 - protein, 335 aa, unidentified; identical to SEQ ID NO: 8722

SEQ ID NO: 11114 - protein, 337 aa, unidentified; identical to SEQ ID NO: 8339

SEQ ID NO: 11115 - protein, 337 aa, unidentified; identical to SEQ ID NO: 8339

SEQ ID NO: 11116 - protein, 334 aa, unidentified
KPGEFGVAKGSRTIWYMWLGSRFLEFEALGFLNEERWASRDISGGGVEGIGINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCSHHFHELFLRDGRKLIVPCRDQHELVGRSMVSQGGSSGVAGTACLAKAYAQMWLMSYFHRRDLRTLGFGIMSSVPKDWFPTGRTTWSVHA

SEQ ID NO: 11117 - protein, 337 aa, unidentified; identical to SEQ ID NO: 8339

SEQ ID NO: 11118 - protein, 332 aa, unidentified; identical to SEQ ID NO: 9622

SEQ ID NO: 11119 - protein, 337 aa, unidentified; identical to SEQ ID NO: 8339

SEQ ID NO: 11120 - protein, 337 aa, unidentified; identical to SEQ ID NO: 8339

SEQ ID NO: 11121 - protein, 298 aa, unidentified; identical to SEQ ID NO: 8537

SEQ ID NO: 11122 - protein, 217 aa, unidentified; identical to SEQ ID NO: 10987

SEQ ID NO: 11123 - protein, 298 aa, unidentified; identical to SEQ ID NO: 8537

SEQ ID NO: 11124 - protein, 337 aa, unidentified; identical to SEQ ID NO: 8339

SEQ ID NO: 11125 - protein, 307 aa, unidentified
FLNEERWASRDISGGGVEGIGINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCSHHFHELFLRDGRKLIVPCRDQHELVGRSMVSQGGSSGVAGTACLAKAYAQMWLMSYFHRRDLRTLGFGIMSSVPKDWFPTGRTTWSVHANHE

SEQ ID NO: 11126 - protein, 337 aa, unidentified; identical to SEQ ID NO: 8339

SEQ ID NO: 11127 - protein, 335 aa, unidentified; identical to SEQ ID NO: 8722

SEQ ID NO: 11128 - protein, 337 aa, unidentified; identical to SEQ ID NO: 8339

SEQ ID NO: 11129 - protein, 337 aa, unidentified; identical to SEQ ID NO: 8339

SEQ ID NO: 11130 - protein, 337 aa, unidentified; identical to SEQ ID NO: 8339

SEQ ID NO: 11131 - protein, 337 aa, unidentified; identical to SEQ ID NO: 8339

SEQ ID NO: 11132 - protein, 337 aa, unidentified; identical to SEQ ID NO: 8339

SEQ ID NO: 11133 - protein, 337 aa, unidentified; identical to SEQ ID NO: 8339

SEQ ID NO: 11134 - protein, 143 aa, unidentified; identical to SEQ ID NO: 8341

SEQ ID NO: 11135 - protein, 337 aa, unidentified; identical to SEQ ID NO: 8339

SEQ ID NO: 11136 - protein, 333 aa, unidentified; identical to SEQ ID NO: 8351

SEQ ID NO: 11137 - protein, 335 aa, unidentified; identical to SEQ ID NO: 8722

SEQ ID NO: 11138 - protein, 332 aa, unidentified; identical to SEQ ID NO: 9622

SEQ ID NO: 11139 - protein, 131 aa, unidentified
LYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDD

SEQ ID NO: 11140 - protein, 337 aa, unidentified; identical to SEQ ID NO: 8339

SEQ ID NO: 11141 - protein, 337 aa, unidentified; identical to SEQ ID NO: 8339

SEQ ID NO: 11142 - protein, 273 aa, unidentified
KPGEFGVAKGSRTIWYMWLGSRFLEFEALGFLNEERWASRDISGGGVEGIGINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCSHHFHELFLRDGRKLIVPCRDQHELVGRS

SEQ ID NO: 11143 - protein, 337 aa, unidentified; identical to SEQ ID NO: 8339

SEQ ID NO: 11144 - protein, 242 aa, unidentified; identical to SEQ ID NO: 9313

SEQ ID NO: 11145 - protein, 337 aa, unidentified; identical to SEQ ID NO: 8339

SEQ ID NO: 11146 - protein, 337 aa, unidentified; identical to SEQ ID NO: 8339

SEQ ID NO: 11147 - protein, 337 aa, unidentified; identical to SEQ ID NO: 8339

SEQ ID NO: 11148 - protein, 279 aa, unidentified; identical to SEQ ID NO: 9724

SEQ ID NO: 11149 - protein, 194 aa, unidentified
KGSRTIWYMWLGSRFLEFESFGFLNEEHWASRELCGGGVEGIPLFYLGYHLEKMAEKAGILYADDTAGWDTRITMADLEDEYTLTELMEGEHKKLAETLFNFAYKNKVALCPRPGKNGGTVLDVISRTDQRGSGQVVTYALNTLTNIKVQLIRMAESEGVLDEEFHDNGMLKWLEKHGRDRLQRLMVSGDDCVV

SEQ ID NO: 11150 - protein, 264 aa, unidentified
KPGEFGVAKGSRTIWYMWLGSRFLEFEALGFLNEERWASRDISGGGVEGIGINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCSHHFHELFLRDGRKLIVPCR

SEQ ID NO: 11151 - protein, 268 aa, unidentified
GILYADDTAGWDTRITMADLEDEYTLTELMEGEHKKLAETLFNFAYKNKVALCPRPGKNGGTVLDVISRTDQRGSGQVVTYALNTLTNIKVQLIRMAESEGVLDEEFHDNGMLKWLEKHGRDRLQRLMVSGDDCVVNAIDERFGKSLVWLNEMQKIRKDIDLWKPSAGHCNWEEVEFCSNHFHKLVMRDGRTLVVPCRHEVELVGRASVNQGGSTGISGTACLAKAYAQMWLLLYFHRRDLRILGMAICSAVPANWVPTGRTTWSLHA

SEQ ID NO: 11152 - protein, 270 aa, unidentified; identical to SEQ ID NO: 8331

SEQ ID NO: 11153 - protein, 337 aa, unidentified; identical to SEQ ID NO: 8339

SEQ ID NO: 11154 - protein, 337 aa, unidentified; identical to SEQ ID NO: 8339

SEQ ID NO: 11155 - protein, 231 aa, unidentified; identical to SEQ ID NO: 9733

SEQ ID NO: 11156 - protein, 247 aa, unidentified
LEFEALGFLNEERWASRDISGGGVEGIGINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCSHHFHELFLRDGRKLIVPCRDQHELV

SEQ ID NO: 11157 - protein, 247 aa, unidentified; identical to SEQ ID NO: 11156

SEQ ID NO: 11158 - protein, 337 aa, unidentified; identical to SEQ ID NO: 8339

SEQ ID NO: 11159 - protein, 337 aa, unidentified; identical to SEQ ID NO: 8339

SEQ ID NO: 11160 - protein, 337 aa, unidentified; identical to SEQ ID NO: 8339

SEQ ID NO: 11161 - protein, 333 aa, unidentified; identical to SEQ ID NO: 8351

SEQ ID NO: 11162 - protein, 337 aa, unidentified; identical to SEQ ID NO: 8339

SEQ ID NO: 11163 - protein, 333 aa, unidentified; identical to SEQ ID NO: 8351

SEQ ID NO: 11164 - protein, 204 aa, unidentified; identical to SEQ ID NO: 10848

SEQ ID NO: 11165 - protein, 333 aa, unidentified; identical to SEQ ID NO: 8351

SEQ ID NO: 11166 - protein, 337 aa, unidentified; identical to SEQ ID NO: 8339

SEQ ID NO: 11167 - protein, 337 aa, unidentified; identical to SEQ ID NO: 8339

SEQ ID NO: 11168 - protein, 320 aa, unidentified; identical to SEQ ID NO: 8962

SEQ ID NO: 11169 - protein, 254 aa, unidentified; identical to SEQ ID NO: 10832

SEQ ID NO: 11170 - protein, 176 aa, unidentified
PHHRALIAVTMRLAYQNIAAVFPRTQSKYGSGFVMDFLGRRDQRGSGQVVTFALNTITNGKVQVARVLESEGLLHADESVLDAWLEKHLEEALGNMVIAGEEVVVSTTNRDFSSALEYLELTGKTRKNVPQGAPSRMESDWEKVEFCFHHYHEMCLKDGRILIAPCRHENEVLGRS

SEQ ID NO: 11171 - protein, 337 aa, unidentified; identical to SEQ ID NO: 8339

SEQ ID NO: 11172 - protein, 253 aa, unidentified
KPGDFGVAKGSRTIWYMWLGSRFLEFESFGFLNEEHWASRELSGGGVEGIPLNYLGYHLREMAQKPGVLYADDTAGWDTRITMADLEDEGILLDMMSGEHKKLASALFSKAYKVKVALCPRPGPKGGTLMDVISRTDQRGSGQVVTYALNTLTNIKVQLIRMAEAEGVLGATFEDFGIDRWLQEHGEDRVERMLVSGDDCVVNAIDERFGSSLNWLNAMEKVRKDIDLWKPSPSFRNWERVEFCSNHFHEMTM

SEQ ID NO: 11173 - protein, 194 aa, unidentified; identical to SEQ ID NO: 10849

SEQ ID NO: 11174 - protein, 226 aa, unidentified; identical to SEQ ID NO: 10364

SEQ ID NO: 11175 - protein, 202 aa, unidentified; identical to SEQ ID NO: 10449

SEQ ID NO: 11176 - protein, 337 aa, unidentified; identical to SEQ ID NO: 8339

SEQ ID NO: 11177 - protein, 214 aa, unidentified
PHHRALIAVTMRLAYQNIAAVFPRTQSKYGSGFVMDFLGRRDQRGSGQVVTFALNTITNGKVQVARVLESEGLLHADESVLDAWLEKHLEEALGNMVIAGEEVVVSTTNRDFSSALEYLELTGKTRKNVPQGAPSRMESDWEKVEFCFHHYHEMCLKDGRILIAPCRHENEVLGRSRLQKGGVVSIPESACMAKAYAQMWALYFFHRRDLRLGF

SEQ ID NO: 11178 - protein, 85 aa, unidentified
EDILIAGPYNLIRTAFLDLEPARGPERHGPFGDGRLQPGDGLSEGFQPITDEEMQTEVGTIGAARNEIRLLREALQRLQVGGVGR

SEQ ID NO: 11179 - protein, 320 aa, unidentified; identical to SEQ ID NO: 8962

SEQ ID NO: 11180 - protein, 243 aa, unidentified; identical to SEQ ID NO: 10870

SEQ ID NO: 11181 - protein, 231 aa, unidentified; identical to SEQ ID NO: 9315

SEQ ID NO: 11182 - protein, 194 aa, unidentified; identical to SEQ ID NO: 10849

SEQ ID NO: 11183 - protein, 128 aa, unidentified
CEMTKLNAYCLYSDAIPVTESLRDCMNGLFSQCGFVRIIGSFANRFASVNGVIYANCKHLTCSCLQPDEIITQDTNVPLTIIDTKRCTKISLGHLTFTIREYANVTYSLRTEIANSQITVVSPLDLSS

SEQ ID NO: 11184 - protein, 333 aa, unidentified; identical to SEQ ID NO: 8351

SEQ ID NO: 11185 - protein, 311 aa, unidentified; identical to SEQ ID NO: 9484

SEQ ID NO: 11186 - protein, 153 aa, unidentified
HHRALIAVTMRLAYQNIAAVFPRTQSKYGSGFVMDFLGRRDQRGSGQVVTFALNTITNGKVQVARVLESEGLLHADESVLDAWLEKHLEEALGNMVIAGEEVVVSTTNRDFSSALEYLELTGKTRKNVPQGAPSRMESDWEKVEFCFHHYHEM

SEQ ID NO: 11187 - protein, 311 aa, unidentified; identical to SEQ ID NO: 9495

SEQ ID NO: 11188 - protein, 86 aa, unidentified
LRNSKIAGCSYWSDVRSCGMDMKMIPIIAYLYRGKTDEDFMIVSQEHGIKAPFRSGEILLQDTAYIWNSTLDKDHICVWRVIGTTT

SEQ ID NO: 11189 - protein, 231 aa, unidentified; identical to SEQ ID NO: 9733

SEQ ID NO: 11190 - protein, 332 aa, unidentified; identical to SEQ ID NO: 9622

SEQ ID NO: 11191 - protein, 333 aa, unidentified; identical to SEQ ID NO: 8351

SEQ ID NO: 11192 - protein, 335 aa, unidentified; identical to SEQ ID NO: 8722

SEQ ID NO: 11193 - protein, 337 aa, unidentified; identical to SEQ ID NO: 8339

SEQ ID NO: 11194 - protein, 337 aa, unidentified; identical to SEQ ID NO: 8339

SEQ ID NO: 11195 - protein, 337 aa, unidentified; identical to SEQ ID NO: 8339

SEQ ID NO: 11196 - protein, 273 aa, unidentified; identical to SEQ ID NO: 11142

SEQ ID NO: 11197 - protein, 333 aa, unidentified; identical to SEQ ID NO: 8351

SEQ ID NO: 11198 - protein, 337 aa, unidentified; identical to SEQ ID NO: 8339

SEQ ID NO: 11199 - protein, 337 aa, unidentified; identical to SEQ ID NO: 8339

SEQ ID NO: 11200 - protein, 337 aa, unidentified; identical to SEQ ID NO: 8339

SEQ ID NO: 11201 - protein, 333 aa, unidentified; identical to SEQ ID NO: 8351

SEQ ID NO: 11202 - protein, 337 aa, unidentified; identical to SEQ ID NO: 8339

SEQ ID NO: 11203 - protein, 231 aa, unidentified; identical to SEQ ID NO: 9733

SEQ ID NO: 11204 - protein, 187 aa, unidentified; identical to SEQ ID NO: 10447

SEQ ID NO: 11205 - protein, 333 aa, unidentified; identical to SEQ ID NO: 8351

SEQ ID NO: 11206 - protein, 332 aa, unidentified; identical to SEQ ID NO: 9622

SEQ ID NO: 11207 - protein, 332 aa, unidentified; identical to SEQ ID NO: 9622

SEQ ID NO: 11208 - protein, 319 aa, unidentified; identical to SEQ ID NO: 8858

SEQ ID NO: 11209 - protein, 319 aa, unidentified; identical to SEQ ID NO: 8858

SEQ ID NO: 11210 - protein, 337 aa, unidentified; identical to SEQ ID NO: 8339

SEQ ID NO: 11211 - protein, 337 aa, unidentified; identical to SEQ ID NO: 8339

SEQ ID NO: 11212 - protein, 333 aa, unidentified; identical to SEQ ID NO: 8351

SEQ ID NO: 11213 - protein, 202 aa, unidentified; identical to SEQ ID NO: 10449

SEQ ID NO: 11214 - protein, 333 aa, unidentified; identical to SEQ ID NO: 8351

SEQ ID NO: 11215 - protein, 333 aa, unidentified; identical to SEQ ID NO: 8351

SEQ ID NO: 11216 - protein, 337 aa, unidentified; identical to SEQ ID NO: 8339

SEQ ID NO: 11217 - protein, 42 aa, unidentified; identical to SEQ ID NO: 8181

SEQ ID NO: 11218 - protein, 198 aa, unidentified
KGSRTIWYMWLGSRFLEFEALGFLNEERWASRDISGGGVEGIGINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALD

SEQ ID NO: 11219 - protein, 337 aa, unidentified; identical to SEQ ID NO: 8339

SEQ ID NO: 11220 - protein, 337 aa, unidentified; identical to SEQ ID NO: 8339

SEQ ID NO: 11221 - protein, 337 aa, unidentified; identical to SEQ ID NO: 8339

SEQ ID NO: 11222 - protein, 231 aa, unidentified; identical to SEQ ID NO: 9733

SEQ ID NO: 11223 - protein, 264 aa, unidentified; identical to SEQ ID NO: 11150

SEQ ID NO: 11224 - protein, 333 aa, unidentified; identical to SEQ ID NO: 8351

SEQ ID NO: 11225 - protein, 337 aa, unidentified; identical to SEQ ID NO: 8339

SEQ ID NO: 11226 - protein, 337 aa, unidentified; identical to SEQ ID NO: 8339

SEQ ID NO: 11227 - protein, 99 aa, unidentified
PHHRALIAVTMRLAYQNIAAVFPRTQSKYGSGFVMDFLGRRDQRGSGQVVTFALNTITNGKVQVARVLESEGLLHADESVLDAWLEKHLEEALGNMVIA

SEQ ID NO: 11228 - protein, 337 aa, unidentified; identical to SEQ ID NO: 8339

SEQ ID NO: 11229 - protein, 333 aa, unidentified; identical to SEQ ID NO: 8351

SEQ ID NO: 11230 - protein, 337 aa, unidentified; identical to SEQ ID NO: 8339

SEQ ID NO: 11231 - protein, 231 aa, unidentified; identical to SEQ ID NO: 9315

SEQ ID NO: 11232 - protein, 226 aa, unidentified; identical to SEQ ID NO: 10364

SEQ ID NO: 11233 - protein, 337 aa, unidentified; identical to SEQ ID NO: 8339

SEQ ID NO: 11234 - protein, 226 aa, unidentified; identical to SEQ ID NO: 10364

SEQ ID NO: 11235 - protein, 333 aa, unidentified; identical to SEQ ID NO: 8351

SEQ ID NO: 11236 - protein, 337 aa, unidentified; identical to SEQ ID NO: 8339

SEQ ID NO: 11237 - protein, 337 aa, unidentified; identical to SEQ ID NO: 8339

SEQ ID NO: 11238 - protein, 333 aa, unidentified; identical to SEQ ID NO: 8351

SEQ ID NO: 11239 - protein, 337 aa, unidentified; identical to SEQ ID NO: 8339

SEQ ID NO: 11240 - protein, 226 aa, unidentified; identical to SEQ ID NO: 10364

SEQ ID NO: 11241 - protein, 96 aa, unidentified; identical to SEQ ID NO: 8176

SEQ ID NO: 11242 - protein, 42 aa, unidentified; identical to SEQ ID NO: 8181

SEQ ID NO: 11243 - protein, 337 aa, unidentified; identical to SEQ ID NO: 8339

SEQ ID NO: 11244 - protein, 337 aa, unidentified; identical to SEQ ID NO: 8339

SEQ ID NO: 11245 - protein, 84 aa, unidentified; identical to SEQ ID NO: 8174

SEQ ID NO: 11246 - protein, 229 aa, unidentified; identical to SEQ ID NO: 8171

SEQ ID NO: 11247 - protein, 337 aa, unidentified; identical to SEQ ID NO: 8339

SEQ ID NO: 11248 - protein, 337 aa, unidentified; identical to SEQ ID NO: 8339

SEQ ID NO: 11249 - protein, 231 aa, unidentified; identical to SEQ ID NO: 9733

SEQ ID NO: 11250 - protein, 187 aa, unidentified; identical to SEQ ID NO: 10447

SEQ ID NO: 11251 - protein, 337 aa, unidentified; identical to SEQ ID NO: 8339

SEQ ID NO: 11252 - protein, 337 aa, unidentified; identical to SEQ ID NO: 8339

SEQ ID NO: 11253 - protein, 337 aa, unidentified; identical to SEQ ID NO: 8339

SEQ ID NO: 11254 - protein, 337 aa, unidentified; identical to SEQ ID NO: 8339

SEQ ID NO: 11255 - protein, 319 aa, unidentified; identical to SEQ ID NO: 10694

SEQ ID NO: 11256 - protein, 337 aa, unidentified; identical to SEQ ID NO: 10217

SEQ ID NO: 11257 - protein, 57 aa, unidentified; identical to SEQ ID NO: 8179

SEQ ID NO: 11258 - protein, 337 aa, unidentified; identical to SEQ ID NO: 8339

SEQ ID NO: 11259 - protein, 162 aa, unidentified
PHHRALIAVTMRLAYQNIAAVFPRTQSKYGSGFVMDFLGRRDQRGSGQVVTFALNTITNGKVQVARVLESEGLLHADESVLDAWLEKHLEEALGNMVIAGEEVVVSTTNRDFSSALEYLELTGKTRKNVPQGAPSRMESDWEKVEFCFHHYHEMCLKDGRIL

SEQ ID NO: 11260 - protein, 187 aa, unidentified; identical to SEQ ID NO: 10447

SEQ ID NO: 11261 - protein, 337 aa, unidentified; identical to SEQ ID NO: 8339

SEQ ID NO: 11262 - protein, 337 aa, unidentified; identical to SEQ ID NO: 8339

SEQ ID NO: 11263 - protein, 335 aa, unidentified; identical to SEQ ID NO: 8722

SEQ ID NO: 11264 - protein, 337 aa, unidentified; identical to SEQ ID NO: 8339

SEQ ID NO: 11265 - protein, 337 aa, unidentified; identical to SEQ ID NO: 10217

SEQ ID NO: 11266 - protein, 239 aa, unidentified; identical to SEQ ID NO: 10024

SEQ ID NO: 11267 - protein, 96 aa, unidentified; identical to SEQ ID NO: 8176

SEQ ID NO: 11268 - protein, 335 aa, unidentified; identical to SEQ ID NO: 8722

SEQ ID NO: 11269 - protein, 332 aa, unidentified; identical to SEQ ID NO: 9622

SEQ ID NO: 11270 - protein, 337 aa, unidentified; identical to SEQ ID NO: 8339

SEQ ID NO: 11271 - protein, 332 aa, unidentified; identical to SEQ ID NO: 9622

SEQ ID NO: 11272 - protein, 210 aa, unidentified
GINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCSHHFHELFLRDGRKLI

SEQ ID NO: 11273 - protein, 337 aa, unidentified; identical to SEQ ID NO: 8339

SEQ ID NO: 11274 - protein, 337 aa, unidentified; identical to SEQ ID NO: 8339

SEQ ID NO: 11275 - protein, 268 aa, unidentified; identical to SEQ ID NO: 11151

SEQ ID NO: 11276 - protein, 337 aa, unidentified; identical to SEQ ID NO: 8339

SEQ ID NO: 11277 - protein, 337 aa, unidentified; identical to SEQ ID NO: 8339

SEQ ID NO: 11278 - protein, 337 aa, unidentified; identical to SEQ ID NO: 8339

SEQ ID NO: 11279 - protein, 298 aa, unidentified; identical to SEQ ID NO: 8537

SEQ ID NO: 11280 - protein, 337 aa, unidentified; identical to SEQ ID NO: 8339

SEQ ID NO: 11281 - protein, 337 aa, unidentified; identical to SEQ ID NO: 8339

SEQ ID NO: 11282 - protein, 151 aa, unidentified
GVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLN

SEQ ID NO: 11283 - protein, 307 aa, unidentified; identical to SEQ ID NO: 11125

SEQ ID NO: 11284 - protein, 332 aa, unidentified; identical to SEQ ID NO: 9622

SEQ ID NO: 11285 - protein, 337 aa, unidentified; identical to SEQ ID NO: 8339

SEQ ID NO: 11286 - protein, 337 aa, unidentified; identical to SEQ ID NO: 8339

SEQ ID NO: 11287 - protein, 337 aa, unidentified; identical to SEQ ID NO: 8339

SEQ ID NO: 11288 - protein, 337 aa, unidentified; identical to SEQ ID NO: 8339

SEQ ID NO: 11289 - protein, 331 aa, unidentified
FGVAKGSRTIWYMWLGSRFLEFEALGFLNEERWASRDISGGGVEGIGINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCSHHFHELFLRDGRKLIVPCRDQHELVGRSMVSQGGSSGVAGTACLAKAYAQMWLMSYFHRRDLRTLGFGIMSSVPKDWFPTGRTTWSVHAN

SEQ ID NO: 11290 - protein, 337 aa, unidentified; identical to SEQ ID NO: 8339

SEQ ID NO: 11291 - protein, 333 aa, unidentified; identical to SEQ ID NO: 8351

SEQ ID NO: 11292 - protein, 337 aa, unidentified; identical to SEQ ID NO: 8339

SEQ ID NO: 11293 - protein, 295 aa, unidentified; identical to SEQ ID NO: 9624

SEQ ID NO: 11294 - protein, 295 aa, unidentified; identical to SEQ ID NO: 9624

SEQ ID NO: 11295 - protein, 298 aa, unidentified; identical to SEQ ID NO: 8537

SEQ ID NO: 11296 - protein, 337 aa, unidentified; identical to SEQ ID NO: 10217

SEQ ID NO: 11297 - protein, 337 aa, unidentified; identical to SEQ ID NO: 8339

SEQ ID NO: 11298 - protein, 337 aa, unidentified; identical to SEQ ID NO: 8339

SEQ ID NO: 11299 - protein, 337 aa, unidentified; identical to SEQ ID NO: 8339

SEQ ID NO: 11300 - protein, 337 aa, unidentified; identical to SEQ ID NO: 8339

SEQ ID NO: 11301 - protein, 337 aa, unidentified; identical to SEQ ID NO: 8339

SEQ ID NO: 11302 - protein, 337 aa, unidentified; identical to SEQ ID NO: 8339

SEQ ID NO: 11303 - protein, 337 aa, unidentified; identical to SEQ ID NO: 8339

SEQ ID NO: 11304 - protein, 337 aa, unidentified; identical to SEQ ID NO: 8339

SEQ ID NO: 11305 - protein, 295 aa, unidentified; identical to SEQ ID NO: 9624

SEQ ID NO: 11306 - protein, 337 aa, unidentified; identical to SEQ ID NO: 8339

SEQ ID NO: 11307 - protein, 337 aa, unidentified; identical to SEQ ID NO: 8339

SEQ ID NO: 11308 - protein, 337 aa, unidentified; identical to SEQ ID NO: 8339

SEQ ID NO: 11309 - protein, 337 aa, unidentified; identical to SEQ ID NO: 8339

SEQ ID NO: 11310 - protein, 70 aa, unidentified; identical to SEQ ID NO: 8269

SEQ ID NO: 11311 - protein, 337 aa, unidentified; identical to SEQ ID NO: 8339

SEQ ID NO: 11312 - protein, 337 aa, unidentified; identical to SEQ ID NO: 8339

SEQ ID NO: 11313 - protein, 337 aa, unidentified; identical to SEQ ID NO: 8339

SEQ ID NO: 11314 - protein, 337 aa, unidentified; identical to SEQ ID NO: 8339

SEQ ID NO: 11315 - protein, 337 aa, unidentified; identical to SEQ ID NO: 8339

SEQ ID NO: 11316 - protein, 337 aa, unidentified; identical to SEQ ID NO: 8339

SEQ ID NO: 11317 - protein, 337 aa, unidentified; identical to SEQ ID NO: 8339

SEQ ID NO: 11318 - protein, 337 aa, unidentified; identical to SEQ ID NO: 8339

SEQ ID NO: 11319 - protein, 337 aa, unidentified; identical to SEQ ID NO: 8339

SEQ ID NO: 11320 - protein, 337 aa, unidentified; identical to SEQ ID NO: 8339

SEQ ID NO: 11321 - protein, 337 aa, unidentified; identical to SEQ ID NO: 8339

SEQ ID NO: 11322 - protein, 337 aa, unidentified; identical to SEQ ID NO: 8339

SEQ ID NO: 11323 - protein, 298 aa, unidentified; identical to SEQ ID NO: 8537

SEQ ID NO: 11324 - protein, 337 aa, unidentified; identical to SEQ ID NO: 8339

SEQ ID NO: 11325 - protein, 337 aa, unidentified; identical to SEQ ID NO: 8339

SEQ ID NO: 11326 - protein, 337 aa, unidentified; identical to SEQ ID NO: 8339

SEQ ID NO: 11327 - protein, 337 aa, unidentified; identical to SEQ ID NO: 8339

SEQ ID NO: 11328 - protein, 295 aa, unidentified; identical to SEQ ID NO: 9624

SEQ ID NO: 11329 - protein, 279 aa, unidentified
YLGYHLREMAQKPGVLYADDTAGWDTRITMADLEDEGILLDMMSGEHKKLASALFSKAYKVKVALCPRPGPKGGTLMDVISRTDQRGSGQVVTYALNTLTNIKVQLIRMAEAEGVLGATFEDFGIDRWLQEHGEDRVERMLVSGDDCVVNAIDERFGSSLNWLNAMEKVRKDIDLWKPSPSFRNWERVEFCSNHFHEMTMKDGRVIVAPCRGQTELIARGTVNQGGCVGVESTGCLAKAYAQMWLLLYFHRRDLRTLALAVMSAVPSNWIPTGRTTWSL

SEQ ID NO: 11330 - protein, 337 aa, unidentified; identical to SEQ ID NO: 8339

SEQ ID NO: 11331 - protein, 337 aa, unidentified; identical to SEQ ID NO: 8339

SEQ ID NO: 11332 - protein, 298 aa, unidentified; identical to SEQ ID NO: 8537

SEQ ID NO: 11333 - protein, 337 aa, unidentified; identical to SEQ ID NO: 8339

SEQ ID NO: 11334 - protein, 337 aa, unidentified; identical to SEQ ID NO: 8339

SEQ ID NO: 11335 - protein, 337 aa, unidentified; identical to SEQ ID NO: 8339

SEQ ID NO: 11336 - protein, 337 aa, unidentified; identical to SEQ ID NO: 8339

SEQ ID NO: 11337 - protein, 309 aa, unidentified
LGFLNEERWASRDISGGGVEGIGINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCSHHFHELFLRDGRKLIVPCRDQHELVGRSMVSQGGSSGVAGTACLAKAYAQMWLMSYFHRRDLRTLGFGIMSSVPKDWFPTGRTTWSVHANHE

SEQ ID NO: 11338 - protein, 224 aa, unidentified; identical to SEQ ID NO: 10802

SEQ ID NO: 11339 - protein, 337 aa, unidentified; identical to SEQ ID NO: 8339

SEQ ID NO: 11340 - protein, 337 aa, unidentified; identical to SEQ ID NO: 8339

SEQ ID NO: 11341 - protein, 324 aa, unidentified; identical to SEQ ID NO: 9763

SEQ ID NO: 11342 - protein, 209 aa, unidentified; identical to SEQ ID NO: 9505

SEQ ID NO: 11343 - protein, 332 aa, unidentified; identical to SEQ ID NO: 9622

SEQ ID NO: 11344 - protein, 337 aa, unidentified; identical to SEQ ID NO: 8339

SEQ ID NO: 11345 - protein, 337 aa, unidentified; identical to SEQ ID NO: 8339

SEQ ID NO: 11346 - protein, 337 aa, unidentified; identical to SEQ ID NO: 8339

SEQ ID NO: 11347 - protein, 337 aa, unidentified; identical to SEQ ID NO: 8339

SEQ ID NO: 11348 - protein, 298 aa, unidentified; identical to SEQ ID NO: 8537

SEQ ID NO: 11349 - protein, 337 aa, unidentified; identical to SEQ ID NO: 8339

SEQ ID NO: 11350 - protein, 337 aa, unidentified; identical to SEQ ID NO: 8339

SEQ ID NO: 11351 - protein, 332 aa, unidentified; identical to SEQ ID NO: 9622

SEQ ID NO: 11352 - protein, 337 aa, unidentified; identical to SEQ ID NO: 8339

SEQ ID NO: 11353 - protein, 337 aa, unidentified; identical to SEQ ID NO: 8339

SEQ ID NO: 11354 - protein, 337 aa, unidentified; identical to SEQ ID NO: 8339

SEQ ID NO: 11355 - protein, 274 aa, unidentified; identical to SEQ ID NO: 10970

SEQ ID NO: 11356 - protein, 337 aa, unidentified; identical to SEQ ID NO: 8339

SEQ ID NO: 11357 - protein, 332 aa, unidentified; identical to SEQ ID NO: 9622

SEQ ID NO: 11358 - protein, 337 aa, unidentified; identical to SEQ ID NO: 8339

SEQ ID NO: 11359 - protein, 337 aa, unidentified; identical to SEQ ID NO: 8339

SEQ ID NO: 11360 - protein, 337 aa, unidentified; identical to SEQ ID NO: 8339

SEQ ID NO: 11361 - protein, 337 aa, unidentified; identical to SEQ ID NO: 8339

SEQ ID NO: 11362 - protein, 337 aa, unidentified; identical to SEQ ID NO: 8339

SEQ ID NO: 11363 - protein, 337 aa, unidentified; identical to SEQ ID NO: 8339

SEQ ID NO: 11364 - protein, 273 aa, unidentified; identical to SEQ ID NO: 11142

SEQ ID NO: 11365 - protein, 337 aa, unidentified; identical to SEQ ID NO: 8339

SEQ ID NO: 11366 - protein, 337 aa, unidentified; identical to SEQ ID NO: 8339

SEQ ID NO: 11367 - protein, 174 aa, unidentified; identical to SEQ ID NO: 8195

SEQ ID NO: 11368 - protein, 337 aa, unidentified; identical to SEQ ID NO: 8339

SEQ ID NO: 11369 - protein, 337 aa, unidentified; identical to SEQ ID NO: 8339

SEQ ID NO: 11370 - protein, 337 aa, unidentified; identical to SEQ ID NO: 8339

SEQ ID NO: 11371 - protein, 304 aa, unidentified
KPGEFGVAKGSRTIWYMWLGSRFLEFEALGFLNEERWASRDISGGGVEGIGINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCSHHFHELFLRDGRKLIVPCRDQHELVGRSMVSQGGSSGVAGTACLAKAYAQMWLMSYFHR

SEQ ID NO: 11372 - protein, 337 aa, unidentified; identical to SEQ ID NO: 8339

SEQ ID NO: 11373 - protein, 337 aa, unidentified; identical to SEQ ID NO: 8339

SEQ ID NO: 11374 - protein, 332 aa, unidentified; identical to SEQ ID NO: 9622

SEQ ID NO: 11375 - protein, 337 aa, unidentified; identical to SEQ ID NO: 8339

SEQ ID NO: 11376 - protein, 337 aa, unidentified; identical to SEQ ID NO: 8339

SEQ ID NO: 11377 - protein, 337 aa, unidentified; identical to SEQ ID NO: 8339

SEQ ID NO: 11378 - protein, 337 aa, unidentified; identical to SEQ ID NO: 8339

SEQ ID NO: 11379 - protein, 44 aa, unidentified
PVRPAAHEDTSLTNFWVPLHDGRFWNPMSHLHLLNVSSADETSP

SEQ ID NO: 11380 - protein, 337 aa, unidentified; identical to SEQ ID NO: 8339

SEQ ID NO: 11381 - protein, 327 aa, unidentified
SRTIWYMWLGSRFLEFEALGFLNEERWASRDISGGGVEGIGINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCSHHFHELFLRDGRKLIVPCRDQHELVGRSMVSQGGSSGVAGTACLAKAYAQMWLMSYFHRRDLRTLGFGIMSSVPKDWFPTGRTTWSVHANHE

SEQ ID NO: 11382 - protein, 332 aa, unidentified; identical to SEQ ID NO: 9622

SEQ ID NO: 11383 - protein, 337 aa, unidentified; identical to SEQ ID NO: 8339

SEQ ID NO: 11384 - protein, 337 aa, unidentified; identical to SEQ ID NO: 8339

SEQ ID NO: 11385 - protein, 298 aa, unidentified; identical to SEQ ID NO: 8537

SEQ ID NO: 11386 - protein, 332 aa, unidentified; identical to SEQ ID NO: 9622

SEQ ID NO: 11387 - protein, 337 aa, unidentified; identical to SEQ ID NO: 8339

SEQ ID NO: 11388 - protein, 337 aa, unidentified; identical to SEQ ID NO: 8339

SEQ ID NO: 11389 - protein, 337 aa, unidentified; identical to SEQ ID NO: 8339

SEQ ID NO: 11390 - protein, 337 aa, unidentified; identical to SEQ ID NO: 8339

SEQ ID NO: 11391 - protein, 337 aa, unidentified; identical to SEQ ID NO: 8339

SEQ ID NO: 11392 - protein, 337 aa, unidentified; identical to SEQ ID NO: 8339

SEQ ID NO: 11393 - protein, 337 aa, unidentified; identical to SEQ ID NO: 8339

SEQ ID NO: 11394 - protein, 337 aa, unidentified; identical to SEQ ID NO: 8339

SEQ ID NO: 11395 - protein, 337 aa, unidentified; identical to SEQ ID NO: 8339

SEQ ID NO: 11396 - protein, 337 aa, unidentified; identical to SEQ ID NO: 8339

SEQ ID NO: 11397 - protein, 337 aa, unidentified; identical to SEQ ID NO: 8339

SEQ ID NO: 11398 - protein, 337 aa, unidentified; identical to SEQ ID NO: 8339

SEQ ID NO: 11399 - protein, 337 aa, unidentified; identical to SEQ ID NO: 8339

SEQ ID NO: 11400 - protein, 337 aa, unidentified; identical to SEQ ID NO: 8339

SEQ ID NO: 11401 - protein, 337 aa, unidentified; identical to SEQ ID NO: 8339

SEQ ID NO: 11402 - protein, 298 aa, unidentified; identical to SEQ ID NO: 8537

SEQ ID NO: 11403 - protein, 298 aa, unidentified; identical to SEQ ID NO: 8537

SEQ ID NO: 11404 - protein, 337 aa, unidentified; identical to SEQ ID NO: 8339

SEQ ID NO: 11405 - protein, 337 aa, unidentified; identical to SEQ ID NO: 8339

SEQ ID NO: 11406 - protein, 337 aa, unidentified; identical to SEQ ID NO: 8339

SEQ ID NO: 11407 - protein, 337 aa, unidentified; identical to SEQ ID NO: 8339

SEQ ID NO: 11408 - protein, 229 aa, unidentified
IGINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCSHHFHELFLRDGRKLIVPCRDQHELVGRSMVSQG

SEQ ID NO: 11409 - protein, 337 aa, unidentified; identical to SEQ ID NO: 8339

SEQ ID NO: 11410 - protein, 337 aa, unidentified; identical to SEQ ID NO: 10217

SEQ ID NO: 11411 - protein, 298 aa, unidentified; identical to SEQ ID NO: 8537

SEQ ID NO: 11412 - protein, 337 aa, unidentified; identical to SEQ ID NO: 8339

SEQ ID NO: 11413 - protein, 332 aa, unidentified; identical to SEQ ID NO: 9622

SEQ ID NO: 11414 - protein, 337 aa, unidentified; identical to SEQ ID NO: 8339

SEQ ID NO: 11415 - protein, 337 aa, unidentified; identical to SEQ ID NO: 8339

SEQ ID NO: 11416 - protein, 337 aa, unidentified; identical to SEQ ID NO: 8339

SEQ ID NO: 11417 - protein, 270 aa, unidentified; identical to SEQ ID NO: 8331

SEQ ID NO: 11418 - protein, 337 aa, unidentified; identical to SEQ ID NO: 8339

SEQ ID NO: 11419 - protein, 295 aa, unidentified; identical to SEQ ID NO: 9624

SEQ ID NO: 11420 - protein, 337 aa, unidentified; identical to SEQ ID NO: 8339

SEQ ID NO: 11421 - protein, 337 aa, unidentified; identical to SEQ ID NO: 8339

SEQ ID NO: 11422 - protein, 337 aa, unidentified; identical to SEQ ID NO: 8339

SEQ ID NO: 11423 - protein, 337 aa, unidentified; identical to SEQ ID NO: 8339

SEQ ID NO: 11424 - protein, 298 aa, unidentified; identical to SEQ ID NO: 8537

SEQ ID NO: 11425 - protein, 337 aa, unidentified; identical to SEQ ID NO: 8339

SEQ ID NO: 11426 - protein, 335 aa, unidentified; identical to SEQ ID NO: 8722

SEQ ID NO: 11427 - protein, 337 aa, unidentified; identical to SEQ ID NO: 8339

SEQ ID NO: 11428 - protein, 337 aa, unidentified; identical to SEQ ID NO: 8339

SEQ ID NO: 11429 - protein, 337 aa, unidentified; identical to SEQ ID NO: 8339

SEQ ID NO: 11430 - protein, 337 aa, unidentified; identical to SEQ ID NO: 8339

SEQ ID NO: 11431 - protein, 337 aa, unidentified; identical to SEQ ID NO: 8339

SEQ ID NO: 11432 - protein, 337 aa, unidentified; identical to SEQ ID NO: 8339

SEQ ID NO: 11433 - protein, 332 aa, unidentified; identical to SEQ ID NO: 9622

SEQ ID NO: 11434 - protein, 337 aa, unidentified; identical to SEQ ID NO: 8339

SEQ ID NO: 11435 - protein, 337 aa, unidentified; identical to SEQ ID NO: 8339

SEQ ID NO: 11436 - protein, 303 aa, unidentified; identical to SEQ ID NO: 8684

SEQ ID NO: 11437 - protein, 258 aa, unidentified
KPGEFGVAKGSRTIWYMWLGSRFLEFEALGFLNEERWASRDISGGGVEGIGINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCSHHFHELFLRDGRK

SEQ ID NO: 11438 - protein, 337 aa, unidentified; identical to SEQ ID NO: 8339

SEQ ID NO: 11439 - protein, 337 aa, unidentified; identical to SEQ ID NO: 8339

SEQ ID NO: 11440 - protein, 333 aa, unidentified; identical to SEQ ID NO: 8351

SEQ ID NO: 11441 - protein, 310 aa, unidentified; identical to SEQ ID NO: 9321

SEQ ID NO: 11442 - protein, 198 aa, unidentified; identical to SEQ ID NO: 9296

SEQ ID NO: 11443 - protein, 333 aa, unidentified; identical to SEQ ID NO: 8351

SEQ ID NO: 11444 - protein, 337 aa, unidentified; identical to SEQ ID NO: 8339

SEQ ID NO: 11445 - protein, 337 aa, unidentified; identical to SEQ ID NO: 8339

SEQ ID NO: 11446 - protein, 159 aa, unidentified
LGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRAL

SEQ ID NO: 11447 - protein, 333 aa, unidentified; identical to SEQ ID NO: 8351

SEQ ID NO: 11448 - protein, 204 aa, unidentified; identical to SEQ ID NO: 10848

SEQ ID NO: 11449 - protein, 337 aa, unidentified; identical to SEQ ID NO: 8339

SEQ ID NO: 11450 - protein, 249 aa, unidentified; identical to SEQ ID NO: 10206

SEQ ID NO: 11451 - protein, 199 aa, unidentified; identical to SEQ ID NO: 8585

SEQ ID NO: 11452 - protein, 337 aa, unidentified; identical to SEQ ID NO: 8339

SEQ ID NO: 11453 - protein, 337 aa, unidentified; identical to SEQ ID NO: 8339

SEQ ID NO: 11454 - protein, 254 aa, unidentified; identical to SEQ ID NO: 10832

SEQ ID NO: 11455 - protein, 313 aa, unidentified; identical to SEQ ID NO: 8418

SEQ ID NO: 11456 - protein, 337 aa, unidentified; identical to SEQ ID NO: 8339

SEQ ID NO: 11457 - protein, 337 aa, unidentified; identical to SEQ ID NO: 8339

SEQ ID NO: 11458 - protein, 279 aa, unidentified; identical to SEQ ID NO: 9724

SEQ ID NO: 11459 - protein, 231 aa, unidentified; identical to SEQ ID NO: 9315

SEQ ID NO: 11460 - protein, 337 aa, unidentified; identical to SEQ ID NO: 8339

SEQ ID NO: 11461 - protein, 337 aa, unidentified; identical to SEQ ID NO: 8339

SEQ ID NO: 11462 - protein, 199 aa, unidentified; identical to SEQ ID NO: 8585

SEQ ID NO: 11463 - protein, 333 aa, unidentified; identical to SEQ ID NO: 8351

SEQ ID NO: 11464 - protein, 204 aa, unidentified; identical to SEQ ID NO: 10848

SEQ ID NO: 11465 - protein, 204 aa, unidentified; identical to SEQ ID NO: 10848

SEQ ID NO: 11466 - protein, 316 aa, unidentified; identical to SEQ ID NO: 8732

SEQ ID NO: 11467 - protein, 204 aa, unidentified; identical to SEQ ID NO: 10848

SEQ ID NO: 11468 - protein, 147 aa, unidentified
GYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVV

SEQ ID NO: 11469 - protein, 193 aa, unidentified
MWLGSRFLEFEALGFLNEERWASRDISGGGVEGIGINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERF

SEQ ID NO: 11470 - protein, 194 aa, unidentified; identical to SEQ ID NO: 10849

SEQ ID NO: 11471 - protein, 261 aa, unidentified
KPGEFGVAKGSRTIWYMWLGSRFLEFEALGFLNEERWASRDISGGGVEGIGINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCSHHFHELFLRDGRKLIV

SEQ ID NO: 11472 - protein, 337 aa, unidentified; identical to SEQ ID NO: 8339

SEQ ID NO: 11473 - protein, 231 aa, unidentified; identical to SEQ ID NO: 9733

SEQ ID NO: 11474 - protein, 231 aa, unidentified; identical to SEQ ID NO: 9315

SEQ ID NO: 11475 - protein, 231 aa, unidentified; identical to SEQ ID NO: 9315

SEQ ID NO: 11476 - protein, 147 aa, unidentified
MAKKPGKLYADDTAGWDTRITEADLDDECILCDYMEDEHKQLALSLFELCYKNKVALCPRPGRHGGTVMDVIFRRDQRGSGQVVTYALNTLTNIKVQLIRLAESEGVLDEDFNDHGIETWLNHYGEERLSRLLISGDDCLVNAFDER

SEQ ID NO: 11477 - protein, 75 aa, unidentified
GNVSACSYSLVRGVLSTKFITLDGSVVANCQAVTCRCIDPPKIISQFAGKPLTIINSKICNVINIEQVTLRLSGH

SEQ ID NO: 11478 - protein, 206 aa, unidentified; identical to SEQ ID NO: 10023

SEQ ID NO: 11479 - protein, 231 aa, unidentified; identical to SEQ ID NO: 9733

SEQ ID NO: 11480 - protein, 242 aa, unidentified; identical to SEQ ID NO: 9313

SEQ ID NO: 11481 - protein, 333 aa, unidentified; identical to SEQ ID NO: 8351

SEQ ID NO: 11482 - protein, 214 aa, unidentified
KPGEFGVAKGSRTIWYMWLGSRFLEFEALGFLNEERWASRDISGGGVEGIGINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALT

SEQ ID NO: 11483 - protein, 337 aa, unidentified; identical to SEQ ID NO: 8339

SEQ ID NO: 11484 - protein, 231 aa, unidentified; identical to SEQ ID NO: 9733

SEQ ID NO: 11485 - protein, 187 aa, unidentified; identical to SEQ ID NO: 10447

SEQ ID NO: 11486 - protein, 319 aa, unidentified; identical to SEQ ID NO: 8858

SEQ ID NO: 11487 - protein, 260 aa, unidentified
LREMAQKPGVLYADDTAGWDTRITMADLEDEGILLDMMSGEHKKLASALFSKAYKVKVALCPRPGPKGGTLMDVISRTDQRGSGQVVTYALNTLTNIKVQLIRMAEAEGVLGATFEDFGIDRWLQEHGEDRVERMLVSGDDCVVNAIDERFGSSLNWLNAMEKVRKDIDLWKPSPSFRNWERVEFCSNHFHEMTMKDGRVIVAPCRGQTELIARGTVNQGGCVGVESTGCLAKAYAQMWLLLYFHRRDLRTLALAVMSAV

SEQ ID NO: 11488 - protein, 144 aa, unidentified
LREMAQKPGVLYADDTAGWDTRITMADLEDEGILLDMMSGEHKKLASALFSKAYKVKVALCPRPGPKGGTLMDVISRTDQRGSGQVVTYALNTLTNIKVQLIRMAEAEGVLGATFEDFGIDRWLQEHGEDRVERMLVSGDDCVV

SEQ ID NO: 11489 - protein, 199 aa, unidentified; identical to SEQ ID NO: 8585

SEQ ID NO: 11490 - protein, 337 aa, unidentified; identical to SEQ ID NO: 8339

SEQ ID NO: 11491 - protein, 231 aa, unidentified; identical to SEQ ID NO: 9733

SEQ ID NO: 11492 - protein, 187 aa, unidentified; identical to SEQ ID NO: 10447

SEQ ID NO: 11493 - protein, 231 aa, unidentified; identical to SEQ ID NO: 9733

SEQ ID NO: 11494 - protein, 319 aa, unidentified; identical to SEQ ID NO: 8858

SEQ ID NO: 11495 - protein, 319 aa, unidentified
KGSRTIWYMWLGSRFLEFESFGFLNEEHWASRELCGGGVEGIPLFYLGYHLEKMAEKAGILYADDTAGWDTRITMADLEDEYTLTELMEGEHKKLAETLFNFAYKNKVALCPRPGKNGGTVLDVISRTDQRGSGQVVTYALNTLTNIKVQLIRMAESEGVLDEEFHDNGMLKWLEKHGRDRLQRLMVSGDDCVVNAIDERFGKSLVWLNEMQKIRKDIDLWKPSAGHCNWEEVEFCSNHFHKLVMRDGRTLVVPCRHEVELVGRASVNQGGSTGISGTACLAKAYAQMWLLLYFHRRDLRILGMAICSAVPANWVPTGR

SEQ ID NO: 11496 - protein, 332 aa, unidentified; identical to SEQ ID NO: 9622

SEQ ID NO: 11497 - protein, 231 aa, unidentified; identical to SEQ ID NO: 9315

SEQ ID NO: 11498 - protein, 226 aa, unidentified; identical to SEQ ID NO: 10364

SEQ ID NO: 11499 - protein, 332 aa, unidentified; identical to SEQ ID NO: 9622

SEQ ID NO: 11500 - protein, 337 aa, unidentified; identical to SEQ ID NO: 8339

SEQ ID NO: 11501 - protein, 231 aa, unidentified; identical to SEQ ID NO: 9733

SEQ ID NO: 11502 - protein, 318 aa, unidentified
KGSRTIWYMWLGSRFLEFEALGFLNEERWASRDISGGGVEGIGINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCSHHFHELFLRDGRKLIVPCRDQHELVGRSMVSQGGSSGVAGTACLAKAYAQMWLMSYFHRRDLRTLGFGIMSSVPKDWFPTG

SEQ ID NO: 11503 - protein, 337 aa, unidentified; identical to SEQ ID NO: 8339

SEQ ID NO: 11504 - protein, 231 aa, unidentified; identical to SEQ ID NO: 9733

SEQ ID NO: 11505 - protein, 333 aa, unidentified; identical to SEQ ID NO: 8351

SEQ ID NO: 11506 - protein, 319 aa, unidentified; identical to SEQ ID NO: 8858

SEQ ID NO: 11507 - protein, 326 aa, unidentified
KGSRTIWYMWLGSRFLEFESFGFLNEEHWASRELSGGGVESIPLFYLGYHLREMAKKPGKLYADDTAGWDTRITEADLDDECILCDYMEDEHKQLALSLFELCYKNKVALCPRPGRHGGTVMDVIFRRDQRGSGQVVTYALNTLTNIKVQLIRLAESEGVLDEDFNDHGIETWLNHYGEERLSRLLISGDDCLVNAFDERFGKALTWLNTMEKIRKDIDLCAPSNGYENFEKVEFCSNHFHELMLKDGRQLVVPCRSQNELVGRASVNQGGSATVAGTACLAKAYAQMWNLLYFHRRDLRLLGFAIMSATPSNWIPTGRTTWSIHA

SEQ ID NO: 11508 - protein, 118 aa, unidentified
GVEGIPLNYLGYHLREMAQKPGVLYADDTAGWDTRITMADLEDEGILLDMMSGEHKKLASALFSKAYKVKVALCPRPGPKGGTLMDVISRTDQRGSGQVVTYALNTLTNIKVQLIRMA

SEQ ID NO: 11509 - protein, 337 aa, unidentified; identical to SEQ ID NO: 8339

SEQ ID NO: 11510 - protein, 231 aa, unidentified; identical to SEQ ID NO: 9733

SEQ ID NO: 11511 - protein, 213 aa, unidentified
PHHRALIAVTMRLAYQNIAAVFPRTQSKYGSGFVMDFLGRRDQRGSGQVVTFALNTITNGKVQVARVLESEGLLHADESVLDAWLEKHLEEALGNMVIAGEEVVVSTTNRDFSSALEYLELTGKTRKNVPQGAPSRMESDWEKVEFCFHHYHEMCLKDGRILIAPCRHENEVLGRSRLQKGGVVSIPESACMAKAYAQMWALYFFHRRDLRLG

SEQ ID NO: 11512 - protein, 333 aa, unidentified; identical to SEQ ID NO: 8351

SEQ ID NO: 11513 - protein, 337 aa, unidentified; identical to SEQ ID NO: 8339

SEQ ID NO: 11514 - protein, 337 aa, unidentified; identical to SEQ ID NO: 8339

SEQ ID NO: 11515 - protein, 337 aa, unidentified; identical to SEQ ID NO: 8339

SEQ ID NO: 11516 - protein, 333 aa, unidentified; identical to SEQ ID NO: 8351

SEQ ID NO: 11517 - protein, 337 aa, unidentified; identical to SEQ ID NO: 8339

SEQ ID NO: 11518 - protein, 59 aa, unidentified; identical to SEQ ID NO: 8183

SEQ ID NO: 11519 - protein, 333 aa, unidentified; identical to SEQ ID NO: 8351

SEQ ID NO: 11520 - protein, 337 aa, unidentified; identical to SEQ ID NO: 8339

SEQ ID NO: 11521 - protein, 337 aa, unidentified; identical to SEQ ID NO: 8339

SEQ ID NO: 11522 - protein, 333 aa, unidentified; identical to SEQ ID NO: 8351

SEQ ID NO: 11523 - protein, 333 aa, unidentified; identical to SEQ ID NO: 8351

SEQ ID NO: 11524 - protein, 275 aa, unidentified
KPGEFGVAKGSRTIWYMWLGSRFLEFEALGFLNEERWASRDISGGGVEGIGINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCSHHFHELFLRDGRKLIVPCRDQHELVGRSMV

SEQ ID NO: 11525 - protein, 110 aa, unidentified
VTRGYSIANIQTSSCSVGDDFVLCDRDMTYPMSQVTQDCLRGNIALCSRMVVRDREAPRYLILQGNMVANCMSITCRCEEPESEIYQSPDQPLTLLTRDTCDTHVVDGIR

SEQ ID NO: 11526 - protein, 333 aa, unidentified; identical to SEQ ID NO: 8351

SEQ ID NO: 11527 - protein, 337 aa, unidentified; identical to SEQ ID NO: 8339

SEQ ID NO: 11528 - protein, 319 aa, unidentified; identical to SEQ ID NO: 8858

SEQ ID NO: 11529 - protein, 319 aa, unidentified; identical to SEQ ID NO: 8213

SEQ ID NO: 11530 - protein, 84 aa, unidentified; identical to SEQ ID NO: 8174

SEQ ID NO: 11531 - protein, 319 aa, unidentified; identical to SEQ ID NO: 8858

SEQ ID NO: 11532 - protein, 337 aa, unidentified; identical to SEQ ID NO: 10217

SEQ ID NO: 11533 - protein, 96 aa, unidentified; identical to SEQ ID NO: 8176

SEQ ID NO: 11534 - protein, 337 aa, unidentified; identical to SEQ ID NO: 8339

SEQ ID NO: 11535 - protein, 42 aa, unidentified; identical to SEQ ID NO: 8181

SEQ ID NO: 11536 - protein, 332 aa, unidentified; identical to SEQ ID NO: 9622

SEQ ID NO: 11537 - protein, 213 aa, unidentified; identical to SEQ ID NO: 8188

SEQ ID NO: 11538 - protein, 84 aa, unidentified; identical to SEQ ID NO: 8174

SEQ ID NO: 11539 - protein, 337 aa, unidentified; identical to SEQ ID NO: 8339

SEQ ID NO: 11540 - protein, 337 aa, unidentified; identical to SEQ ID NO: 8339

SEQ ID NO: 11541 - protein, 57 aa, unidentified; identical to SEQ ID NO: 8179

SEQ ID NO: 11542 - protein, 337 aa, unidentified; identical to SEQ ID NO: 8339

SEQ ID NO: 11543 - protein, 337 aa, unidentified; identical to SEQ ID NO: 8339

SEQ ID NO: 11544 - protein, 337 aa, unidentified; identical to SEQ ID NO: 8339

SEQ ID NO: 11545 - protein, 337 aa, unidentified; identical to SEQ ID NO: 8339

SEQ ID NO: 11546 - protein, 337 aa, unidentified; identical to SEQ ID NO: 8339

SEQ ID NO: 11547 - protein, 337 aa, unidentified; identical to SEQ ID NO: 8339

SEQ ID NO: 11548 - protein, 42 aa, unidentified; identical to SEQ ID NO: 8181

SEQ ID NO: 11549 - protein, 42 aa, unidentified; identical to SEQ ID NO: 8181

SEQ ID NO: 11550 - protein, 76 aa, unidentified; identical to SEQ ID NO: 8186

SEQ ID NO: 11551 - protein, 57 aa, unidentified; identical to SEQ ID NO: 8179

SEQ ID NO: 11552 - protein, 57 aa, unidentified; identical to SEQ ID NO: 8179

SEQ ID NO: 11553 - protein, 332 aa, unidentified; identical to SEQ ID NO: 9622

SEQ ID NO: 11554 - protein, 337 aa, unidentified; identical to SEQ ID NO: 10217

SEQ ID NO: 11555 - protein, 335 aa, unidentified; identical to SEQ ID NO: 8722

SEQ ID NO: 11556 - protein, 247 aa, unidentified; identical to SEQ ID NO: 10338

SEQ ID NO: 11557 - protein, 337 aa, unidentified; identical to SEQ ID NO: 8339

SEQ ID NO: 11558 - protein, 337 aa, unidentified; identical to SEQ ID NO: 8339

SEQ ID NO: 11559 - protein, 337 aa, unidentified; identical to SEQ ID NO: 8339

SEQ ID NO: 11560 - protein, 337 aa, unidentified; identical to SEQ ID NO: 8339

SEQ ID NO: 11561 - protein, 298 aa, unidentified; identical to SEQ ID NO: 8537

SEQ ID NO: 11562 - protein, 337 aa, unidentified; identical to SEQ ID NO: 8339

SEQ ID NO: 11563 - protein, 337 aa, unidentified; identical to SEQ ID NO: 8339

SEQ ID NO: 11564 - protein, 335 aa, unidentified; identical to SEQ ID NO: 8722

SEQ ID NO: 11565 - protein, 337 aa, unidentified; identical to SEQ ID NO: 8339

SEQ ID NO: 11566 - protein, 298 aa, unidentified; identical to SEQ ID NO: 8537

SEQ ID NO: 11567 - protein, 258 aa, unidentified; identical to SEQ ID NO: 8309

SEQ ID NO: 11568 - protein, 337 aa, unidentified; identical to SEQ ID NO: 8339

SEQ ID NO: 11569 - protein, 337 aa, unidentified; identical to SEQ ID NO: 8339

SEQ ID NO: 11570 - protein, 337 aa, unidentified; identical to SEQ ID NO: 8339

SEQ ID NO: 11571 - protein, 337 aa, unidentified; identical to SEQ ID NO: 8339

SEQ ID NO: 11572 - protein, 337 aa, unidentified; identical to SEQ ID NO: 8339

SEQ ID NO: 11573 - protein, 337 aa, unidentified; identical to SEQ ID NO: 8339

SEQ ID NO: 11574 - protein, 333 aa, unidentified; identical to SEQ ID NO: 8351

SEQ ID NO: 11575 - protein, 240 aa, unidentified
KPGEFGVAKGSRTIWYMWLGSRFLEFEALGFLNEERWASRDISGGGVEGIGINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQE

SEQ ID NO: 11576 - protein, 337 aa, unidentified; identical to SEQ ID NO: 8339

SEQ ID NO: 11577 - protein, 298 aa, unidentified; identical to SEQ ID NO: 8537

SEQ ID NO: 11578 - protein, 337 aa, unidentified; identical to SEQ ID NO: 8339

SEQ ID NO: 11579 - protein, 337 aa, unidentified; identical to SEQ ID NO: 8339

SEQ ID NO: 11580 - protein, 337 aa, unidentified; identical to SEQ ID NO: 8339

SEQ ID NO: 11581 - protein, 337 aa, unidentified; identical to SEQ ID NO: 8339

SEQ ID NO: 11582 - protein, 337 aa, unidentified; identical to SEQ ID NO: 8339

SEQ ID NO: 11583 - protein, 337 aa, unidentified; identical to SEQ ID NO: 8339

SEQ ID NO: 11584 - protein, 337 aa, unidentified; identical to SEQ ID NO: 8339

SEQ ID NO: 11585 - protein, 337 aa, unidentified; identical to SEQ ID NO: 8339

SEQ ID NO: 11586 - protein, 337 aa, unidentified; identical to SEQ ID NO: 8339

SEQ ID NO: 11587 - protein, 336 aa, unidentified
KPGEFGVAKGSRTIWYMWLGSRFLEFEALGFLNEERWASRDISGGGVEGIGINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCSHHFHELFLRDGRKLIVPCRDQHELVGRSMVSQGGSSGVAGTACLAKAYAQMWLMSYFHRRDLRTLGFGIMSSVPKDWFPTGRTTWSVHANH

SEQ ID NO: 11588 - protein, 337 aa, unidentified; identical to SEQ ID NO: 8339

SEQ ID NO: 11589 - protein, 337 aa, unidentified; identical to SEQ ID NO: 8339

SEQ ID NO: 11590 - protein, 337 aa, unidentified; identical to SEQ ID NO: 8339

SEQ ID NO: 11591 - protein, 337 aa, unidentified; identical to SEQ ID NO: 8339

SEQ ID NO: 11592 - protein, 337 aa, unidentified; identical to SEQ ID NO: 8339

SEQ ID NO: 11593 - protein, 337 aa, unidentified; identical to SEQ ID NO: 8339

SEQ ID NO: 11594 - protein, 337 aa, unidentified; identical to SEQ ID NO: 8339

SEQ ID NO: 11595 - protein, 337 aa, unidentified; identical to SEQ ID NO: 8339

SEQ ID NO: 11596 - protein, 337 aa, unidentified; identical to SEQ ID NO: 8339

SEQ ID NO: 11597 - protein, 332 aa, unidentified; identical to SEQ ID NO: 9622

SEQ ID NO: 11598 - protein, 335 aa, unidentified; identical to SEQ ID NO: 8722

SEQ ID NO: 11599 - protein, 335 aa, unidentified; identical to SEQ ID NO: 8722

SEQ ID NO: 11600 - protein, 337 aa, unidentified; identical to SEQ ID NO: 8339

SEQ ID NO: 11601 - protein, 337 aa, unidentified; identical to SEQ ID NO: 8339

SEQ ID NO: 11602 - protein, 322 aa, unidentified
GVAKGSRTIWYMWLGSRFLEFESFGFLNEEHWASRELCGGGVEGIPLFYLGYHLEKMAEKAGILYADDTAGWDTRITMADLEDEYTLTELMEGEHKKLAETLFNFAYKNKVALCPRPGKNGGTVLDVISRTDQRGSGQVVTYALNTLTNIKVQLIRMAESEGVLDEEFHDNGMLKWLEKHGRDRLQRLMVSGDDCVVNAIDERFGKSLVWLNEMQKIRKDIDLWKPSAGHCNWEEVEFCSNHFHKLVMRDGRTLVVPCRHEVELVGRASVNQGGSTGISGTACLAKAYAQMWLLLYFHRRDLRILGMAICSAVPANWVPTGR

SEQ ID NO: 11603 - protein, 337 aa, unidentified; identical to SEQ ID NO: 8339

SEQ ID NO: 11604 - protein, 42 aa, unidentified
STEELFKEYKLTRPYMAKCVRCAVGSCHSPIAIEAVRSDGHD

SEQ ID NO: 11605 - protein, 337 aa, unidentified; identical to SEQ ID NO: 8339

SEQ ID NO: 11606 - protein, 337 aa, unidentified; identical to SEQ ID NO: 8339

SEQ ID NO: 11607 - protein, 333 aa, unidentified; identical to SEQ ID NO: 8351

SEQ ID NO: 11608 - protein, 337 aa, unidentified; identical to SEQ ID NO: 8339

SEQ ID NO: 11609 - protein, 337 aa, unidentified; identical to SEQ ID NO: 8339

SEQ ID NO: 11610 - protein, 337 aa, unidentified; identical to SEQ ID NO: 8339

SEQ ID NO: 11611 - protein, 337 aa, unidentified; identical to SEQ ID NO: 8339

SEQ ID NO: 11612 - protein, 337 aa, unidentified; identical to SEQ ID NO: 10217

SEQ ID NO: 11613 - protein, 337 aa, unidentified; identical to SEQ ID NO: 8339

SEQ ID NO: 11614 - protein, 337 aa, unidentified; identical to SEQ ID NO: 8339

SEQ ID NO: 11615 - protein, 337 aa, unidentified; identical to SEQ ID NO: 8339

SEQ ID NO: 11616 - protein, 332 aa, unidentified; identical to SEQ ID NO: 9622

SEQ ID NO: 11617 - protein, 337 aa, unidentified; identical to SEQ ID NO: 8339

SEQ ID NO: 11618 - protein, 337 aa, unidentified; identical to SEQ ID NO: 8339

SEQ ID NO: 11619 - protein, 337 aa, unidentified; identical to SEQ ID NO: 8339

SEQ ID NO: 11620 - protein, 337 aa, unidentified; identical to SEQ ID NO: 8339

SEQ ID NO: 11621 - protein, 337 aa, unidentified; identical to SEQ ID NO: 8339

SEQ ID NO: 11622 - protein, 337 aa, unidentified; identical to SEQ ID NO: 8339

SEQ ID NO: 11623 - protein, 337 aa, unidentified; identical to SEQ ID NO: 8339

SEQ ID NO: 11624 - protein, 206 aa, unidentified
RDISGGGVEGIGINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCS

SEQ ID NO: 11625 - protein, 337 aa, unidentified; identical to SEQ ID NO: 8339

SEQ ID NO: 11626 - protein, 337 aa, unidentified; identical to SEQ ID NO: 8339

SEQ ID NO: 11627 - protein, 337 aa, unidentified; identical to SEQ ID NO: 8339

SEQ ID NO: 11628 - protein, 337 aa, unidentified; identical to SEQ ID NO: 8339

SEQ ID NO: 11629 - protein, 337 aa, unidentified; identical to SEQ ID NO: 8339

SEQ ID NO: 11630 - protein, 332 aa, unidentified; identical to SEQ ID NO: 9622

SEQ ID NO: 11631 - protein, 337 aa, unidentified; identical to SEQ ID NO: 8339

SEQ ID NO: 11632 - protein, 337 aa, unidentified; identical to SEQ ID NO: 8339

SEQ ID NO: 11633 - protein, 337 aa, unidentified; identical to SEQ ID NO: 8339

SEQ ID NO: 11634 - protein, 337 aa, unidentified; identical to SEQ ID NO: 8339

SEQ ID NO: 11635 - protein, 298 aa, unidentified; identical to SEQ ID NO: 8537

SEQ ID NO: 11636 - protein, 337 aa, unidentified; identical to SEQ ID NO: 8339

SEQ ID NO: 11637 - protein, 337 aa, unidentified; identical to SEQ ID NO: 10217

SEQ ID NO: 11638 - protein, 337 aa, unidentified; identical to SEQ ID NO: 8339

SEQ ID NO: 11639 - protein, 313 aa, unidentified
EFEALGFLNEERWASRDISGGGVEGIGINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCSHHFHELFLRDGRKLIVPCRDQHELVGRSMVSQGGSSGVAGTACLAKAYAQMWLMSYFHRRDLRTLGFGIMSSVPKDWFPTGRTTWSVHANHE

SEQ ID NO: 11640 - protein, 337 aa, unidentified; identical to SEQ ID NO: 8339

SEQ ID NO: 11641 - protein, 337 aa, unidentified; identical to SEQ ID NO: 8339

SEQ ID NO: 11642 - protein, 332 aa, unidentified; identical to SEQ ID NO: 9622

SEQ ID NO: 11643 - protein, 337 aa, unidentified; identical to SEQ ID NO: 8339

SEQ ID NO: 11644 - protein, 292 aa, unidentified; identical to SEQ ID NO: 9890

SEQ ID NO: 11645 - protein, 337 aa, unidentified; identical to SEQ ID NO: 8339

SEQ ID NO: 11646 - protein, 337 aa, unidentified; identical to SEQ ID NO: 8339

SEQ ID NO: 11647 - protein, 337 aa, unidentified; identical to SEQ ID NO: 8339

SEQ ID NO: 11648 - protein, 337 aa, unidentified; identical to SEQ ID NO: 8339

SEQ ID NO: 11649 - protein, 332 aa, unidentified; identical to SEQ ID NO: 9622

SEQ ID NO: 11650 - protein, 337 aa, unidentified; identical to SEQ ID NO: 8339

SEQ ID NO: 11651 - protein, 337 aa, unidentified; identical to SEQ ID NO: 8339

SEQ ID NO: 11652 - protein, 337 aa, unidentified; identical to SEQ ID NO: 8339

SEQ ID NO: 11653 - protein, 337 aa, unidentified; identical to SEQ ID NO: 8339

SEQ ID NO: 11654 - protein, 337 aa, unidentified; identical to SEQ ID NO: 8339

SEQ ID NO: 11655 - protein, 298 aa, unidentified; identical to SEQ ID NO: 8537

SEQ ID NO: 11656 - protein, 298 aa, unidentified; identical to SEQ ID NO: 8537

SEQ ID NO: 11657 - protein, 337 aa, unidentified; identical to SEQ ID NO: 8339

SEQ ID NO: 11658 - protein, 337 aa, unidentified; identical to SEQ ID NO: 8339

SEQ ID NO: 11659 - protein, 298 aa, unidentified; identical to SEQ ID NO: 8537

SEQ ID NO: 11660 - protein, 89 aa, unidentified
DKIQRGDPLTPIDLSYLSPQRPGPGLGFLLINGTMHMSHLTYKALELANDSVWVLDRADRDNPSQVMWSRWERMAGVMVGPNGIVKQGS

SEQ ID NO: 11661 - protein, 332 aa, unidentified; identical to SEQ ID NO: 9622

SEQ ID NO: 11662 - protein, 337 aa, unidentified; identical to SEQ ID NO: 8339

SEQ ID NO: 11663 - protein, 337 aa, unidentified; identical to SEQ ID NO: 8339

SEQ ID NO: 11664 - protein, 324 aa, unidentified; identical to SEQ ID NO: 9759

SEQ ID NO: 11665 - protein, 332 aa, unidentified; identical to SEQ ID NO: 9622

SEQ ID NO: 11666 - protein, 337 aa, unidentified; identical to SEQ ID NO: 8339

SEQ ID NO: 11667 - protein, 337 aa, unidentified; identical to SEQ ID NO: 8339

SEQ ID NO: 11668 - protein, 337 aa, unidentified; identical to SEQ ID NO: 8339

SEQ ID NO: 11669 - protein, 337 aa, unidentified; identical to SEQ ID NO: 8339

SEQ ID NO: 11670 - protein, 337 aa, unidentified; identical to SEQ ID NO: 8339

SEQ ID NO: 11671 - protein, 337 aa, unidentified; identical to SEQ ID NO: 8339

SEQ ID NO: 11672 - protein, 337 aa, unidentified; identical to SEQ ID NO: 8339

SEQ ID NO: 11673 - protein, 337 aa, unidentified; identical to SEQ ID NO: 8339

SEQ ID NO: 11674 - protein, 337 aa, unidentified; identical to SEQ ID NO: 8339

SEQ ID NO: 11675 - protein, 337 aa, unidentified; identical to SEQ ID NO: 8339

SEQ ID NO: 11676 - protein, 337 aa, unidentified; identical to SEQ ID NO: 8339

SEQ ID NO: 11677 - protein, 332 aa, unidentified; identical to SEQ ID NO: 9622

SEQ ID NO: 11678 - protein, 337 aa, unidentified; identical to SEQ ID NO: 8339

SEQ ID NO: 11679 - protein, 337 aa, unidentified; identical to SEQ ID NO: 8339

SEQ ID NO: 11680 - protein, 298 aa, unidentified; identical to SEQ ID NO: 8537

SEQ ID NO: 11681 - protein, 337 aa, unidentified; identical to SEQ ID NO: 8339

SEQ ID NO: 11682 - protein, 337 aa, unidentified; identical to SEQ ID NO: 8339

SEQ ID NO: 11683 - protein, 337 aa, unidentified; identical to SEQ ID NO: 8339

SEQ ID NO: 11684 - protein, 337 aa, unidentified; identical to SEQ ID NO: 8339

SEQ ID NO: 11685 - protein, 337 aa, unidentified; identical to SEQ ID NO: 8339

SEQ ID NO: 11686 - protein, 337 aa, unidentified; identical to SEQ ID NO: 8339

SEQ ID NO: 11687 - protein, 337 aa, unidentified; identical to SEQ ID NO: 8339

SEQ ID NO: 11688 - protein, 337 aa, unidentified; identical to SEQ ID NO: 8339

SEQ ID NO: 11689 - protein, 337 aa, unidentified; identical to SEQ ID NO: 8339

SEQ ID NO: 11690 - protein, 337 aa, unidentified; identical to SEQ ID NO: 8339

SEQ ID NO: 11691 - protein, 333 aa, unidentified; identical to SEQ ID NO: 8351

SEQ ID NO: 11692 - protein, 337 aa, unidentified; identical to SEQ ID NO: 8339

SEQ ID NO: 11693 - protein, 337 aa, unidentified; identical to SEQ ID NO: 8339

SEQ ID NO: 11694 - protein, 337 aa, unidentified; identical to SEQ ID NO: 8339

SEQ ID NO: 11695 - protein, 298 aa, unidentified; identical to SEQ ID NO: 8537

SEQ ID NO: 11696 - protein, 239 aa, unidentified
DTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCSHHFHELFLRDGRKLIVPCRDQHELVGRSMVSQGGSSGVAGTACLAKAYAQMWLMSYFHRRDLRTLG

SEQ ID NO: 11697 - protein, 332 aa, unidentified; identical to SEQ ID NO: 9622

SEQ ID NO: 11698 - protein, 337 aa, unidentified; identical to SEQ ID NO: 8339

SEQ ID NO: 11699 - protein, 332 aa, unidentified; identical to SEQ ID NO: 9622

SEQ ID NO: 11700 - protein, 337 aa, unidentified; identical to SEQ ID NO: 8339

SEQ ID NO: 11701 - protein, 298 aa, unidentified; identical to SEQ ID NO: 8537

SEQ ID NO: 11702 - protein, 337 aa, unidentified; identical to SEQ ID NO: 8339

SEQ ID NO: 11703 - protein, 337 aa, unidentified; identical to SEQ ID NO: 8339

SEQ ID NO: 11704 - protein, 337 aa, unidentified; identical to SEQ ID NO: 8339

SEQ ID NO: 11705 - protein, 337 aa, unidentified; identical to SEQ ID NO: 8339

SEQ ID NO: 11706 - protein, 337 aa, unidentified; identical to SEQ ID NO: 8339

SEQ ID NO: 11707 - protein, 337 aa, unidentified; identical to SEQ ID NO: 8339

SEQ ID NO: 11708 - protein, 337 aa, unidentified; identical to SEQ ID NO: 8339

SEQ ID NO: 11709 - protein, 332 aa, unidentified; identical to SEQ ID NO: 9622

SEQ ID NO: 11710 - protein, 337 aa, unidentified; identical to SEQ ID NO: 8339

SEQ ID NO: 11711 - protein, 295 aa, unidentified; identical to SEQ ID NO: 9624

SEQ ID NO: 11712 - protein, 337 aa, unidentified; identical to SEQ ID NO: 8339

SEQ ID NO: 11713 - protein, 337 aa, unidentified; identical to SEQ ID NO: 8339

SEQ ID NO: 11714 - protein, 298 aa, unidentified; identical to SEQ ID NO: 8537

SEQ ID NO: 11715 - protein, 294 aa, unidentified
GGGVEGIGINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCSHHFHELFLRDGRKLIVPCRDQHELVGRSMVSQGGSSGVAGTACLAKAYAQMWLMSYFHRRDLRTLGFGIMSSVPKDWFPTGRTTWSVHANHE

SEQ ID NO: 11716 - protein, 337 aa, unidentified; identical to SEQ ID NO: 8339

SEQ ID NO: 11717 - protein, 337 aa, unidentified; identical to SEQ ID NO: 8339

SEQ ID NO: 11718 - protein, 298 aa, unidentified; identical to SEQ ID NO: 8537

SEQ ID NO: 11719 - protein, 337 aa, unidentified; identical to SEQ ID NO: 8339

SEQ ID NO: 11720 - protein, 337 aa, unidentified; identical to SEQ ID NO: 8339

SEQ ID NO: 11721 - protein, 337 aa, unidentified; identical to SEQ ID NO: 8339

SEQ ID NO: 11722 - protein, 337 aa, unidentified; identical to SEQ ID NO: 8339

SEQ ID NO: 11723 - protein, 337 aa, unidentified; identical to SEQ ID NO: 8339

SEQ ID NO: 11724 - protein, 337 aa, unidentified; identical to SEQ ID NO: 8339

SEQ ID NO: 11725 - protein, 337 aa, unidentified; identical to SEQ ID NO: 8339

SEQ ID NO: 11726 - protein, 337 aa, unidentified; identical to SEQ ID NO: 8339

SEQ ID NO: 11727 - protein, 337 aa, unidentified; identical to SEQ ID NO: 8339

SEQ ID NO: 11728 - protein, 337 aa, unidentified; identical to SEQ ID NO: 8339

SEQ ID NO: 11729 - protein, 269 aa, unidentified
KPGEFGVAKGSRTIWYMWLGSRFLEFEALGFLNEERWASRDISGGGVEGIGINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCSHHFHELFLRDGRKLIVPCRDQHEL

SEQ ID NO: 11730 - protein, 298 aa, unidentified; identical to SEQ ID NO: 8537

SEQ ID NO: 11731 - protein, 337 aa, unidentified; identical to SEQ ID NO: 8339

SEQ ID NO: 11732 - protein, 337 aa, unidentified; identical to SEQ ID NO: 8339

SEQ ID NO: 11733 - protein, 337 aa, unidentified; identical to SEQ ID NO: 8339

SEQ ID NO: 11734 - protein, 332 aa, unidentified; identical to SEQ ID NO: 9622

SEQ ID NO: 11735 - protein, 337 aa, unidentified; identical to SEQ ID NO: 8339

SEQ ID NO: 11736 - protein, 337 aa, unidentified; identical to SEQ ID NO: 8339

SEQ ID NO: 11737 - protein, 337 aa, unidentified; identical to SEQ ID NO: 8339

SEQ ID NO: 11738 - protein, 337 aa, unidentified; identical to SEQ ID NO: 8339

SEQ ID NO: 11739 - protein, 337 aa, unidentified; identical to SEQ ID NO: 8339

SEQ ID NO: 11740 - protein, 337 aa, unidentified; identical to SEQ ID NO: 8339

SEQ ID NO: 11741 - protein, 295 aa, unidentified; identical to SEQ ID NO: 9624

SEQ ID NO: 11742 - protein, 337 aa, unidentified; identical to SEQ ID NO: 8339

SEQ ID NO: 11743 - protein, 337 aa, unidentified; identical to SEQ ID NO: 8339

SEQ ID NO: 11744 - protein, 337 aa, unidentified; identical to SEQ ID NO: 8339

SEQ ID NO: 11745 - protein, 298 aa, unidentified; identical to SEQ ID NO: 8537

SEQ ID NO: 11746 - protein, 38 aa, unidentified
TFNYVQTGRVIESQYIGHILITDLCIMTFCNRDGYLFP

SEQ ID NO: 11747 - protein, 298 aa, unidentified; identical to SEQ ID NO: 8537

SEQ ID NO: 11748 - protein, 337 aa, unidentified; identical to SEQ ID NO: 8339

SEQ ID NO: 11749 - protein, 273 aa, unidentified; identical to SEQ ID NO: 11142

SEQ ID NO: 11750 - protein, 273 aa, unidentified; identical to SEQ ID NO: 11142

SEQ ID NO: 11751 - protein, 337 aa, unidentified; identical to SEQ ID NO: 8339

SEQ ID NO: 11752 - protein, 250 aa, unidentified
KPGEFGVAKGSRTIWYMWLGSRFLEFEALGFLNEERWASRDISGGGVEGIGINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCSHHFHE

SEQ ID NO: 11753 - protein, 205 aa, unidentified
KPGEFGVAKGSRTIWYMWLGSRFLEFEALGFLNEERWASRDISGGGVEGIGINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNAL

SEQ ID NO: 11754 - protein, 245 aa, unidentified
EGIGINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCSHHFHELFLRDGRKLIVPCRDQHELVGRSMVSQGGSSGVAGTACLAKA

SEQ ID NO: 11755 - protein, 337 aa, unidentified; identical to SEQ ID NO: 8339

SEQ ID NO: 11756 - protein, 317 aa, unidentified; identical to SEQ ID NO: 10841

SEQ ID NO: 11757 - protein, 331 aa, unidentified
KPGDFGVAKGSRTIWYMWLGSRFLEFESFGFLNEEHWASRELCGGGVEGIPLFYLGYHLEKMAEKAGILYADDTAGWDTRITMADLEDEYTLTELMEGEHKKLAETLFNFAYKNKVALCPRPGKNGGTVLDVISRTDQRGSGQVVTYALNTLTNIKVQLIRMAESEGVLDEEFHDNGMLKWLEKHGRDRLQRLMVSGDDCVVNAIDERFGKSLVWLNEMQKIRKDIDLWKPSAGHCNWEEVEFCSNHFHKLVMRDGRTLVVPCRHEVELVGRASVNQGGSTGISGTACLAKAYAQMWLLLYFHRRDLRILGMAICSAVPANWVPTGRTTWS

SEQ ID NO: 11758 - protein, 270 aa, unidentified; identical to SEQ ID NO: 8331

SEQ ID NO: 11759 - protein, 337 aa, unidentified; identical to SEQ ID NO: 8339

SEQ ID NO: 11760 - protein, 333 aa, unidentified; identical to SEQ ID NO: 8351

SEQ ID NO: 11761 - protein, 204 aa, unidentified; identical to SEQ ID NO: 10848

SEQ ID NO: 11762 - protein, 337 aa, unidentified; identical to SEQ ID NO: 8339

SEQ ID NO: 11763 - protein, 194 aa, unidentified; identical to SEQ ID NO: 10849

SEQ ID NO: 11764 - protein, 328 aa, unidentified
KPGEFGVAKGSRTIWYMWLGSRFLEFEALGFLNEERWASRDISGGGVEGIGINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCSHHFHELFLRDGRKLIVPCRDQHELVGRSMVSQGGSSGVAGTACLAKAYAQMWLMSYFHRRDLRTLGFGIMSSVPKDWFPTGRT

SEQ ID NO: 11765 - protein, 337 aa, unidentified; identical to SEQ ID NO: 8339

SEQ ID NO: 11766 - protein, 259 aa, unidentified
KPGEFGVAKGSRTIWYMWLGSRFLEFEALGFLNEERWASRDISGGGVEGIGINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCSHHFHELFLRDGRKL

SEQ ID NO: 11767 - protein, 337 aa, unidentified; identical to SEQ ID NO: 8339

SEQ ID NO: 11768 - protein, 260 aa, unidentified; identical to SEQ ID NO: 11487

SEQ ID NO: 11769 - protein, 337 aa, unidentified; identical to SEQ ID NO: 8339

SEQ ID NO: 11770 - protein, 315 aa, unidentified
GSRTIWYMWLGSRFLEFESFGFLNEEHWASRELCGGGVEGIPLFYLGYHLEKMAEKAGILYADDTAGWDTRITMADLEDEYTLTELMEGEHKKLAETLFNFAYKNKVALCPRPGKNGGTVLDVISRTDQRGSGQVVTYALNTLTNIKVQLIRMAESEGVLDEEFHDNGMLKWLEKHGRDRLQRLMVSGDDCVVNAIDERFGKSLVWLNEMQKIRKDIDLWKPSAGHCNWEEVEFCSNHFHKLVMRDGRTLVVPCRHEVELVGRASVNQGGSTGISGTACLAKAYAQMWLLLYFHRRDLRILGMAICSAVPANWVP

SEQ ID NO: 11771 - protein, 298 aa, unidentified
GFLNEEHWASRELCGGGVEGIPLFYLGYHLEKMAEKAGILYADDTAGWDTRITMADLEDEYTLTELMEGEHKKLAETLFNFAYKNKVALCPRPGKNGGTVLDVISRTDQRGSGQVVTYALNTLTNIKVQLIRMAESEGVLDEEFHDNGMLKWLEKHGRDRLQRLMVSGDDCVVNAIDERFGKSLVWLNEMQKIRKDIDLWKPSAGHCNWEEVEFCSNHFHKLVMRDGRTLVVPCRHEVELVGRASVNQGGSTGISGTACLAKAYAQMWLLLYFHRRDLRILGMAICSAVPANWVPTGR

SEQ ID NO: 11772 - protein, 337 aa, unidentified; identical to SEQ ID NO: 8339

SEQ ID NO: 11773 - protein, 333 aa, unidentified; identical to SEQ ID NO: 8351

SEQ ID NO: 11774 - protein, 217 aa, unidentified
LGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCSHHFHELFLRDGRKLIVPCRDQHELVG

SEQ ID NO: 11775 - protein, 151 aa, unidentified
HHRALIAVTMRLAYQNIAAVFPRTQSKYGSGFVMDFLGRRDQRGSGQVVTFALNTITNGKVQVARVLESEGLLHADESVLDAWLEKHLEEALGNMVIAGEEVVVSTTNRDFSSALEYLELTGKTRKNVPQGAPSRMESDWEKVEFCFHHYH

SEQ ID NO: 11776 - protein, 337 aa, unidentified; identical to SEQ ID NO: 8339

SEQ ID NO: 11777 - protein, 337 aa, unidentified; identical to SEQ ID NO: 8339

SEQ ID NO: 11778 - protein, 69 aa, unidentified
VNIGTMIDCLPDMPPLYLLGEDWYQISSRGLIRHSKPATMQQDDVNYEFSVLSGLGNGGLYNDETIALY

SEQ ID NO: 11779 - protein, 237 aa, unidentified
RTIWYMWLGSRFLEFESFGFLNEEHWASRELCGGGVEGIPLFYLGYHLEKMAEKAGILYADDTAGWDTRITMADLEDEYTLTELMEGEHKKLAETLFNFAYKNKVALCPRPGKNGGTVLDVISRTDQRGSGQVVTYALNTLTNIKVQLIRMAESEGVLDEEFHDNGMLKWLEKHGRDRLQRLMVSGDDCVVNAIDERFGKSLVWLNEMQKIRKDIDLWKPSAGHCNWEEVEFCSNHF

SEQ ID NO: 11780 - protein, 319 aa, unidentified; identical to SEQ ID NO: 8858

SEQ ID NO: 11781 - protein, 231 aa, unidentified; identical to SEQ ID NO: 9315

SEQ ID NO: 11782 - protein, 91 aa, unidentified
MAKKPGKLYADDTAGWDTRITEADLDDECILCDYMEDEHKQLALSLFELCYKNKVALCPRPGRHGGTVMDVIFRRDQRGSGQVVTYALNTL

SEQ ID NO: 11783 - protein, 254 aa, unidentified; identical to SEQ ID NO: 10832

SEQ ID NO: 11784 - protein, 242 aa, unidentified; identical to SEQ ID NO: 9313

SEQ ID NO: 11785 - protein, 302 aa, unidentified; identical to SEQ ID NO: 10310

SEQ ID NO: 11786 - protein, 231 aa, unidentified; identical to SEQ ID NO: 9315

SEQ ID NO: 11787 - protein, 337 aa, unidentified; identical to SEQ ID NO: 8339

SEQ ID NO: 11788 - protein, 309 aa, unidentified
GSRTIWYMWLGSRFLEFEALGFLNEERWASRDISGGGVEGIGINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCSHHFHELFLRDGRKLIVPCRDQHELVGRSMVSQGGSSGVAGTACLAKAYAQMWLMSYFHRRDLRTLGFGIMSSV

SEQ ID NO: 11789 - protein, 316 aa, unidentified
GSRTIWYMWLGSRFLEFESFGFLNEEHWASRELCGGGVEGIPLFYLGYHLEKMAEKAGILYADDTAGWDTRITMADLEDEYTLTELMEGEHKKLAETLFNFAYKNKVALCPRPGKNGGTVLDVISRTDQRGSGQVVTYALNTLTNIKVQLIRMAESEGVLDEEFHDNGMLKWLEKHGRDRLQRLMVSGDDCVVNAIDERFGKSLVWLNEMQKIRKDIDLWKPSAGHCNWEEVEFCSNHFHKLVMRDGRTLVVPCRHEVELVGRASVNQGGSTGISGTACLAKAYAQMWLLLYFHRRDLRILGMAICSAVPANWVPT

SEQ ID NO: 11790 - protein, 337 aa, unidentified; identical to SEQ ID NO: 8339

SEQ ID NO: 11791 - protein, 249 aa, unidentified; identical to SEQ ID NO: 10206

SEQ ID NO: 11792 - protein, 260 aa, unidentified; identical to SEQ ID NO: 11487

SEQ ID NO: 11793 - protein, 242 aa, unidentified; identical to SEQ ID NO: 9313

SEQ ID NO: 11794 - protein, 316 aa, unidentified; identical to SEQ ID NO: 8732

SEQ ID NO: 11795 - protein, 316 aa, unidentified; identical to SEQ ID NO: 8732

SEQ ID NO: 11796 - protein, 337 aa, unidentified; identical to SEQ ID NO: 8339

SEQ ID NO: 11797 - protein, 231 aa, unidentified; identical to SEQ ID NO: 9733

SEQ ID NO: 11798 - protein, 187 aa, unidentified; identical to SEQ ID NO: 10447

SEQ ID NO: 11799 - protein, 242 aa, unidentified; identical to SEQ ID NO: 9313

SEQ ID NO: 11800 - protein, 242 aa, unidentified; identical to SEQ ID NO: 9313

SEQ ID NO: 11801 - protein, 260 aa, unidentified; identical to SEQ ID NO: 11487

SEQ ID NO: 11802 - protein, 319 aa, unidentified; identical to SEQ ID NO: 8858

SEQ ID NO: 11803 - protein, 231 aa, unidentified; identical to SEQ ID NO: 9315

SEQ ID NO: 11804 - protein, 242 aa, unidentified; identical to SEQ ID NO: 9313

SEQ ID NO: 11805 - protein, 337 aa, unidentified; identical to SEQ ID NO: 8339

SEQ ID NO: 11806 - protein, 231 aa, unidentified; identical to SEQ ID NO: 9733

SEQ ID NO: 11807 - protein, 209 aa, unidentified; identical to SEQ ID NO: 9505

SEQ ID NO: 11808 - protein, 279 aa, unidentified
RELSGGGVEGIPLNYLGYHLREMAQKPGVLYADDTAGWDTRITMADLEDEGILLDMMSGEHKKLASALFSKAYKVKVALCPRPGPKGGTLMDVISRTDQRGSGQVVTYALNTLTNIKVQLIRMAEAEGVLGATFEDFGIDRWLQEHGEDRVERMLVSGDDCVVNAIDERFGSSLNWLNAMEKVRKDIDLWKPSPSFRNWERVEFCSNHFHEMTMKDGRVIVAPCRGQTELIARGTVNQGGCVGVESTGCLAKAYAQMWLLLYFHRRDLRTLALAVMSAV

SEQ ID NO: 11809 - protein, 333 aa, unidentified; identical to SEQ ID NO: 8351

SEQ ID NO: 11810 - protein, 237 aa, unidentified
DTAGWDTRITEADLDDECILCDYMEDEHKQLALSLFELCYKNKVALCPRPGRHGGTVMDVIFRRDQRGSGQVVTYALNTLTNIKVQLIRLAESEGVLDEDFNDHGIETWLNHYGEERLSRLLISGDDCLVNAFDERFGKALTWLNTMEKIRKDIDLCAPSNGYENFEKVEFCSNHFHELMLKDGRQLVVPCRSQNELVGRASVNQGGSATVAGTACLAKAYAQMWNLLYFHRRDLRL

SEQ ID NO: 11811 - protein, 335 aa, unidentified; identical to SEQ ID NO: 8722

SEQ ID NO: 11812 - protein, 319 aa, unidentified; identical to SEQ ID NO: 8858

SEQ ID NO: 11813 - protein, 333 aa, unidentified; identical to SEQ ID NO: 8351

SEQ ID NO: 11814 - protein, 319 aa, unidentified; identical to SEQ ID NO: 8858

SEQ ID NO: 11815 - protein, 83 aa, unidentified; identical to SEQ ID NO: 10321

SEQ ID NO: 11816 - protein, 231 aa, unidentified; identical to SEQ ID NO: 9315

SEQ ID NO: 11817 - protein, 319 aa, unidentified; identical to SEQ ID NO: 11495

SEQ ID NO: 11818 - protein, 319 aa, unidentified; identical to SEQ ID NO: 8858

SEQ ID NO: 11819 - protein, 332 aa, unidentified; identical to SEQ ID NO: 9622

SEQ ID NO: 11820 - protein, 337 aa, unidentified; identical to SEQ ID NO: 8339

SEQ ID NO: 11821 - protein, 333 aa, unidentified; identical to SEQ ID NO: 8351

SEQ ID NO: 11822 - protein, 337 aa, unidentified; identical to SEQ ID NO: 8339

SEQ ID NO: 11823 - protein, 337 aa, unidentified; identical to SEQ ID NO: 8339

SEQ ID NO: 11824 - protein, 272 aa, unidentified
KPGEFGVAKGSRTIWYMWLGSRFLEFEALGFLNEERWASRDISGGGVEGIGINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCSHHFHELFLRDGRKLIVPCRDQHELVGR

SEQ ID NO: 11825 - protein, 337 aa, unidentified; identical to SEQ ID NO: 8339

SEQ ID NO: 11826 - protein, 231 aa, unidentified; identical to SEQ ID NO: 9733

SEQ ID NO: 11827 - protein, 187 aa, unidentified; identical to SEQ ID NO: 10447

SEQ ID NO: 11828 - protein, 84 aa, unidentified; identical to SEQ ID NO: 8174

SEQ ID NO: 11829 - protein, 337 aa, unidentified; identical to SEQ ID NO: 8339

SEQ ID NO: 11830 - protein, 59 aa, unidentified; identical to SEQ ID NO: 8183

SEQ ID NO: 11831 - protein, 166 aa, unidentified; identical to SEQ ID NO: 9897

SEQ ID NO: 11832 - protein, 57 aa, unidentified; identical to SEQ ID NO: 8179

SEQ ID NO: 11833 - protein, 319 aa, unidentified; identical to SEQ ID NO: 8858

SEQ ID NO: 11834 - protein, 337 aa, unidentified; identical to SEQ ID NO: 10217

SEQ ID NO: 11835 - protein, 337 aa, unidentified; identical to SEQ ID NO: 8339

SEQ ID NO: 11836 - protein, 337 aa, unidentified; identical to SEQ ID NO: 8339

SEQ ID NO: 11837 - protein, 337 aa, unidentified; identical to SEQ ID NO: 8339

SEQ ID NO: 11838 - protein, 328 aa, unidentified; identical to SEQ ID NO: 11764

SEQ ID NO: 11839 - protein, 319 aa, unidentified
GVAKGSRTIWYMWLGSRFLEFEALGFLNEERWASRDISGGGVEGIGINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCSHHFHELFLRDGRKLIVPCRDQHELVGRSMVSQGGSSGVAGTACLAKAYAQMWLMSYFHRRDLRTLGFGIMSSVPKDWFP

SEQ ID NO: 11840 - protein, 337 aa, unidentified; identical to SEQ ID NO: 8339

SEQ ID NO: 11841 - protein, 337 aa, unidentified; identical to SEQ ID NO: 8339

SEQ ID NO: 11842 - protein, 23 aa, unidentified
ACLAKAYAQMWNLLYFHRRDLRL

SEQ ID NO: 11843 - protein, 337 aa, unidentified; identical to SEQ ID NO: 8339

SEQ ID NO: 11844 - protein, 337 aa, unidentified; identical to SEQ ID NO: 8339

SEQ ID NO: 11845 - protein, 337 aa, unidentified; identical to SEQ ID NO: 8339

SEQ ID NO: 11846 - protein, 86 aa, unidentified; identical to SEQ ID NO: 8182

SEQ ID NO: 11847 - protein, 73 aa, unidentified; identical to SEQ ID NO: 8173

SEQ ID NO: 11848 - protein, 332 aa, unidentified; identical to SEQ ID NO: 9622

SEQ ID NO: 11849 - protein, 42 aa, unidentified; identical to SEQ ID NO: 8181

SEQ ID NO: 11850 - protein, 337 aa, unidentified; identical to SEQ ID NO: 10217

SEQ ID NO: 11851 - protein, 337 aa, unidentified; identical to SEQ ID NO: 8339

SEQ ID NO: 11852 - protein, 333 aa, unidentified; identical to SEQ ID NO: 8351

SEQ ID NO: 11853 - protein, 289 aa, unidentified
SGGGVEGIGINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCSHHFHELFLRDGRKLIVPCRDQHELVGRSMVSQGGSSGVAGTACLAKAYAQMWLMSYFHRRDLRTLGFGIMSSVPKDWFPTGRTTWS

SEQ ID NO: 11854 - protein, 337 aa, unidentified; identical to SEQ ID NO: 10217

SEQ ID NO: 11855 - protein, 47 aa, unidentified
PILSCTALALLLLIYCCKRRYQQTLKQHTKVDPAFKPDLTGTSKSYV

SEQ ID NO: 11856 - protein, 57 aa, unidentified; identical to SEQ ID NO: 8179

SEQ ID NO: 11857 - protein, 337 aa, unidentified; identical to SEQ ID NO: 8339

SEQ ID NO: 11858 - protein, 337 aa, unidentified; identical to SEQ ID NO: 8339

SEQ ID NO: 11859 - protein, 337 aa, unidentified; identical to SEQ ID NO: 8339

SEQ ID NO: 11860 - protein, 337 aa, unidentified; identical to SEQ ID NO: 10217

SEQ ID NO: 11861 - protein, 29 aa, unidentified
NSNDSVLFQLYNVGWYHKPLVGSINLTTP

SEQ ID NO: 11862 - protein, 295 aa, unidentified; identical to SEQ ID NO: 9624

SEQ ID NO: 11863 - protein, 240 aa, unidentified; identical to SEQ ID NO: 8200

SEQ ID NO: 11864 - protein, 59 aa, unidentified; identical to SEQ ID NO: 8183

SEQ ID NO: 11865 - protein, 104 aa, unidentified
YYESPLLNSGWLTIPPKDGTISGLINKAGRGDQFTVLPHVLTFAPRESSGNCYLPIQTSQIRDRDVLIESNIVVLPTQSIRYVIATYDISRSDHAIVYYVYDPI

SEQ ID NO: 11866 - protein, 170 aa, unidentified; identical to SEQ ID NO: 8202

SEQ ID NO: 11867 - protein, 57 aa, unidentified; identical to SEQ ID NO: 8179

SEQ ID NO: 11868 - protein, 337 aa, unidentified; identical to SEQ ID NO: 10217

SEQ ID NO: 11869 - protein, 57 aa, unidentified; identical to SEQ ID NO: 8179

SEQ ID NO: 11870 - protein, 337 aa, unidentified; identical to SEQ ID NO: 8339

SEQ ID NO: 11871 - protein, 84 aa, unidentified; identical to SEQ ID NO: 8174

SEQ ID NO: 11872 - protein, 335 aa, unidentified; identical to SEQ ID NO: 8722

SEQ ID NO: 11873 - protein, 57 aa, unidentified; identical to SEQ ID NO: 8179

SEQ ID NO: 11874 - protein, 57 aa, unidentified; identical to SEQ ID NO: 8179

SEQ ID NO: 11875 - protein, 337 aa, unidentified; identical to SEQ ID NO: 8339

SEQ ID NO: 11876 - protein, 335 aa, unidentified; identical to SEQ ID NO: 8722

SEQ ID NO: 11877 - protein, 333 aa, unidentified; identical to SEQ ID NO: 8351

SEQ ID NO: 11878 - protein, 337 aa, unidentified; identical to SEQ ID NO: 8339

SEQ ID NO: 11879 - protein, 337 aa, unidentified; identical to SEQ ID NO: 10217

SEQ ID NO: 11880 - protein, 337 aa, unidentified; identical to SEQ ID NO: 8339

SEQ ID NO: 11881 - protein, 332 aa, unidentified; identical to SEQ ID NO: 9622

SEQ ID NO: 11882 - protein, 337 aa, unidentified; identical to SEQ ID NO: 8339

SEQ ID NO: 11883 - protein, 337 aa, unidentified; identical to SEQ ID NO: 8339

SEQ ID NO: 11884 - protein, 337 aa, unidentified; identical to SEQ ID NO: 8339

SEQ ID NO: 11885 - protein, 337 aa, unidentified; identical to SEQ ID NO: 8339

SEQ ID NO: 11886 - protein, 337 aa, unidentified; identical to SEQ ID NO: 8339

SEQ ID NO: 11887 - protein, 298 aa, unidentified; identical to SEQ ID NO: 8537

SEQ ID NO: 11888 - protein, 246 aa, unidentified
KPGEFGVAKGSRTIWYMWLGSRFLEFEALGFLNEERWASRDISGGGVEGIGINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCSH

SEQ ID NO: 11889 - protein, 337 aa, unidentified; identical to SEQ ID NO: 8339

SEQ ID NO: 11890 - protein, 332 aa, unidentified; identical to SEQ ID NO: 9622

SEQ ID NO: 11891 - protein, 328 aa, unidentified
GSRTIWYMWLGSRFLEFEALGFLNEERWASRDISGGGVEGIGINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCSHHFHELFLRDGRKLIVPCRDQHELVGRSMVSQGGSSGVAGTACLAKAYAQMWLMSYFHRRDLRTLGFGIMSSVPKDWFPTGRTTWSVHANHE

SEQ ID NO: 11892 - protein, 337 aa, unidentified; identical to SEQ ID NO: 8339

SEQ ID NO: 11893 - protein, 333 aa, unidentified
KPGEFGVAKGSRTIWYMWLGSRFLEFEALGFLNEERWASRDISGGGVEGIGINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCSHHFHELFLRDGRKLIVPCRDQHELVGRSMVSQGGSSGVAGTACLAKAYAQMWLMSYFHRRDLRTLGFGIMSSVPKDWFPTGRTTWSVH

SEQ ID NO: 11894 - protein, 337 aa, unidentified; identical to SEQ ID NO: 8339

SEQ ID NO: 11895 - protein, 337 aa, unidentified; identical to SEQ ID NO: 8339

SEQ ID NO: 11896 - protein, 337 aa, unidentified; identical to SEQ ID NO: 8339

SEQ ID NO: 11897 - protein, 337 aa, unidentified; identical to SEQ ID NO: 8339

SEQ ID NO: 11898 - protein, 334 aa, unidentified
KPGDFGVAKGSRTIWYMWLGSRFLEFESFGFLNEEHWASRELCGGGVEGIPLFYLGYHLEKMAEKAGILYADDTAGWDTRITMADLEDEYTLTELMEGEHKKLAETLFNFAYKNKVALCPRPGKNGGTVLDVISRTDQRGSGQVVTYALNTLTNIKVQLIRMAESEGVLDEEFHDNGMLKWLEKHGRDRLQRLMVSGDDCVVNAIDERFGKSLVWLNEMQKIRKDIDLWKPSAGHCNWEEVEFCSNHFHKLVMRDGRTLVVPCRHEVELVGRASVNQGGSTGISGTACLAKAYAQMWLLLYFHRRDLRILGMAICSAVPANWVPTGRTTWSLHA

SEQ ID NO: 11899 - protein, 337 aa, unidentified; identical to SEQ ID NO: 8339

SEQ ID NO: 11900 - protein, 337 aa, unidentified; identical to SEQ ID NO: 8339

SEQ ID NO: 11901 - protein, 337 aa, unidentified; identical to SEQ ID NO: 8339

SEQ ID NO: 11902 - protein, 298 aa, unidentified; identical to SEQ ID NO: 8537

SEQ ID NO: 11903 - protein, 337 aa, unidentified; identical to SEQ ID NO: 8339

SEQ ID NO: 11904 - protein, 337 aa, unidentified; identical to SEQ ID NO: 8339

SEQ ID NO: 11905 - protein, 337 aa, unidentified; identical to SEQ ID NO: 8339

SEQ ID NO: 11906 - protein, 337 aa, unidentified; identical to SEQ ID NO: 8339

SEQ ID NO: 11907 - protein, 337 aa, unidentified; identical to SEQ ID NO: 8339

SEQ ID NO: 11908 - protein, 337 aa, unidentified; identical to SEQ ID NO: 8339

SEQ ID NO: 11909 - protein, 335 aa, unidentified; identical to SEQ ID NO: 8722

SEQ ID NO: 11910 - protein, 337 aa, unidentified; identical to SEQ ID NO: 8339

SEQ ID NO: 11911 - protein, 337 aa, unidentified; identical to SEQ ID NO: 8339

SEQ ID NO: 11912 - protein, 332 aa, unidentified; identical to SEQ ID NO: 9622

SEQ ID NO: 11913 - protein, 337 aa, unidentified; identical to SEQ ID NO: 8339

SEQ ID NO: 11914 - protein, 337 aa, unidentified; identical to SEQ ID NO: 8339

SEQ ID NO: 11915 - protein, 337 aa, unidentified; identical to SEQ ID NO: 8339

SEQ ID NO: 11916 - protein, 337 aa, unidentified; identical to SEQ ID NO: 8339

SEQ ID NO: 11917 - protein, 337 aa, unidentified; identical to SEQ ID NO: 8339

SEQ ID NO: 11918 - protein, 337 aa, unidentified; identical to SEQ ID NO: 8339

SEQ ID NO: 11919 - protein, 337 aa, unidentified; identical to SEQ ID NO: 8339

SEQ ID NO: 11920 - protein, 337 aa, unidentified; identical to SEQ ID NO: 8339

SEQ ID NO: 11921 - protein, 335 aa, unidentified; identical to SEQ ID NO: 8722

SEQ ID NO: 11922 - protein, 298 aa, unidentified; identical to SEQ ID NO: 8537

SEQ ID NO: 11923 - protein, 335 aa, unidentified; identical to SEQ ID NO: 8722

SEQ ID NO: 11924 - protein, 247 aa, unidentified; identical to SEQ ID NO: 10338

SEQ ID NO: 11925 - protein, 258 aa, unidentified; identical to SEQ ID NO: 8309

SEQ ID NO: 11926 - protein, 127 aa, unidentified; identical to SEQ ID NO: 8344

SEQ ID NO: 11927 - protein, 337 aa, unidentified; identical to SEQ ID NO: 8339

SEQ ID NO: 11928 - protein, 337 aa, unidentified; identical to SEQ ID NO: 8339

SEQ ID NO: 11929 - protein, 328 aa, unidentified; identical to SEQ ID NO: 11764

SEQ ID NO: 11930 - protein, 337 aa, unidentified; identical to SEQ ID NO: 8339

SEQ ID NO: 11931 - protein, 337 aa, unidentified; identical to SEQ ID NO: 8339

SEQ ID NO: 11932 - protein, 330 aa, unidentified
GVAKGSRTIWYMWLGSRFLEFEALGFLNEERWASRDISGGGVEGIGINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCSHHFHELFLRDGRKLIVPCRDQHELVGRSMVSQGGSSGVAGTACLAKAYAQMWLMSYFHRRDLRTLGFGIMSSVPKDWFPTGRTTWSVHAN

SEQ ID NO: 11933 - protein, 337 aa, unidentified; identical to SEQ ID NO: 10217

SEQ ID NO: 11934 - protein, 337 aa, unidentified; identical to SEQ ID NO: 8339

SEQ ID NO: 11935 - protein, 337 aa, unidentified; identical to SEQ ID NO: 8339

SEQ ID NO: 11936 - protein, 337 aa, unidentified; identical to SEQ ID NO: 8339

SEQ ID NO: 11937 - protein, 333 aa, unidentified; identical to SEQ ID NO: 8351

SEQ ID NO: 11938 - protein, 337 aa, unidentified; identical to SEQ ID NO: 8339

SEQ ID NO: 11939 - protein, 295 aa, unidentified; identical to SEQ ID NO: 9624

SEQ ID NO: 11940 - protein, 337 aa, unidentified; identical to SEQ ID NO: 8339

SEQ ID NO: 11941 - protein, 337 aa, unidentified; identical to SEQ ID NO: 8339

SEQ ID NO: 11942 - protein, 337 aa, unidentified; identical to SEQ ID NO: 8339

SEQ ID NO: 11943 - protein, 298 aa, unidentified; identical to SEQ ID NO: 8537

SEQ ID NO: 11944 - protein, 337 aa, unidentified; identical to SEQ ID NO: 8339

SEQ ID NO: 11945 - protein, 337 aa, unidentified; identical to SEQ ID NO: 8339

SEQ ID NO: 11946 - protein, 337 aa, unidentified; identical to SEQ ID NO: 8339

SEQ ID NO: 11947 - protein, 337 aa, unidentified; identical to SEQ ID NO: 8339

SEQ ID NO: 11948 - protein, 337 aa, unidentified; identical to SEQ ID NO: 8339

SEQ ID NO: 11949 - protein, 332 aa, unidentified; identical to SEQ ID NO: 9622

SEQ ID NO: 11950 - protein, 337 aa, unidentified; identical to SEQ ID NO: 8339

SEQ ID NO: 11951 - protein, 337 aa, unidentified; identical to SEQ ID NO: 8339

SEQ ID NO: 11952 - protein, 337 aa, unidentified; identical to SEQ ID NO: 8339

SEQ ID NO: 11953 - protein, 104 aa, unidentified; identical to SEQ ID NO: 8421

SEQ ID NO: 11954 - protein, 74 aa, unidentified; identical to SEQ ID NO: 8267

SEQ ID NO: 11955 - protein, 74 aa, unidentified; identical to SEQ ID NO: 8267

SEQ ID NO: 11956 - protein, 337 aa, unidentified; identical to SEQ ID NO: 8339

SEQ ID NO: 11957 - protein, 298 aa, unidentified; identical to SEQ ID NO: 8537

SEQ ID NO: 11958 - protein, 337 aa, unidentified; identical to SEQ ID NO: 8339

SEQ ID NO: 11959 - protein, 337 aa, unidentified; identical to SEQ ID NO: 8339

SEQ ID NO: 11960 - protein, 337 aa, unidentified; identical to SEQ ID NO: 8339

SEQ ID NO: 11961 - protein, 337 aa, unidentified; identical to SEQ ID NO: 8339

SEQ ID NO: 11962 - protein, 337 aa, unidentified; identical to SEQ ID NO: 8339

SEQ ID NO: 11963 - protein, 335 aa, unidentified; identical to SEQ ID NO: 8722

SEQ ID NO: 11964 - protein, 337 aa, unidentified; identical to SEQ ID NO: 8339

SEQ ID NO: 11965 - protein, 337 aa, unidentified; identical to SEQ ID NO: 8339

SEQ ID NO: 11966 - protein, 337 aa, unidentified; identical to SEQ ID NO: 8339

SEQ ID NO: 11967 - protein, 246 aa, unidentified; identical to SEQ ID NO: 11888

SEQ ID NO: 11968 - protein, 307 aa, unidentified; identical to SEQ ID NO: 11125

SEQ ID NO: 11969 - protein, 337 aa, unidentified; identical to SEQ ID NO: 8339

SEQ ID NO: 11970 - protein, 332 aa, unidentified; identical to SEQ ID NO: 9622

SEQ ID NO: 11971 - protein, 337 aa, unidentified; identical to SEQ ID NO: 8339

SEQ ID NO: 11972 - protein, 337 aa, unidentified; identical to SEQ ID NO: 8339

SEQ ID NO: 11973 - protein, 298 aa, unidentified; identical to SEQ ID NO: 8537

SEQ ID NO: 11974 - protein, 337 aa, unidentified; identical to SEQ ID NO: 8339

SEQ ID NO: 11975 - protein, 337 aa, unidentified; identical to SEQ ID NO: 8339

SEQ ID NO: 11976 - protein, 337 aa, unidentified; identical to SEQ ID NO: 8339

SEQ ID NO: 11977 - protein, 337 aa, unidentified; identical to SEQ ID NO: 8339

SEQ ID NO: 11978 - protein, 337 aa, unidentified; identical to SEQ ID NO: 8339

SEQ ID NO: 11979 - protein, 337 aa, unidentified; identical to SEQ ID NO: 8339

SEQ ID NO: 11980 - protein, 337 aa, unidentified; identical to SEQ ID NO: 8339

SEQ ID NO: 11981 - protein, 337 aa, unidentified; identical to SEQ ID NO: 8339

SEQ ID NO: 11982 - protein, 337 aa, unidentified; identical to SEQ ID NO: 8339

SEQ ID NO: 11983 - protein, 337 aa, unidentified; identical to SEQ ID NO: 8339

SEQ ID NO: 11984 - protein, 337 aa, unidentified; identical to SEQ ID NO: 8339

SEQ ID NO: 11985 - protein, 298 aa, unidentified; identical to SEQ ID NO: 8537

SEQ ID NO: 11986 - protein, 337 aa, unidentified; identical to SEQ ID NO: 8339

SEQ ID NO: 11987 - protein, 293 aa, unidentified
GGVEGIGINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCSHHFHELFLRDGRKLIVPCRDQHELVGRSMVSQGGSSGVAGTACLAKAYAQMWLMSYFHRRDLRTLGFGIMSSVPKDWFPTGRTTWSVHANHE

SEQ ID NO: 11988 - protein, 337 aa, unidentified; identical to SEQ ID NO: 8339

SEQ ID NO: 11989 - protein, 337 aa, unidentified; identical to SEQ ID NO: 8339

SEQ ID NO: 11990 - protein, 337 aa, unidentified; identical to SEQ ID NO: 8339

SEQ ID NO: 11991 - protein, 298 aa, unidentified; identical to SEQ ID NO: 8537

SEQ ID NO: 11992 - protein, 337 aa, unidentified; identical to SEQ ID NO: 8339

SEQ ID NO: 11993 - protein, 337 aa, unidentified; identical to SEQ ID NO: 8339

SEQ ID NO: 11994 - protein, 337 aa, unidentified; identical to SEQ ID NO: 8339

SEQ ID NO: 11995 - protein, 298 aa, unidentified; identical to SEQ ID NO: 8537

SEQ ID NO: 11996 - protein, 337 aa, unidentified; identical to SEQ ID NO: 8339

SEQ ID NO: 11997 - protein, 337 aa, unidentified; identical to SEQ ID NO: 8339

SEQ ID NO: 11998 - protein, 337 aa, unidentified; identical to SEQ ID NO: 8339

SEQ ID NO: 11999 - protein, 337 aa, unidentified; identical to SEQ ID NO: 8339

SEQ ID NO: 12000 - protein, 337 aa, unidentified; identical to SEQ ID NO: 8339

SEQ ID NO: 12001 - protein, 298 aa, unidentified; identical to SEQ ID NO: 8537

SEQ ID NO: 12002 - protein, 337 aa, unidentified; identical to SEQ ID NO: 8339

SEQ ID NO: 12003 - protein, 337 aa, unidentified; identical to SEQ ID NO: 8339

SEQ ID NO: 12004 - protein, 337 aa, unidentified; identical to SEQ ID NO: 8339

SEQ ID NO: 12005 - protein, 337 aa, unidentified; identical to SEQ ID NO: 8339

SEQ ID NO: 12006 - protein, 337 aa, unidentified; identical to SEQ ID NO: 8339

SEQ ID NO: 12007 - protein, 337 aa, unidentified; identical to SEQ ID NO: 8339

SEQ ID NO: 12008 - protein, 337 aa, unidentified; identical to SEQ ID NO: 8339

SEQ ID NO: 12009 - protein, 337 aa, unidentified; identical to SEQ ID NO: 8339

SEQ ID NO: 12010 - protein, 337 aa, unidentified; identical to SEQ ID NO: 8339

SEQ ID NO: 12011 - protein, 332 aa, unidentified; identical to SEQ ID NO: 9622

SEQ ID NO: 12012 - protein, 337 aa, unidentified; identical to SEQ ID NO: 8339

SEQ ID NO: 12013 - protein, 337 aa, unidentified; identical to SEQ ID NO: 8339

SEQ ID NO: 12014 - protein, 337 aa, unidentified; identical to SEQ ID NO: 8339

SEQ ID NO: 12015 - protein, 337 aa, unidentified; identical to SEQ ID NO: 8339

SEQ ID NO: 12016 - protein, 337 aa, unidentified; identical to SEQ ID NO: 8339

SEQ ID NO: 12017 - protein, 337 aa, unidentified; identical to SEQ ID NO: 8339

SEQ ID NO: 12018 - protein, 298 aa, unidentified; identical to SEQ ID NO: 8537

SEQ ID NO: 12019 - protein, 337 aa, unidentified; identical to SEQ ID NO: 8339

SEQ ID NO: 12020 - protein, 332 aa, unidentified; identical to SEQ ID NO: 9622

SEQ ID NO: 12021 - protein, 332 aa, unidentified; identical to SEQ ID NO: 9622

SEQ ID NO: 12022 - protein, 337 aa, unidentified; identical to SEQ ID NO: 8339

SEQ ID NO: 12023 - protein, 332 aa, unidentified; identical to SEQ ID NO: 9622

SEQ ID NO: 12024 - protein, 337 aa, unidentified; identical to SEQ ID NO: 8339

SEQ ID NO: 12025 - protein, 337 aa, unidentified; identical to SEQ ID NO: 8339

SEQ ID NO: 12026 - protein, 298 aa, unidentified; identical to SEQ ID NO: 8537

SEQ ID NO: 12027 - protein, 337 aa, unidentified; identical to SEQ ID NO: 8339

SEQ ID NO: 12028 - protein, 337 aa, unidentified; identical to SEQ ID NO: 8339

SEQ ID NO: 12029 - protein, 337 aa, unidentified; identical to SEQ ID NO: 8339

SEQ ID NO: 12030 - protein, 337 aa, unidentified; identical to SEQ ID NO: 8339

SEQ ID NO: 12031 - protein, 332 aa, unidentified; identical to SEQ ID NO: 9622

SEQ ID NO: 12032 - protein, 337 aa, unidentified; identical to SEQ ID NO: 8339

SEQ ID NO: 12033 - protein, 337 aa, unidentified; identical to SEQ ID NO: 8339

SEQ ID NO: 12034 - protein, 144 aa, unidentified
GVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFG

SEQ ID NO: 12035 - protein, 337 aa, unidentified; identical to SEQ ID NO: 8339

SEQ ID NO: 12036 - protein, 337 aa, unidentified; identical to SEQ ID NO: 8339

SEQ ID NO: 12037 - protein, 337 aa, unidentified; identical to SEQ ID NO: 8339

SEQ ID NO: 12038 - protein, 337 aa, unidentified; identical to SEQ ID NO: 8339

SEQ ID NO: 12039 - protein, 337 aa, unidentified; identical to SEQ ID NO: 8339

SEQ ID NO: 12040 - protein, 337 aa, unidentified; identical to SEQ ID NO: 8339

SEQ ID NO: 12041 - protein, 337 aa, unidentified; identical to SEQ ID NO: 8339

SEQ ID NO: 12042 - protein, 337 aa, unidentified; identical to SEQ ID NO: 8339

SEQ ID NO: 12043 - protein, 337 aa, unidentified; identical to SEQ ID NO: 8339

SEQ ID NO: 12044 - protein, 337 aa, unidentified; identical to SEQ ID NO: 8339

SEQ ID NO: 12045 - protein, 337 aa, unidentified; identical to SEQ ID NO: 8339

SEQ ID NO: 12046 - protein, 337 aa, unidentified; identical to SEQ ID NO: 8339

SEQ ID NO: 12047 - protein, 337 aa, unidentified; identical to SEQ ID NO: 8339

SEQ ID NO: 12048 - protein, 337 aa, unidentified; identical to SEQ ID NO: 8339

SEQ ID NO: 12049 - protein, 337 aa, unidentified; identical to SEQ ID NO: 8339

SEQ ID NO: 12050 - protein, 332 aa, unidentified; identical to SEQ ID NO: 9622

SEQ ID NO: 12051 - protein, 337 aa, unidentified; identical to SEQ ID NO: 8339

SEQ ID NO: 12052 - protein, 337 aa, unidentified; identical to SEQ ID NO: 8339

SEQ ID NO: 12053 - protein, 337 aa, unidentified; identical to SEQ ID NO: 8339

SEQ ID NO: 12054 - protein, 258 aa, unidentified; identical to SEQ ID NO: 8309

SEQ ID NO: 12055 - protein, 337 aa, unidentified; identical to SEQ ID NO: 8339

SEQ ID NO: 12056 - protein, 246 aa, unidentified; identical to SEQ ID NO: 10234

SEQ ID NO: 12057 - protein, 337 aa, unidentified; identical to SEQ ID NO: 8339

SEQ ID NO: 12058 - protein, 337 aa, unidentified; identical to SEQ ID NO: 8339

SEQ ID NO: 12059 - protein, 337 aa, unidentified; identical to SEQ ID NO: 8339

SEQ ID NO: 12060 - protein, 337 aa, unidentified; identical to SEQ ID NO: 8339

SEQ ID NO: 12061 - protein, 209 aa, unidentified; identical to SEQ ID NO: 9505

SEQ ID NO: 12062 - protein, 311 aa, unidentified
KPGEFGVAKGSRTIWYMWLGSRFLEFEALGFLNEERWASRDISGGGVEGIGINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCSHHFHELFLRDGRKLIVPCRDQHELVGRSMVSQGGSSGVAGTACLAKAYAQMWLMSYFHRRDLRTLG

SEQ ID NO: 12063 - protein, 69 aa, unidentified; identical to SEQ ID NO: 8367

SEQ ID NO: 12064 - protein, 251 aa, unidentified; identical to SEQ ID NO: 10649

SEQ ID NO: 12065 - protein, 337 aa, unidentified; identical to SEQ ID NO: 8339

SEQ ID NO: 12066 - protein, 337 aa, unidentified; identical to SEQ ID NO: 8339

SEQ ID NO: 12067 - protein, 337 aa, unidentified; identical to SEQ ID NO: 8339

SEQ ID NO: 12068 - protein, 337 aa, unidentified; identical to SEQ ID NO: 8339

SEQ ID NO: 12069 - protein, 313 aa, unidentified; identical to SEQ ID NO: 9730

SEQ ID NO: 12070 - protein, 188 aa, unidentified
VLYADDTAGWDTRITMADLEDEGILLDMMSGEHKKLASALFSKAYKVKVALCPRPGPKGGTLMDVISRTDQRGSGQVVTYALNTLTNIKVQLIRMAEAEGVLGATFEDFGIDRWLQEHGEDRVERMLVSGDDCVVNAIDERFGSSLNWLNAMEKVRKDIDLWKPSPSFRNWERVEFCSNHFHEMTMKD

SEQ ID NO: 12071 - protein, 278 aa, unidentified
YHLEKMAEKAGILYADDTAGWDTRITMADLEDEYTLTELMEGEHKKLAETLFNFAYKNKVALCPRPGKNGGTVLDVISRTDQRGSGQVVTYALNTLTNIKVQLIRMAESEGVLDEEFHDNGMLKWLEKHGRDRLQRLMVSGDDCVVNAIDERFGKSLVWLNEMQKIRKDIDLWKPSAGHCNWEEVEFCSNHFHKLVMRDGRTLVVPCRHEVELVGRASVNQGGSTGISGTACLAKAYAQMWLLLYFHRRDLRILGMAICSAVPANWVPTGRTTWSLHA

SEQ ID NO: 12072 - protein, 337 aa, unidentified; identical to SEQ ID NO: 8339

SEQ ID NO: 12073 - protein, 337 aa, unidentified; identical to SEQ ID NO: 8339

SEQ ID NO: 12074 - protein, 337 aa, unidentified; identical to SEQ ID NO: 8339

SEQ ID NO: 12075 - protein, 72 aa, unidentified
CPIIHCKYSKAENCRLSMGVNSKSHYILRSGLLKYNLSLGGDIILQFIEIADNRLTIGSPSKIYNSLGQPVF

SEQ ID NO: 12076 - protein, 319 aa, unidentified; identical to SEQ ID NO: 8681

SEQ ID NO: 12077 - protein, 337 aa, unidentified; identical to SEQ ID NO: 8339

SEQ ID NO: 12078 - protein, 337 aa, unidentified; identical to SEQ ID NO: 8339

SEQ ID NO: 12079 - protein, 337 aa, unidentified; identical to SEQ ID NO: 8339

SEQ ID NO: 12080 - protein, 337 aa, unidentified; identical to SEQ ID NO: 8339

SEQ ID NO: 12081 - protein, 333 aa, unidentified; identical to SEQ ID NO: 8351

SEQ ID NO: 12082 - protein, 19 aa, unidentified
DLETHFTQYKLARPYIADC

SEQ ID NO: 12083 - protein, 337 aa, unidentified; identical to SEQ ID NO: 8339

SEQ ID NO: 12084 - protein, 333 aa, unidentified; identical to SEQ ID NO: 8351

SEQ ID NO: 12085 - protein, 337 aa, unidentified; identical to SEQ ID NO: 8339

SEQ ID NO: 12086 - protein, 337 aa, unidentified; identical to SEQ ID NO: 8339

SEQ ID NO: 12087 - protein, 337 aa, unidentified; identical to SEQ ID NO: 8339

SEQ ID NO: 12088 - protein, 337 aa, unidentified; identical to SEQ ID NO: 8339

SEQ ID NO: 12089 - protein, 99 aa, unidentified
YRKFLDTVTGNMLTPHVIRTKCTNWMTGLHLGEELLAHEGKLPITYCRAIHEYGNPQDSIEERVLWENQHKNYPYYDPSCPMDLLDEALAKEDEGIWTG

SEQ ID NO: 12090 - protein, 292 aa, unidentified; identical to SEQ ID NO: 9890

SEQ ID NO: 12091 - protein, 262 aa, unidentified; identical to SEQ ID NO: 9207

SEQ ID NO: 12092 - protein, 337 aa, unidentified; identical to SEQ ID NO: 8339

SEQ ID NO: 12093 - protein, 337 aa, unidentified; identical to SEQ ID NO: 8339

SEQ ID NO: 12094 - protein, 333 aa, unidentified; identical to SEQ ID NO: 8351

SEQ ID NO: 12095 - protein, 337 aa, unidentified; identical to SEQ ID NO: 8339

SEQ ID NO: 12096 - protein, 337 aa, unidentified; identical to SEQ ID NO: 8339

SEQ ID NO: 12097 - protein, 337 aa, unidentified; identical to SEQ ID NO: 8339

SEQ ID NO: 12098 - protein, 337 aa, unidentified; identical to SEQ ID NO: 8339

SEQ ID NO: 12099 - protein, 337 aa, unidentified; identical to SEQ ID NO: 8339

SEQ ID NO: 12100 - protein, 243 aa, unidentified; identical to SEQ ID NO: 8643

SEQ ID NO: 12101 - protein, 337 aa, unidentified; identical to SEQ ID NO: 8339

SEQ ID NO: 12102 - protein, 266 aa, unidentified
LYADDTAGWDTRITMADLEDEYTLTELMEGEHKKLAETLFNFAYKNKVALCPRPGKNGGTVLDVISRTDQRGSGQVVTYALNTLTNIKVQLIRMAESEGVLDEEFHDNGMLKWLEKHGRDRLQRLMVSGDDCVVNAIDERFGKSLVWLNEMQKIRKDIDLWKPSAGHCNWEEVEFCSNHFHKLVMRDGRTLVVPCRHEVELVGRASVNQGGSTGISGTACLAKAYAQMWLLLYFHRRDLRILGMAICSAVPANWVPTGRTTWSLHA

SEQ ID NO: 12103 - protein, 337 aa, unidentified; identical to SEQ ID NO: 8339

SEQ ID NO: 12104 - protein, 337 aa, unidentified; identical to SEQ ID NO: 8339

SEQ ID NO: 12105 - protein, 337 aa, unidentified; identical to SEQ ID NO: 8339

SEQ ID NO: 12106 - protein, 337 aa, unidentified; identical to SEQ ID NO: 8339

SEQ ID NO: 12107 - protein, 337 aa, unidentified; identical to SEQ ID NO: 8339

SEQ ID NO: 12108 - protein, 223 aa, unidentified
KPGEFGVAKGSRTIWYMWLGSRFLEFEALGFLNEERWASRDISGGGVEGIGINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTR

SEQ ID NO: 12109 - protein, 337 aa, unidentified; identical to SEQ ID NO: 8339

SEQ ID NO: 12110 - protein, 337 aa, unidentified; identical to SEQ ID NO: 8339

SEQ ID NO: 12111 - protein, 337 aa, unidentified; identical to SEQ ID NO: 8339

SEQ ID NO: 12112 - protein, 337 aa, unidentified; identical to SEQ ID NO: 8339

SEQ ID NO: 12113 - protein, 305 aa, unidentified
NEERWASRDISGGGVEGIGINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCSHHFHELFLRDGRKLIVPCRDQHELVGRSMVSQGGSSGVAGTACLAKAYAQMWLMSYFHRRDLRTLGFGIMSSVPKDWFPTGRTTWSVHANHE

SEQ ID NO: 12114 - protein, 337 aa, unidentified; identical to SEQ ID NO: 8339

SEQ ID NO: 12115 - protein, 333 aa, unidentified; identical to SEQ ID NO: 8351

SEQ ID NO: 12116 - protein, 337 aa, unidentified; identical to SEQ ID NO: 8339

SEQ ID NO: 12117 - protein, 337 aa, unidentified; identical to SEQ ID NO: 8339

SEQ ID NO: 12118 - protein, 337 aa, unidentified; identical to SEQ ID NO: 8339

SEQ ID NO: 12119 - protein, 337 aa, unidentified; identical to SEQ ID NO: 8339

SEQ ID NO: 12120 - protein, 337 aa, unidentified; identical to SEQ ID NO: 8339

SEQ ID NO: 12121 - protein, 337 aa, unidentified; identical to SEQ ID NO: 8339

SEQ ID NO: 12122 - protein, 337 aa, unidentified; identical to SEQ ID NO: 8339

SEQ ID NO: 12123 - protein, 337 aa, unidentified; identical to SEQ ID NO: 8339

SEQ ID NO: 12124 - protein, 333 aa, unidentified; identical to SEQ ID NO: 8351

SEQ ID NO: 12125 - protein, 333 aa, unidentified; identical to SEQ ID NO: 8351

SEQ ID NO: 12126 - protein, 337 aa, unidentified; identical to SEQ ID NO: 8339

SEQ ID NO: 12127 - protein, 337 aa, unidentified; identical to SEQ ID NO: 8339

SEQ ID NO: 12128 - protein, 337 aa, unidentified; identical to SEQ ID NO: 8339

SEQ ID NO: 12129 - protein, 337 aa, unidentified; identical to SEQ ID NO: 8339

SEQ ID NO: 12130 - protein, 337 aa, unidentified; identical to SEQ ID NO: 8339

SEQ ID NO: 12131 - protein, 337 aa, unidentified; identical to SEQ ID NO: 8339

SEQ ID NO: 12132 - protein, 337 aa, unidentified; identical to SEQ ID NO: 8339

SEQ ID NO: 12133 - protein, 266 aa, unidentified; identical to SEQ ID NO: 12102

SEQ ID NO: 12134 - protein, 337 aa, unidentified; identical to SEQ ID NO: 8339

SEQ ID NO: 12135 - protein, 337 aa, unidentified; identical to SEQ ID NO: 8339

SEQ ID NO: 12136 - protein, 337 aa, unidentified; identical to SEQ ID NO: 8339

SEQ ID NO: 12137 - protein, 318 aa, unidentified
GSRFLEFEALGFLNEERWASRDISGGGVEGIGINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCSHHFHELFLRDGRKLIVPCRDQHELVGRSMVSQGGSSGVAGTACLAKAYAQMWLMSYFHRRDLRTLGFGIMSSVPKDWFPTGRTTWSVHANHE

SEQ ID NO: 12138 - protein, 337 aa, unidentified; identical to SEQ ID NO: 8339

SEQ ID NO: 12139 - protein, 337 aa, unidentified; identical to SEQ ID NO: 8339

SEQ ID NO: 12140 - protein, 337 aa, unidentified; identical to SEQ ID NO: 8339

SEQ ID NO: 12141 - protein, 337 aa, unidentified; identical to SEQ ID NO: 8339

SEQ ID NO: 12142 - protein, 337 aa, unidentified; identical to SEQ ID NO: 8339

SEQ ID NO: 12143 - protein, 337 aa, unidentified; identical to SEQ ID NO: 8339

SEQ ID NO: 12144 - protein, 337 aa, unidentified; identical to SEQ ID NO: 8339

SEQ ID NO: 12145 - protein, 337 aa, unidentified; identical to SEQ ID NO: 8339

SEQ ID NO: 12146 - protein, 337 aa, unidentified; identical to SEQ ID NO: 8339

SEQ ID NO: 12147 - protein, 337 aa, unidentified; identical to SEQ ID NO: 8339

SEQ ID NO: 12148 - protein, 337 aa, unidentified; identical to SEQ ID NO: 8339

SEQ ID NO: 12149 - protein, 337 aa, unidentified; identical to SEQ ID NO: 8339

SEQ ID NO: 12150 - protein, 337 aa, unidentified; identical to SEQ ID NO: 8339

SEQ ID NO: 12151 - protein, 291 aa, unidentified
VEGIGINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCSHHFHELFLRDGRKLIVPCRDQHELVGRSMVSQGGSSGVAGTACLAKAYAQMWLMSYFHRRDLRTLGFGIMSSVPKDWFPTGRTTWSVHANHE

SEQ ID NO: 12152 - protein, 337 aa, unidentified; identical to SEQ ID NO: 8339

SEQ ID NO: 12153 - protein, 337 aa, unidentified; identical to SEQ ID NO: 8339

SEQ ID NO: 12154 - protein, 337 aa, unidentified; identical to SEQ ID NO: 8339

SEQ ID NO: 12155 - protein, 337 aa, unidentified; identical to SEQ ID NO: 8339

SEQ ID NO: 12156 - protein, 337 aa, unidentified; identical to SEQ ID NO: 8339

SEQ ID NO: 12157 - protein, 333 aa, unidentified; identical to SEQ ID NO: 8351

SEQ ID NO: 12158 - protein, 337 aa, unidentified; identical to SEQ ID NO: 8339

SEQ ID NO: 12159 - protein, 337 aa, unidentified; identical to SEQ ID NO: 8339

SEQ ID NO: 12160 - protein, 337 aa, unidentified; identical to SEQ ID NO: 8339

SEQ ID NO: 12161 - protein, 337 aa, unidentified; identical to SEQ ID NO: 8339

SEQ ID NO: 12162 - protein, 337 aa, unidentified; identical to SEQ ID NO: 8339

SEQ ID NO: 12163 - protein, 337 aa, unidentified; identical to SEQ ID NO: 8339

SEQ ID NO: 12164 - protein, 337 aa, unidentified; identical to SEQ ID NO: 8339

SEQ ID NO: 12165 - protein, 337 aa, unidentified; identical to SEQ ID NO: 8339

SEQ ID NO: 12166 - protein, 337 aa, unidentified; identical to SEQ ID NO: 8339

SEQ ID NO: 12167 - protein, 333 aa, unidentified; identical to SEQ ID NO: 8351

SEQ ID NO: 12168 - protein, 337 aa, unidentified; identical to SEQ ID NO: 8339

SEQ ID NO: 12169 - protein, 337 aa, unidentified; identical to SEQ ID NO: 8339

SEQ ID NO: 12170 - protein, 337 aa, unidentified; identical to SEQ ID NO: 8339

SEQ ID NO: 12171 - protein, 337 aa, unidentified; identical to SEQ ID NO: 8339

SEQ ID NO: 12172 - protein, 337 aa, unidentified; identical to SEQ ID NO: 8339

SEQ ID NO: 12173 - protein, 337 aa, unidentified; identical to SEQ ID NO: 8339

SEQ ID NO: 12174 - protein, 333 aa, unidentified; identical to SEQ ID NO: 8351

SEQ ID NO: 12175 - protein, 337 aa, unidentified; identical to SEQ ID NO: 8339

SEQ ID NO: 12176 - protein, 337 aa, unidentified; identical to SEQ ID NO: 8339

SEQ ID NO: 12177 - protein, 337 aa, unidentified; identical to SEQ ID NO: 8339

SEQ ID NO: 12178 - protein, 337 aa, unidentified; identical to SEQ ID NO: 8339

SEQ ID NO: 12179 - protein, 337 aa, unidentified; identical to SEQ ID NO: 8339

SEQ ID NO: 12180 - protein, 337 aa, unidentified; identical to SEQ ID NO: 8339

SEQ ID NO: 12181 - protein, 337 aa, unidentified; identical to SEQ ID NO: 8339

SEQ ID NO: 12182 - protein, 337 aa, unidentified; identical to SEQ ID NO: 8339

SEQ ID NO: 12183 - protein, 337 aa, unidentified; identical to SEQ ID NO: 8339

SEQ ID NO: 12184 - protein, 337 aa, unidentified; identical to SEQ ID NO: 8339

SEQ ID NO: 12185 - protein, 337 aa, unidentified; identical to SEQ ID NO: 8339

SEQ ID NO: 12186 - protein, 337 aa, unidentified; identical to SEQ ID NO: 8339

SEQ ID NO: 12187 - protein, 333 aa, unidentified; identical to SEQ ID NO: 8351

SEQ ID NO: 12188 - protein, 337 aa, unidentified; identical to SEQ ID NO: 8339

SEQ ID NO: 12189 - protein, 333 aa, unidentified; identical to SEQ ID NO: 8351

SEQ ID NO: 12190 - protein, 337 aa, unidentified; identical to SEQ ID NO: 8339

SEQ ID NO: 12191 - protein, 337 aa, unidentified; identical to SEQ ID NO: 8339

SEQ ID NO: 12192 - protein, 337 aa, unidentified; identical to SEQ ID NO: 8339

SEQ ID NO: 12193 - protein, 337 aa, unidentified; identical to SEQ ID NO: 8339

SEQ ID NO: 12194 - protein, 337 aa, unidentified; identical to SEQ ID NO: 8339

SEQ ID NO: 12195 - protein, 337 aa, unidentified; identical to SEQ ID NO: 8339

SEQ ID NO: 12196 - protein, 264 aa, unidentified; identical to SEQ ID NO: 11150

SEQ ID NO: 12197 - protein, 337 aa, unidentified; identical to SEQ ID NO: 8339

SEQ ID NO: 12198 - protein, 337 aa, unidentified; identical to SEQ ID NO: 8339

SEQ ID NO: 12199 - protein, 337 aa, unidentified; identical to SEQ ID NO: 8339

SEQ ID NO: 12200 - protein, 305 aa, unidentified
NEEHWASRELSGGGVEGIPLNYLGYHLREMAQKPGVLYADDTAGWDTRITMADLEDEGILLDMMSGEHKKLASALFSKAYKVKVALCPRPGPKGGTLMDVISRTDQRGSGQVVTYALNTLTNIKVQLIRMAEAEGVLGATFEDFGIDRWLQEHGEDRVERMLVSGDDCVVNAIDERFGSSLNWLNAMEKVRKDIDLWKPSPSFRNWERVEFCSNHFHEMTMKDGRVIVAPCRGQTELIARGTVNQGGCVGVESTGCLAKAYAQMWLLLYFHRRDLRTLALAVMSAVPSNWIPTGRTTWSLMVKGE

SEQ ID NO: 12201 - protein, 337 aa, unidentified; identical to SEQ ID NO: 8339

SEQ ID NO: 12202 - protein, 337 aa, unidentified; identical to SEQ ID NO: 8339

SEQ ID NO: 12203 - protein, 337 aa, unidentified; identical to SEQ ID NO: 8339

SEQ ID NO: 12204 - protein, 337 aa, unidentified; identical to SEQ ID NO: 8339

SEQ ID NO: 12205 - protein, 337 aa, unidentified; identical to SEQ ID NO: 8339

SEQ ID NO: 12206 - protein, 270 aa, unidentified; identical to SEQ ID NO: 8331

SEQ ID NO: 12207 - protein, 337 aa, unidentified; identical to SEQ ID NO: 8339

SEQ ID NO: 12208 - protein, 241 aa, unidentified
KPGEFGVAKGSRTIWYMWLGSRFLEFEALGFLNEERWASRDISGGGVEGIGINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEV

SEQ ID NO: 12209 - protein, 337 aa, unidentified; identical to SEQ ID NO: 8339

SEQ ID NO: 12210 - protein, 337 aa, unidentified; identical to SEQ ID NO: 8339

SEQ ID NO: 12211 - protein, 337 aa, unidentified; identical to SEQ ID NO: 8339

SEQ ID NO: 12212 - protein, 337 aa, unidentified; identical to SEQ ID NO: 8339

SEQ ID NO: 12213 - protein, 337 aa, unidentified; identical to SEQ ID NO: 8339

SEQ ID NO: 12214 - protein, 337 aa, unidentified; identical to SEQ ID NO: 8339

SEQ ID NO: 12215 - protein, 333 aa, unidentified; identical to SEQ ID NO: 8351

SEQ ID NO: 12216 - protein, 337 aa, unidentified; identical to SEQ ID NO: 8339

SEQ ID NO: 12217 - protein, 337 aa, unidentified; identical to SEQ ID NO: 8339

SEQ ID NO: 12218 - protein, 270 aa, unidentified; identical to SEQ ID NO: 8331

SEQ ID NO: 12219 - protein, 337 aa, unidentified; identical to SEQ ID NO: 8339

SEQ ID NO: 12220 - protein, 337 aa, unidentified; identical to SEQ ID NO: 8339

SEQ ID NO: 12221 - protein, 305 aa, unidentified; identical to SEQ ID NO: 12113

SEQ ID NO: 12222 - protein, 337 aa, unidentified; identical to SEQ ID NO: 8339

SEQ ID NO: 12223 - protein, 337 aa, unidentified; identical to SEQ ID NO: 8339

SEQ ID NO: 12224 - protein, 304 aa, unidentified
GFLNEEHWASRELCGGGVEGIPLFYLGYHLEKMAEKAGILYADDTAGWDTRITMADLEDEYTLTELMEGEHKKLAETLFNFAYKNKVALCPRPGKNGGTVLDVISRTDQRGSGQVVTYALNTLTNIKVQLIRMAESEGVLDEEFHDNGMLKWLEKHGRDRLQRLMVSGDDCVVNAIDERFGKSLVWLNEMQKIRKDIDLWKPSAGHCNWEEVEFCSNHFHKLVMRDGRTLVVPCRHEVELVGRASVNQGGSTGISGTACLAKAYAQMWLLLYFHRRDLRILGMAICSAVPANWVPTGRTTWSLH

SEQ ID NO: 12225 - protein, 337 aa, unidentified; identical to SEQ ID NO: 8339

SEQ ID NO: 12226 - protein, 337 aa, unidentified; identical to SEQ ID NO: 8339

SEQ ID NO: 12227 - protein, 337 aa, unidentified; identical to SEQ ID NO: 8339

SEQ ID NO: 12228 - protein, 337 aa, unidentified; identical to SEQ ID NO: 8339

SEQ ID NO: 12229 - protein, 337 aa, unidentified; identical to SEQ ID NO: 8339

SEQ ID NO: 12230 - protein, 337 aa, unidentified; identical to SEQ ID NO: 8339

SEQ ID NO: 12231 - protein, 295 aa, unidentified; identical to SEQ ID NO: 9624

SEQ ID NO: 12232 - protein, 337 aa, unidentified; identical to SEQ ID NO: 8339

SEQ ID NO: 12233 - protein, 337 aa, unidentified; identical to SEQ ID NO: 8339

SEQ ID NO: 12234 - protein, 337 aa, unidentified; identical to SEQ ID NO: 8339

SEQ ID NO: 12235 - protein, 337 aa, unidentified; identical to SEQ ID NO: 8339

SEQ ID NO: 12236 - protein, 337 aa, unidentified; identical to SEQ ID NO: 8339

SEQ ID NO: 12237 - protein, 337 aa, unidentified; identical to SEQ ID NO: 8339

SEQ ID NO: 12238 - protein, 337 aa, unidentified; identical to SEQ ID NO: 8339

SEQ ID NO: 12239 - protein, 333 aa, unidentified; identical to SEQ ID NO: 8351

SEQ ID NO: 12240 - protein, 337 aa, unidentified; identical to SEQ ID NO: 8339

SEQ ID NO: 12241 - protein, 318 aa, unidentified; identical to SEQ ID NO: 12137

SEQ ID NO: 12242 - protein, 337 aa, unidentified; identical to SEQ ID NO: 8339

SEQ ID NO: 12243 - protein, 337 aa, unidentified; identical to SEQ ID NO: 8339

SEQ ID NO: 12244 - protein, 337 aa, unidentified; identical to SEQ ID NO: 8339

SEQ ID NO: 12245 - protein, 337 aa, unidentified; identical to SEQ ID NO: 8339

SEQ ID NO: 12246 - protein, 337 aa, unidentified; identical to SEQ ID NO: 8339

SEQ ID NO: 12247 - protein, 337 aa, unidentified; identical to SEQ ID NO: 8339

SEQ ID NO: 12248 - protein, 333 aa, unidentified; identical to SEQ ID NO: 8351

SEQ ID NO: 12249 - protein, 333 aa, unidentified; identical to SEQ ID NO: 8351

SEQ ID NO: 12250 - protein, 337 aa, unidentified; identical to SEQ ID NO: 8339

SEQ ID NO: 12251 - protein, 333 aa, unidentified; identical to SEQ ID NO: 8351

SEQ ID NO: 12252 - protein, 337 aa, unidentified; identical to SEQ ID NO: 8339

SEQ ID NO: 12253 - protein, 209 aa, unidentified; identical to SEQ ID NO: 9505

SEQ ID NO: 12254 - protein, 337 aa, unidentified; identical to SEQ ID NO: 8339

SEQ ID NO: 12255 - protein, 333 aa, unidentified; identical to SEQ ID NO: 8351

SEQ ID NO: 12256 - protein, 337 aa, unidentified; identical to SEQ ID NO: 8339

SEQ ID NO: 12257 - protein, 261 aa, unidentified; identical to SEQ ID NO: 11471

SEQ ID NO: 12258 - protein, 337 aa, unidentified; identical to SEQ ID NO: 8339

SEQ ID NO: 12259 - protein, 337 aa, unidentified; identical to SEQ ID NO: 8339

SEQ ID NO: 12260 - protein, 283 aa, unidentified; identical to SEQ ID NO: 9339

SEQ ID NO: 12261 - protein, 333 aa, unidentified; identical to SEQ ID NO: 8351

SEQ ID NO: 12262 - protein, 337 aa, unidentified; identical to SEQ ID NO: 8339

SEQ ID NO: 12263 - protein, 337 aa, unidentified; identical to SEQ ID NO: 8339

SEQ ID NO: 12264 - protein, 333 aa, unidentified; identical to SEQ ID NO: 8351

SEQ ID NO: 12265 - protein, 337 aa, unidentified; identical to SEQ ID NO: 8339

SEQ ID NO: 12266 - protein, 337 aa, unidentified; identical to SEQ ID NO: 8339

SEQ ID NO: 12267 - protein, 337 aa, unidentified; identical to SEQ ID NO: 8339

SEQ ID NO: 12268 - protein, 337 aa, unidentified; identical to SEQ ID NO: 8339

SEQ ID NO: 12269 - protein, 337 aa, unidentified; identical to SEQ ID NO: 8339

SEQ ID NO: 12270 - protein, 231 aa, unidentified; identical to SEQ ID NO: 9315

SEQ ID NO: 12271 - protein, 337 aa, unidentified; identical to SEQ ID NO: 8339

SEQ ID NO: 12272 - protein, 213 aa, unidentified
KPGEFGVAKGSRTIWYMWLGSRFLEFEALGFLNEERWASRDISGGGVEGIGINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRAL

SEQ ID NO: 12273 - protein, 333 aa, unidentified; identical to SEQ ID NO: 8351

SEQ ID NO: 12274 - protein, 333 aa, unidentified; identical to SEQ ID NO: 8351

SEQ ID NO: 12275 - protein, 337 aa, unidentified; identical to SEQ ID NO: 8339

SEQ ID NO: 12276 - protein, 337 aa, unidentified; identical to SEQ ID NO: 8339

SEQ ID NO: 12277 - protein, 337 aa, unidentified; identical to SEQ ID NO: 8339

SEQ ID NO: 12278 - protein, 337 aa, unidentified; identical to SEQ ID NO: 8339

SEQ ID NO: 12279 - protein, 337 aa, unidentified; identical to SEQ ID NO: 8339

SEQ ID NO: 12280 - protein, 337 aa, unidentified; identical to SEQ ID NO: 8339

SEQ ID NO: 12281 - protein, 337 aa, unidentified; identical to SEQ ID NO: 8339

SEQ ID NO: 12282 - protein, 337 aa, unidentified; identical to SEQ ID NO: 8339

SEQ ID NO: 12283 - protein, 337 aa, unidentified; identical to SEQ ID NO: 8339

SEQ ID NO: 12284 - protein, 337 aa, unidentified; identical to SEQ ID NO: 8339

SEQ ID NO: 12285 - protein, 223 aa, unidentified; identical to SEQ ID NO: 12108

SEQ ID NO: 12286 - protein, 337 aa, unidentified; identical to SEQ ID NO: 8339

SEQ ID NO: 12287 - protein, 337 aa, unidentified; identical to SEQ ID NO: 8339

SEQ ID NO: 12288 - protein, 337 aa, unidentified; identical to SEQ ID NO: 8339

SEQ ID NO: 12289 - protein, 333 aa, unidentified; identical to SEQ ID NO: 8351

SEQ ID NO: 12290 - protein, 251 aa, unidentified; identical to SEQ ID NO: 8663

SEQ ID NO: 12291 - protein, 333 aa, unidentified; identical to SEQ ID NO: 8351

SEQ ID NO: 12292 - protein, 337 aa, unidentified; identical to SEQ ID NO: 8339

SEQ ID NO: 12293 - protein, 337 aa, unidentified; identical to SEQ ID NO: 8339

SEQ ID NO: 12294 - protein, 337 aa, unidentified; identical to SEQ ID NO: 8339

SEQ ID NO: 12295 - protein, 209 aa, unidentified; identical to SEQ ID NO: 9505

SEQ ID NO: 12296 - protein, 337 aa, unidentified; identical to SEQ ID NO: 8339

SEQ ID NO: 12297 - protein, 333 aa, unidentified; identical to SEQ ID NO: 8351

SEQ ID NO: 12298 - protein, 333 aa, unidentified; identical to SEQ ID NO: 8351

SEQ ID NO: 12299 - protein, 337 aa, unidentified; identical to SEQ ID NO: 8339

SEQ ID NO: 12300 - protein, 333 aa, unidentified; identical to SEQ ID NO: 8351

SEQ ID NO: 12301 - protein, 333 aa, unidentified; identical to SEQ ID NO: 8351

SEQ ID NO: 12302 - protein, 337 aa, unidentified; identical to SEQ ID NO: 8339

SEQ ID NO: 12303 - protein, 337 aa, unidentified; identical to SEQ ID NO: 8339

SEQ ID NO: 12304 - protein, 333 aa, unidentified; identical to SEQ ID NO: 8351

SEQ ID NO: 12305 - protein, 337 aa, unidentified; identical to SEQ ID NO: 8339

SEQ ID NO: 12306 - protein, 333 aa, unidentified; identical to SEQ ID NO: 8351

SEQ ID NO: 12307 - protein, 293 aa, unidentified
SRTIWYMWLGSRFLEFESFGFLNEEHWASRELSGGGVESIPLFYLGYHLREMAKKPGKLYADDTAGWDTRITEADLDDECILCDYMEDEHKQLALSLFELCYKNKVALCPRPGRHGGTVMDVIFRRDQRGSGQVVTYALNTLTNIKVQLIRLAESEGVLDEDFNDHGIETWLNHYGEERLSRLLISGDDCLVNAFDERFGKALTWLNTMEKIRKDIDLCAPSNGYENFEKVEFCSNHFHELMLKDGRQLVVPCRSQNELVGRASVNQGGSATVAGTACLAKAYAQMWNLLYFH

SEQ ID NO: 12308 - protein, 333 aa, unidentified; identical to SEQ ID NO: 8351

SEQ ID NO: 12309 - protein, 258 aa, unidentified
IWYMWLGSRFLEFEALGFLNEERWASRDISGGGVEGIGINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCSHHFHELFLRDGRKLIVPCRDQHELVG

SEQ ID NO: 12310 - protein, 333 aa, unidentified; identical to SEQ ID NO: 8351

SEQ ID NO: 12311 - protein, 333 aa, unidentified; identical to SEQ ID NO: 8351

SEQ ID NO: 12312 - protein, 333 aa, unidentified; identical to SEQ ID NO: 8351

SEQ ID NO: 12313 - protein, 337 aa, unidentified; identical to SEQ ID NO: 8339

SEQ ID NO: 12314 - protein, 275 aa, unidentified; identical to SEQ ID NO: 11524

SEQ ID NO: 12315 - protein, 333 aa, unidentified; identical to SEQ ID NO: 8351

SEQ ID NO: 12316 - protein, 333 aa, unidentified; identical to SEQ ID NO: 8351

SEQ ID NO: 12317 - protein, 261 aa, unidentified; identical to SEQ ID NO: 11471

SEQ ID NO: 12318 - protein, 333 aa, unidentified; identical to SEQ ID NO: 8351

SEQ ID NO: 12319 - protein, 333 aa, unidentified; identical to SEQ ID NO: 8351

SEQ ID NO: 12320 - protein, 217 aa, unidentified; identical to SEQ ID NO: 10987

SEQ ID NO: 12321 - protein, 333 aa, unidentified; identical to SEQ ID NO: 8351

SEQ ID NO: 12322 - protein, 333 aa, unidentified; identical to SEQ ID NO: 8351

SEQ ID NO: 12323 - protein, 333 aa, unidentified; identical to SEQ ID NO: 8351

SEQ ID NO: 12324 - protein, 333 aa, unidentified; identical to SEQ ID NO: 8351

SEQ ID NO: 12325 - protein, 333 aa, unidentified; identical to SEQ ID NO: 8351

SEQ ID NO: 12326 - protein, 332 aa, unidentified; identical to SEQ ID NO: 9622

SEQ ID NO: 12327 - protein, 333 aa, unidentified; identical to SEQ ID NO: 8351

SEQ ID NO: 12328 - protein, 333 aa, unidentified; identical to SEQ ID NO: 8351

SEQ ID NO: 12329 - protein, 333 aa, unidentified; identical to SEQ ID NO: 8351

SEQ ID NO: 12330 - protein, 273 aa, unidentified; identical to SEQ ID NO: 11142

SEQ ID NO: 12331 - protein, 337 aa, unidentified; identical to SEQ ID NO: 8339

SEQ ID NO: 12332 - protein, 333 aa, unidentified; identical to SEQ ID NO: 8351

SEQ ID NO: 12333 - protein, 337 aa, unidentified; identical to SEQ ID NO: 8339

SEQ ID NO: 12334 - protein, 333 aa, unidentified; identical to SEQ ID NO: 8351

SEQ ID NO: 12335 - protein, 333 aa, unidentified; identical to SEQ ID NO: 8351

SEQ ID NO: 12336 - protein, 333 aa, unidentified; identical to SEQ ID NO: 8351

SEQ ID NO: 12337 - protein, 288 aa, unidentified
KPGEFGVAKGSRTIWYMWLGSRFLEFEALGFLNEERWASRDISGGGVEGIGINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCSHHFHELFLRDGRKLIVPCRDQHELVGRSMVSQGGSSGVAGTAC

SEQ ID NO: 12338 - protein, 333 aa, unidentified; identical to SEQ ID NO: 8351

SEQ ID NO: 12339 - protein, 270 aa, unidentified; identical to SEQ ID NO: 8331

SEQ ID NO: 12340 - protein, 330 aa, unidentified
AKGSRTIWYMWLGSRFLEFEALGFLNEERWASRDISGGGVEGIGINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCSHHFHELFLRDGRKLIVPCRDQHELVGRSMVSQGGSSGVAGTACLAKAYAQMWLMSYFHRRDLRTLGFGIMSSVPKDWFPTGRTTWSVHANHE

SEQ ID NO: 12341 - protein, 233 aa, unidentified
KPGEFGVAKGSRTIWYMWLGSRFLEFEALGFLNEERWASRDISGGGVEGIGINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSR

SEQ ID NO: 12342 - protein, 231 aa, unidentified; identical to SEQ ID NO: 9315

SEQ ID NO: 12343 - protein, 333 aa, unidentified; identical to SEQ ID NO: 8351

SEQ ID NO: 12344 - protein, 337 aa, unidentified; identical to SEQ ID NO: 8339

SEQ ID NO: 12345 - protein, 337 aa, unidentified; identical to SEQ ID NO: 8339

SEQ ID NO: 12346 - protein, 337 aa, unidentified; identical to SEQ ID NO: 8339

SEQ ID NO: 12347 - protein, 309 aa, unidentified
SRTIWYMWLGSRFLEFEALGFLNEERWASRDISGGGVEGIGINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCSHHFHELFLRDGRKLIVPCRDQHELVGRSMVSQGGSSGVAGTACLAKAYAQMWLMSYFHRRDLRTLGFGIMSSVP

SEQ ID NO: 12348 - protein, 337 aa, unidentified; identical to SEQ ID NO: 8339

SEQ ID NO: 12349 - protein, 317 aa, unidentified
KGSRTIWYMWLGSRFLEFESFGFLNEEHWASRELSGGGVESIPLFYLGYHLREMAKKPGKLYADDTAGWDTRITEADLDDECILCDYMEDEHKQLALSLFELCYKNKVALCPRPGRHGGTVMDVIFRRDQRGSGQVVTYALNTLTNIKVQLIRLAESEGVLDEDFNDHGIETWLNHYGEERLSRLLISGDDCLVNAFDERFGKALTWLNTMEKIRKDIDLCAPSNGYENFEKVEFCSNHFHELMLKDGRQLVVPCRSQNELVGRASVNQGGSATVAGTACLAKAYAQMWNLLYFHRRDLRLLGFAIMSATPSNWIPT

SEQ ID NO: 12350 - protein, 309 aa, unidentified; identical to SEQ ID NO: 12347

SEQ ID NO: 12351 - protein, 311 aa, unidentified
SRTIWYMWLGSRFLEFESFGFLNEEHWASRELSGGGVESIPLFYLGYHLREMAKKPGKLYADDTAGWDTRITEADLDDECILCDYMEDEHKQLALSLFELCYKNKVALCPRPGRHGGTVMDVIFRRDQRGSGQVVTYALNTLTNIKVQLIRLAESEGVLDEDFNDHGIETWLNHYGEERLSRLLISGDDCLVNAFDERFGKALTWLNTMEKIRKDIDLCAPSNGYENFEKVEFCSNHFHELMLKDGRQLVVPCRSQNELVGRASVNQGGSATVAGTACLAKAYAQMWNLLYFHRRDLRLLGFAIMSATPSN

SEQ ID NO: 12352 - protein, 337 aa, unidentified; identical to SEQ ID NO: 8339

SEQ ID NO: 12353 - protein, 337 aa, unidentified; identical to SEQ ID NO: 8339

SEQ ID NO: 12354 - protein, 309 aa, unidentified; identical to SEQ ID NO: 12347

SEQ ID NO: 12355 - protein, 337 aa, unidentified; identical to SEQ ID NO: 8339

SEQ ID NO: 12356 - protein, 310 aa, unidentified; identical to SEQ ID NO: 8697

SEQ ID NO: 12357 - protein, 337 aa, unidentified; identical to SEQ ID NO: 8339

SEQ ID NO: 12358 - protein, 337 aa, unidentified; identical to SEQ ID NO: 8339

SEQ ID NO: 12359 - protein, 337 aa, unidentified; identical to SEQ ID NO: 8339

SEQ ID NO: 12360 - protein, 272 aa, unidentified; identical to SEQ ID NO: 11824

SEQ ID NO: 12361 - protein, 337 aa, unidentified; identical to SEQ ID NO: 8339

SEQ ID NO: 12362 - protein, 337 aa, unidentified; identical to SEQ ID NO: 8339

SEQ ID NO: 12363 - protein, 337 aa, unidentified; identical to SEQ ID NO: 8339

SEQ ID NO: 12364 - protein, 337 aa, unidentified; identical to SEQ ID NO: 8339

SEQ ID NO: 12365 - protein, 337 aa, unidentified; identical to SEQ ID NO: 8339

SEQ ID NO: 12366 - protein, 337 aa, unidentified; identical to SEQ ID NO: 8339

SEQ ID NO: 12367 - protein, 337 aa, unidentified; identical to SEQ ID NO: 8339

SEQ ID NO: 12368 - protein, 337 aa, unidentified; identical to SEQ ID NO: 8339

SEQ ID NO: 12369 - protein, 337 aa, unidentified; identical to SEQ ID NO: 8339

SEQ ID NO: 12370 - protein, 337 aa, unidentified; identical to SEQ ID NO: 8339

SEQ ID NO: 12371 - protein, 232 aa, unidentified; identical to SEQ ID NO: 10022

SEQ ID NO: 12372 - protein, 97 aa, unidentified
SIERRGEYADMNLRERCLDAIDRITNENTVTLRTLGHFMPRSPGRHPVYILINSTLMCGSAKYKEYTGSLDNDNLWTLLKNSLWVHWADDNHLSYNG

SEQ ID NO: 12373 - protein, 337 aa, unidentified; identical to SEQ ID NO: 8339

SEQ ID NO: 12374 - protein, 337 aa, unidentified; identical to SEQ ID NO: 8339

SEQ ID NO: 12375 - protein, 202 aa, unidentified
LYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCSHHFHELFLRDGRKLIVPCRDQHELV

SEQ ID NO: 12376 - protein, 337 aa, unidentified; identical to SEQ ID NO: 8339

SEQ ID NO: 12377 - protein, 337 aa, unidentified; identical to SEQ ID NO: 8339

SEQ ID NO: 12378 - protein, 337 aa, unidentified; identical to SEQ ID NO: 8339

SEQ ID NO: 12379 - protein, 266 aa, unidentified; identical to SEQ ID NO: 10749

SEQ ID NO: 12380 - protein, 337 aa, unidentified; identical to SEQ ID NO: 8339

SEQ ID NO: 12381 - protein, 337 aa, unidentified; identical to SEQ ID NO: 8339

SEQ ID NO: 12382 - protein, 337 aa, unidentified; identical to SEQ ID NO: 8339

SEQ ID NO: 12383 - protein, 337 aa, unidentified; identical to SEQ ID NO: 8339

SEQ ID NO: 12384 - protein, 337 aa, unidentified; identical to SEQ ID NO: 8339

SEQ ID NO: 12385 - protein, 311 aa, unidentified; identical to SEQ ID NO: 9371

SEQ ID NO: 12386 - protein, 251 aa, unidentified; identical to SEQ ID NO: 10649

SEQ ID NO: 12387 - protein, 337 aa, unidentified; identical to SEQ ID NO: 8339

SEQ ID NO: 12388 - protein, 337 aa, unidentified; identical to SEQ ID NO: 8339

SEQ ID NO: 12389 - protein, 337 aa, unidentified; identical to SEQ ID NO: 8339

SEQ ID NO: 12390 - protein, 57 aa, unidentified; identical to SEQ ID NO: 8179

SEQ ID NO: 12391 - protein, 337 aa, unidentified; identical to SEQ ID NO: 8339

SEQ ID NO: 12392 - protein, 209 aa, unidentified
DERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCSHHFHELFLRDGRKLIVPCRDQHELVGRSMVSQGGSSGVAGTACLAKAYAQM

SEQ ID NO: 12393 - protein, 337 aa, unidentified; identical to SEQ ID NO: 8339

SEQ ID NO: 12394 - protein, 337 aa, unidentified; identical to SEQ ID NO: 8339

SEQ ID NO: 12395 - protein, 329 aa, unidentified; identical to SEQ ID NO: 9403

SEQ ID NO: 12396 - protein, 337 aa, unidentified; identical to SEQ ID NO: 8339

SEQ ID NO: 12397 - protein, 306 aa, unidentified; identical to SEQ ID NO: 10939

SEQ ID NO: 12398 - protein, 337 aa, unidentified; identical to SEQ ID NO: 8339

SEQ ID NO: 12399 - protein, 255 aa, unidentified; identical to SEQ ID NO: 9520

SEQ ID NO: 12400 - protein, 337 aa, unidentified; identical to SEQ ID NO: 8339

SEQ ID NO: 12401 - protein, 337 aa, unidentified; identical to SEQ ID NO: 8339

SEQ ID NO: 12402 - protein, 337 aa, unidentified; identical to SEQ ID NO: 8339

SEQ ID NO: 12403 - protein, 337 aa, unidentified; identical to SEQ ID NO: 8339

SEQ ID NO: 12404 - protein, 337 aa, unidentified; identical to SEQ ID NO: 8339

SEQ ID NO: 12405 - protein, 270 aa, unidentified; identical to SEQ ID NO: 8331

SEQ ID NO: 12406 - protein, 57 aa, unidentified; identical to SEQ ID NO: 8179

SEQ ID NO: 12407 - protein, 120 aa, unidentified; identical to SEQ ID NO: 8921

SEQ ID NO: 12408 - protein, 337 aa, unidentified; identical to SEQ ID NO: 8339

SEQ ID NO: 12409 - protein, 337 aa, unidentified; identical to SEQ ID NO: 8339

SEQ ID NO: 12410 - protein, 337 aa, unidentified; identical to SEQ ID NO: 8339

SEQ ID NO: 12411 - protein, 337 aa, unidentified; identical to SEQ ID NO: 8339

SEQ ID NO: 12412 - protein, 337 aa, unidentified; identical to SEQ ID NO: 8339

SEQ ID NO: 12413 - protein, 337 aa, unidentified; identical to SEQ ID NO: 8339

SEQ ID NO: 12414 - protein, 337 aa, unidentified; identical to SEQ ID NO: 8339

SEQ ID NO: 12415 - protein, 337 aa, unidentified; identical to SEQ ID NO: 8339

SEQ ID NO: 12416 - protein, 337 aa, unidentified; identical to SEQ ID NO: 8339

SEQ ID NO: 12417 - protein, 249 aa, unidentified; identical to SEQ ID NO: 10206

SEQ ID NO: 12418 - protein, 337 aa, unidentified; identical to SEQ ID NO: 8339

SEQ ID NO: 12419 - protein, 57 aa, unidentified; identical to SEQ ID NO: 8179

SEQ ID NO: 12420 - protein, 337 aa, unidentified; identical to SEQ ID NO: 8339

SEQ ID NO: 12421 - protein, 337 aa, unidentified; identical to SEQ ID NO: 8339

SEQ ID NO: 12422 - protein, 337 aa, unidentified; identical to SEQ ID NO: 8339

SEQ ID NO: 12423 - protein, 265 aa, unidentified
IWYMWLGSRFLEFEALGFLNEERWASRDISGGGVEGIGINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCSHHFHELFLRDGRKLIVPCRDQHELVGRSMVSQG

SEQ ID NO: 12424 - protein, 337 aa, unidentified; identical to SEQ ID NO: 8339

SEQ ID NO: 12425 - protein, 337 aa, unidentified; identical to SEQ ID NO: 8339

SEQ ID NO: 12426 - protein, 57 aa, unidentified; identical to SEQ ID NO: 8179

SEQ ID NO: 12427 - protein, 76 aa, unidentified; identical to SEQ ID NO: 8186

SEQ ID NO: 12428 - protein, 90 aa, unidentified
EALTSVDLSYLAPRVGGLGSIFRVRNGTLERGSTIYMKIDVESPIVPELEGFDPRTNQSRVFWDDWELDGTTYQGFNGIYKGQDQMIHIP

SEQ ID NO: 12429 - protein, 337 aa, unidentified; identical to SEQ ID NO: 8339

SEQ ID NO: 12430 - protein, 337 aa, unidentified; identical to SEQ ID NO: 8339

SEQ ID NO: 12431 - protein, 337 aa, unidentified; identical to SEQ ID NO: 8339

SEQ ID NO: 12432 - protein, 337 aa, unidentified; identical to SEQ ID NO: 8339

SEQ ID NO: 12433 - protein, 337 aa, unidentified; identical to SEQ ID NO: 8339

SEQ ID NO: 12434 - protein, 310 aa, unidentified; identical to SEQ ID NO: 9321

SEQ ID NO: 12435 - protein, 292 aa, unidentified; identical to SEQ ID NO: 9890

SEQ ID NO: 12436 - protein, 337 aa, unidentified; identical to SEQ ID NO: 8339

SEQ ID NO: 12437 - protein, 337 aa, unidentified; identical to SEQ ID NO: 8339

SEQ ID NO: 12438 - protein, 337 aa, unidentified; identical to SEQ ID NO: 8339

SEQ ID NO: 12439 - protein, 337 aa, unidentified; identical to SEQ ID NO: 8339

SEQ ID NO: 12440 - protein, 337 aa, unidentified; identical to SEQ ID NO: 8339

SEQ ID NO: 12441 - protein, 276 aa, unidentified
KPGEFGVAKGSRTIWYMWLGSRFLEFEALGFLNEERWASRDISGGGVEGIGINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCSHHFHELFLRDGRKLIVPCRDQHELVGRSMVS

SEQ ID NO: 12442 - protein, 337 aa, unidentified; identical to SEQ ID NO: 8339

SEQ ID NO: 12443 - protein, 231 aa, unidentified; identical to SEQ ID NO: 9315

SEQ ID NO: 12444 - protein, 337 aa, unidentified; identical to SEQ ID NO: 8339

SEQ ID NO: 12445 - protein, 337 aa, unidentified; identical to SEQ ID NO: 8339

SEQ ID NO: 12446 - protein, 270 aa, unidentified; identical to SEQ ID NO: 8331

SEQ ID NO: 12447 - protein, 337 aa, unidentified; identical to SEQ ID NO: 8339

SEQ ID NO: 12448 - protein, 337 aa, unidentified; identical to SEQ ID NO: 8339

SEQ ID NO: 12449 - protein, 337 aa, unidentified; identical to SEQ ID NO: 8339

SEQ ID NO: 12450 - protein, 337 aa, unidentified; identical to SEQ ID NO: 8339

SEQ ID NO: 12451 - protein, 337 aa, unidentified; identical to SEQ ID NO: 8339

SEQ ID NO: 12452 - protein, 337 aa, unidentified; identical to SEQ ID NO: 8339

SEQ ID NO: 12453 - protein, 337 aa, unidentified; identical to SEQ ID NO: 8339

SEQ ID NO: 12454 - protein, 209 aa, unidentified; identical to SEQ ID NO: 9505

SEQ ID NO: 12455 - protein, 337 aa, unidentified; identical to SEQ ID NO: 8339

SEQ ID NO: 12456 - protein, 270 aa, unidentified; identical to SEQ ID NO: 8331

SEQ ID NO: 12457 - protein, 337 aa, unidentified; identical to SEQ ID NO: 8339

SEQ ID NO: 12458 - protein, 337 aa, unidentified; identical to SEQ ID NO: 8339

SEQ ID NO: 12459 - protein, 337 aa, unidentified; identical to SEQ ID NO: 8339

SEQ ID NO: 12460 - protein, 275 aa, unidentified; identical to SEQ ID NO: 11524

SEQ ID NO: 12461 - protein, 245 aa, unidentified; identical to SEQ ID NO: 9193

SEQ ID NO: 12462 - protein, 337 aa, unidentified; identical to SEQ ID NO: 8339

SEQ ID NO: 12463 - protein, 337 aa, unidentified; identical to SEQ ID NO: 8339

SEQ ID NO: 12464 - protein, 337 aa, unidentified; identical to SEQ ID NO: 8339

SEQ ID NO: 12465 - protein, 337 aa, unidentified; identical to SEQ ID NO: 8339

SEQ ID NO: 12466 - protein, 337 aa, unidentified; identical to SEQ ID NO: 8339

SEQ ID NO: 12467 - protein, 219 aa, unidentified
LYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCSHHFHELFLRDGRKLIVPCRDQHELVGRSMVSQGGSSGVAGTA

SEQ ID NO: 12468 - protein, 270 aa, unidentified; identical to SEQ ID NO: 8331

SEQ ID NO: 12469 - protein, 337 aa, unidentified; identical to SEQ ID NO: 8339

SEQ ID NO: 12470 - protein, 337 aa, unidentified; identical to SEQ ID NO: 8339

SEQ ID NO: 12471 - protein, 333 aa, unidentified; identical to SEQ ID NO: 8351

SEQ ID NO: 12472 - protein, 337 aa, unidentified; identical to SEQ ID NO: 8339

SEQ ID NO: 12473 - protein, 337 aa, unidentified; identical to SEQ ID NO: 8339

SEQ ID NO: 12474 - protein, 337 aa, unidentified; identical to SEQ ID NO: 8339

SEQ ID NO: 12475 - protein, 337 aa, unidentified; identical to SEQ ID NO: 8339

SEQ ID NO: 12476 - protein, 337 aa, unidentified; identical to SEQ ID NO: 8339

SEQ ID NO: 12477 - protein, 337 aa, unidentified; identical to SEQ ID NO: 8339

SEQ ID NO: 12478 - protein, 337 aa, unidentified; identical to SEQ ID NO: 8339

SEQ ID NO: 12479 - protein, 337 aa, unidentified; identical to SEQ ID NO: 8339

SEQ ID NO: 12480 - protein, 337 aa, unidentified; identical to SEQ ID NO: 8339

SEQ ID NO: 12481 - protein, 337 aa, unidentified; identical to SEQ ID NO: 8339

SEQ ID NO: 12482 - protein, 337 aa, unidentified; identical to SEQ ID NO: 8339

SEQ ID NO: 12483 - protein, 337 aa, unidentified; identical to SEQ ID NO: 8339

SEQ ID NO: 12484 - protein, 337 aa, unidentified; identical to SEQ ID NO: 8339

SEQ ID NO: 12485 - protein, 337 aa, unidentified; identical to SEQ ID NO: 8339

SEQ ID NO: 12486 - protein, 333 aa, unidentified; identical to SEQ ID NO: 8351

SEQ ID NO: 12487 - protein, 337 aa, unidentified; identical to SEQ ID NO: 8339

SEQ ID NO: 12488 - protein, 337 aa, unidentified; identical to SEQ ID NO: 8339

SEQ ID NO: 12489 - protein, 337 aa, unidentified; identical to SEQ ID NO: 8339

SEQ ID NO: 12490 - protein, 298 aa, unidentified; identical to SEQ ID NO: 8537

SEQ ID NO: 12491 - protein, 337 aa, unidentified; identical to SEQ ID NO: 8339

SEQ ID NO: 12492 - protein, 337 aa, unidentified; identical to SEQ ID NO: 8339

SEQ ID NO: 12493 - protein, 337 aa, unidentified; identical to SEQ ID NO: 8339

SEQ ID NO: 12494 - protein, 337 aa, unidentified; identical to SEQ ID NO: 8339

SEQ ID NO: 12495 - protein, 337 aa, unidentified; identical to SEQ ID NO: 8339

SEQ ID NO: 12496 - protein, 337 aa, unidentified; identical to SEQ ID NO: 8339

SEQ ID NO: 12497 - protein, 337 aa, unidentified; identical to SEQ ID NO: 8339

SEQ ID NO: 12498 - protein, 337 aa, unidentified; identical to SEQ ID NO: 8339

SEQ ID NO: 12499 - protein, 337 aa, unidentified; identical to SEQ ID NO: 8339

SEQ ID NO: 12500 - protein, 337 aa, unidentified; identical to SEQ ID NO: 8339

SEQ ID NO: 12501 - protein, 337 aa, unidentified; identical to SEQ ID NO: 8339

SEQ ID NO: 12502 - protein, 337 aa, unidentified; identical to SEQ ID NO: 8339

SEQ ID NO: 12503 - protein, 337 aa, unidentified; identical to SEQ ID NO: 8339

SEQ ID NO: 12504 - protein, 337 aa, unidentified; identical to SEQ ID NO: 8339

SEQ ID NO: 12505 - protein, 337 aa, unidentified; identical to SEQ ID NO: 8339

SEQ ID NO: 12506 - protein, 337 aa, unidentified; identical to SEQ ID NO: 8339

SEQ ID NO: 12507 - protein, 337 aa, unidentified; identical to SEQ ID NO: 8339

SEQ ID NO: 12508 - protein, 337 aa, unidentified; identical to SEQ ID NO: 8339

SEQ ID NO: 12509 - protein, 337 aa, unidentified; identical to SEQ ID NO: 8339

SEQ ID NO: 12510 - protein, 337 aa, unidentified; identical to SEQ ID NO: 8339

SEQ ID NO: 12511 - protein, 337 aa, unidentified; identical to SEQ ID NO: 8339

SEQ ID NO: 12512 - protein, 337 aa, unidentified; identical to SEQ ID NO: 8339

SEQ ID NO: 12513 - protein, 337 aa, unidentified; identical to SEQ ID NO: 8339

SEQ ID NO: 12514 - protein, 337 aa, unidentified; identical to SEQ ID NO: 8339

SEQ ID NO: 12515 - protein, 337 aa, unidentified; identical to SEQ ID NO: 8339

SEQ ID NO: 12516 - protein, 337 aa, unidentified; identical to SEQ ID NO: 8339

SEQ ID NO: 12517 - protein, 337 aa, unidentified; identical to SEQ ID NO: 8339

SEQ ID NO: 12518 - protein, 333 aa, unidentified; identical to SEQ ID NO: 8351

SEQ ID NO: 12519 - protein, 261 aa, unidentified; identical to SEQ ID NO: 11471

SEQ ID NO: 12520 - protein, 337 aa, unidentified; identical to SEQ ID NO: 8339

SEQ ID NO: 12521 - protein, 328 aa, unidentified; identical to SEQ ID NO: 11891

SEQ ID NO: 12522 - protein, 337 aa, unidentified; identical to SEQ ID NO: 8339

SEQ ID NO: 12523 - protein, 337 aa, unidentified; identical to SEQ ID NO: 8339

SEQ ID NO: 12524 - protein, 337 aa, unidentified; identical to SEQ ID NO: 8339

SEQ ID NO: 12525 - protein, 337 aa, unidentified; identical to SEQ ID NO: 8339

SEQ ID NO: 12526 - protein, 337 aa, unidentified; identical to SEQ ID NO: 8339

SEQ ID NO: 12527 - protein, 337 aa, unidentified; identical to SEQ ID NO: 8339

SEQ ID NO: 12528 - protein, 337 aa, unidentified; identical to SEQ ID NO: 8339

SEQ ID NO: 12529 - protein, 337 aa, unidentified; identical to SEQ ID NO: 8339

SEQ ID NO: 12530 - protein, 337 aa, unidentified; identical to SEQ ID NO: 8339

SEQ ID NO: 12531 - protein, 337 aa, unidentified; identical to SEQ ID NO: 8339

SEQ ID NO: 12532 - protein, 337 aa, unidentified; identical to SEQ ID NO: 8339

SEQ ID NO: 12533 - protein, 337 aa, unidentified; identical to SEQ ID NO: 8339

SEQ ID NO: 12534 - protein, 154 aa, unidentified; identical to SEQ ID NO: 8743

SEQ ID NO: 12535 - protein, 337 aa, unidentified; identical to SEQ ID NO: 8339

SEQ ID NO: 12536 - protein, 337 aa, unidentified; identical to SEQ ID NO: 8339

SEQ ID NO: 12537 - protein, 337 aa, unidentified; identical to SEQ ID NO: 8339

SEQ ID NO: 12538 - protein, 337 aa, unidentified; identical to SEQ ID NO: 8339

SEQ ID NO: 12539 - protein, 337 aa, unidentified; identical to SEQ ID NO: 8339

SEQ ID NO: 12540 - protein, 270 aa, unidentified; identical to SEQ ID NO: 8331

SEQ ID NO: 12541 - protein, 337 aa, unidentified; identical to SEQ ID NO: 8339

SEQ ID NO: 12542 - protein, 337 aa, unidentified; identical to SEQ ID NO: 8339

SEQ ID NO: 12543 - protein, 337 aa, unidentified; identical to SEQ ID NO: 8339

SEQ ID NO: 12544 - protein, 337 aa, unidentified; identical to SEQ ID NO: 8339

SEQ ID NO: 12545 - protein, 337 aa, unidentified; identical to SEQ ID NO: 8339

SEQ ID NO: 12546 - protein, 337 aa, unidentified; identical to SEQ ID NO: 8339

SEQ ID NO: 12547 - protein, 337 aa, unidentified; identical to SEQ ID NO: 8339

SEQ ID NO: 12548 - protein, 337 aa, unidentified; identical to SEQ ID NO: 8339

SEQ ID NO: 12549 - protein, 337 aa, unidentified; identical to SEQ ID NO: 8339

SEQ ID NO: 12550 - protein, 337 aa, unidentified; identical to SEQ ID NO: 8339

SEQ ID NO: 12551 - protein, 337 aa, unidentified; identical to SEQ ID NO: 8339

SEQ ID NO: 12552 - protein, 337 aa, unidentified; identical to SEQ ID NO: 8339

SEQ ID NO: 12553 - protein, 337 aa, unidentified; identical to SEQ ID NO: 8339

SEQ ID NO: 12554 - protein, 270 aa, unidentified; identical to SEQ ID NO: 8331

SEQ ID NO: 12555 - protein, 337 aa, unidentified; identical to SEQ ID NO: 8339

SEQ ID NO: 12556 - protein, 146 aa, unidentified
DTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNT

SEQ ID NO: 12557 - protein, 143 aa, unidentified; identical to SEQ ID NO: 8341

SEQ ID NO: 12558 - protein, 270 aa, unidentified; identical to SEQ ID NO: 8331

SEQ ID NO: 12559 - protein, 337 aa, unidentified; identical to SEQ ID NO: 8339

SEQ ID NO: 12560 - protein, 337 aa, unidentified; identical to SEQ ID NO: 8339

SEQ ID NO: 12561 - protein, 337 aa, unidentified; identical to SEQ ID NO: 8339

SEQ ID NO: 12562 - protein, 337 aa, unidentified; identical to SEQ ID NO: 8339

SEQ ID NO: 12563 - protein, 337 aa, unidentified; identical to SEQ ID NO: 8339

SEQ ID NO: 12564 - protein, 333 aa, unidentified; identical to SEQ ID NO: 8351

SEQ ID NO: 12565 - protein, 337 aa, unidentified; identical to SEQ ID NO: 8339

SEQ ID NO: 12566 - protein, 337 aa, unidentified; identical to SEQ ID NO: 8339

SEQ ID NO: 12567 - protein, 337 aa, unidentified; identical to SEQ ID NO: 8339

SEQ ID NO: 12568 - protein, 337 aa, unidentified; identical to SEQ ID NO: 8339

SEQ ID NO: 12569 - protein, 337 aa, unidentified; identical to SEQ ID NO: 8339

SEQ ID NO: 12570 - protein, 337 aa, unidentified; identical to SEQ ID NO: 8339

SEQ ID NO: 12571 - protein, 337 aa, unidentified; identical to SEQ ID NO: 8339

SEQ ID NO: 12572 - protein, 333 aa, unidentified; identical to SEQ ID NO: 8351

SEQ ID NO: 12573 - protein, 337 aa, unidentified; identical to SEQ ID NO: 8339

SEQ ID NO: 12574 - protein, 311 aa, unidentified; identical to SEQ ID NO: 12351

SEQ ID NO: 12575 - protein, 337 aa, unidentified; identical to SEQ ID NO: 8339

SEQ ID NO: 12576 - protein, 337 aa, unidentified; identical to SEQ ID NO: 8339

SEQ ID NO: 12577 - protein, 337 aa, unidentified; identical to SEQ ID NO: 8339

SEQ ID NO: 12578 - protein, 337 aa, unidentified; identical to SEQ ID NO: 8339

SEQ ID NO: 12579 - protein, 258 aa, unidentified; identical to SEQ ID NO: 8309

SEQ ID NO: 12580 - protein, 337 aa, unidentified; identical to SEQ ID NO: 8339

SEQ ID NO: 12581 - protein, 337 aa, unidentified; identical to SEQ ID NO: 8339

SEQ ID NO: 12582 - protein, 337 aa, unidentified; identical to SEQ ID NO: 8339

SEQ ID NO: 12583 - protein, 337 aa, unidentified; identical to SEQ ID NO: 8339

SEQ ID NO: 12584 - protein, 337 aa, unidentified; identical to SEQ ID NO: 8339

SEQ ID NO: 12585 - protein, 337 aa, unidentified; identical to SEQ ID NO: 8339

SEQ ID NO: 12586 - protein, 337 aa, unidentified; identical to SEQ ID NO: 8339

SEQ ID NO: 12587 - protein, 261 aa, unidentified; identical to SEQ ID NO: 11471

SEQ ID NO: 12588 - protein, 333 aa, unidentified; identical to SEQ ID NO: 8351

SEQ ID NO: 12589 - protein, 337 aa, unidentified; identical to SEQ ID NO: 8339

SEQ ID NO: 12590 - protein, 333 aa, unidentified; identical to SEQ ID NO: 8351

SEQ ID NO: 12591 - protein, 337 aa, unidentified; identical to SEQ ID NO: 8339

SEQ ID NO: 12592 - protein, 337 aa, unidentified; identical to SEQ ID NO: 8339

SEQ ID NO: 12593 - protein, 337 aa, unidentified; identical to SEQ ID NO: 8339

SEQ ID NO: 12594 - protein, 333 aa, unidentified; identical to SEQ ID NO: 8351

SEQ ID NO: 12595 - protein, 207 aa, unidentified
KPGEFGVAKGSRTIWYMWLGSRFLEFEALGFLNEERWASRDISGGGVEGIGINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDE

SEQ ID NO: 12596 - protein, 337 aa, unidentified; identical to SEQ ID NO: 8339

SEQ ID NO: 12597 - protein, 337 aa, unidentified; identical to SEQ ID NO: 8339

SEQ ID NO: 12598 - protein, 333 aa, unidentified; identical to SEQ ID NO: 8351

SEQ ID NO: 12599 - protein, 337 aa, unidentified; identical to SEQ ID NO: 8339

SEQ ID NO: 12600 - protein, 337 aa, unidentified; identical to SEQ ID NO: 8339

SEQ ID NO: 12601 - protein, 337 aa, unidentified; identical to SEQ ID NO: 8339

SEQ ID NO: 12602 - protein, 337 aa, unidentified; identical to SEQ ID NO: 8339

SEQ ID NO: 12603 - protein, 241 aa, unidentified; identical to SEQ ID NO: 12208

SEQ ID NO: 12604 - protein, 337 aa, unidentified; identical to SEQ ID NO: 8339

SEQ ID NO: 12605 - protein, 267 aa, unidentified
KPGEFGVAKGSRTIWYMWLGSRFLEFEALGFLNEERWASRDISGGGVEGIGINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCSHHFHELFLRDGRKLIVPCRDQH

SEQ ID NO: 12606 - protein, 337 aa, unidentified; identical to SEQ ID NO: 8339

SEQ ID NO: 12607 - protein, 333 aa, unidentified; identical to SEQ ID NO: 8351

SEQ ID NO: 12608 - protein, 216 aa, unidentified
KPGEFGVAKGSRTIWYMWLGSRFLEFEALGFLNEERWASRDISGGGVEGIGINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWL

SEQ ID NO: 12609 - protein, 337 aa, unidentified; identical to SEQ ID NO: 8339

SEQ ID NO: 12610 - protein, 311 aa, unidentified; identical to SEQ ID NO: 12351

SEQ ID NO: 12611 - protein, 258 aa, unidentified; identical to SEQ ID NO: 8309

SEQ ID NO: 12612 - protein, 333 aa, unidentified; identical to SEQ ID NO: 8351

SEQ ID NO: 12613 - protein, 255 aa, unidentified; identical to SEQ ID NO: 9104

SEQ ID NO: 12614 - protein, 256 aa, unidentified; identical to SEQ ID NO: 9141

SEQ ID NO: 12615 - protein, 337 aa, unidentified; identical to SEQ ID NO: 8339

SEQ ID NO: 12616 - protein, 333 aa, unidentified; identical to SEQ ID NO: 8351

SEQ ID NO: 12617 - protein, 333 aa, unidentified; identical to SEQ ID NO: 8351

SEQ ID NO: 12618 - protein, 333 aa, unidentified; identical to SEQ ID NO: 8351

SEQ ID NO: 12619 - protein, 333 aa, unidentified; identical to SEQ ID NO: 8351

SEQ ID NO: 12620 - protein, 235 aa, unidentified; identical to SEQ ID NO: 9303

SEQ ID NO: 12621 - protein, 234 aa, unidentified
GVEGIGINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCSHHFHELFLRDGRKLIVPCRDQHELVGRSMVSQGG

SEQ ID NO: 12622 - protein, 333 aa, unidentified; identical to SEQ ID NO: 8351

SEQ ID NO: 12623 - protein, 333 aa, unidentified; identical to SEQ ID NO: 8351

SEQ ID NO: 12624 - protein, 337 aa, unidentified; identical to SEQ ID NO: 8339

SEQ ID NO: 12625 - protein, 288 aa, unidentified; identical to SEQ ID NO: 12337

SEQ ID NO: 12626 - protein, 333 aa, unidentified; identical to SEQ ID NO: 8351

SEQ ID NO: 12627 - protein, 332 aa, unidentified; identical to SEQ ID NO: 9622

SEQ ID NO: 12628 - protein, 337 aa, unidentified; identical to SEQ ID NO: 8339

SEQ ID NO: 12629 - protein, 247 aa, unidentified; identical to SEQ ID NO: 10338

SEQ ID NO: 12630 - protein, 337 aa, unidentified; identical to SEQ ID NO: 8339

SEQ ID NO: 12631 - protein, 333 aa, unidentified; identical to SEQ ID NO: 8351

SEQ ID NO: 12632 - protein, 333 aa, unidentified; identical to SEQ ID NO: 8351

SEQ ID NO: 12633 - protein, 333 aa, unidentified; identical to SEQ ID NO: 8351

SEQ ID NO: 12634 - protein, 333 aa, unidentified; identical to SEQ ID NO: 8351

SEQ ID NO: 12635 - protein, 337 aa, unidentified; identical to SEQ ID NO: 8339

SEQ ID NO: 12636 - protein, 333 aa, unidentified; identical to SEQ ID NO: 8351

SEQ ID NO: 12637 - protein, 333 aa, unidentified; identical to SEQ ID NO: 8351

SEQ ID NO: 12638 - protein, 333 aa, unidentified; identical to SEQ ID NO: 8351

SEQ ID NO: 12639 - protein, 333 aa, unidentified; identical to SEQ ID NO: 8351

SEQ ID NO: 12640 - protein, 333 aa, unidentified; identical to SEQ ID NO: 8351

SEQ ID NO: 12641 - protein, 333 aa, unidentified; identical to SEQ ID NO: 8351

SEQ ID NO: 12642 - protein, 271 aa, unidentified
KPGEFGVAKGSRTIWYMWLGSRFLEFEALGFLNEERWASRDISGGGVEGIGINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCSHHFHELFLRDGRKLIVPCRDQHELVG

SEQ ID NO: 12643 - protein, 333 aa, unidentified; identical to SEQ ID NO: 8351

SEQ ID NO: 12644 - protein, 337 aa, unidentified; identical to SEQ ID NO: 8339

SEQ ID NO: 12645 - protein, 309 aa, unidentified; identical to SEQ ID NO: 12347

SEQ ID NO: 12646 - protein, 337 aa, unidentified; identical to SEQ ID NO: 8339

SEQ ID NO: 12647 - protein, 337 aa, unidentified; identical to SEQ ID NO: 8339

SEQ ID NO: 12648 - protein, 174 aa, unidentified; identical to SEQ ID NO: 8195

SEQ ID NO: 12649 - protein, 337 aa, unidentified; identical to SEQ ID NO: 8339

SEQ ID NO: 12650 - protein, 337 aa, unidentified; identical to SEQ ID NO: 8339

SEQ ID NO: 12651 - protein, 232 aa, unidentified; identical to SEQ ID NO: 10022

SEQ ID NO: 12652 - protein, 313 aa, unidentified; identical to SEQ ID NO: 8356

SEQ ID NO: 12653 - protein, 337 aa, unidentified; identical to SEQ ID NO: 8339

SEQ ID NO: 12654 - protein, 127 aa, unidentified; identical to SEQ ID NO: 8344

SEQ ID NO: 12655 - protein, 248 aa, unidentified
KPGEFGVAKGSRTIWYMWLGSRFLEFEALGFLNEERWASRDISGGGVEGIGINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCSHHF

SEQ ID NO: 12656 - protein, 263 aa, unidentified
LGSRFLEFEALGFLNEERWASRDISGGGVEGIGINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCSHHFHELFLRDGRKLIVPCRDQHELVGRSMVSQGGSS

SEQ ID NO: 12657 - protein, 319 aa, unidentified; identical to SEQ ID NO: 8681

SEQ ID NO: 12658 - protein, 337 aa, unidentified; identical to SEQ ID NO: 8339

SEQ ID NO: 12659 - protein, 264 aa, unidentified; identical to SEQ ID NO: 11150

SEQ ID NO: 12660 - protein, 337 aa, unidentified; identical to SEQ ID NO: 8339

SEQ ID NO: 12661 - protein, 333 aa, unidentified; identical to SEQ ID NO: 8351

SEQ ID NO: 12662 - protein, 337 aa, unidentified; identical to SEQ ID NO: 8339

SEQ ID NO: 12663 - protein, 337 aa, unidentified; identical to SEQ ID NO: 8339

SEQ ID NO: 12664 - protein, 95 aa, unidentified
SVVDMDPYDKSLHSKVFPTGRCSGISVSSTSCSTNHDYTLWLPEDPKPGSSCDIFTTSKGKKASKGGKICGFVDERGLYKSLKGSCKLKLCGISG

SEQ ID NO: 12665 - protein, 305 aa, unidentified
KGSRTIWYMWLGSRFLEFESFGFLNEEHWASRELCGGGVEGIPLFYLGYHLEKMAEKAGILYADDTAGWDTRITMADLEDEYTLTELMEGEHKKLAETLFNFAYKNKVALCPRPGKNGGTVLDVISRTDQRGSGQVVTYALNTLTNIKVQLIRMAESEGVLDEEFHDNGMLKWLEKHGRDRLQRLMVSGDDCVVNAIDERFGKSLVWLNEMQKIRKDIDLWKPSAGHCNWEEVEFCSNHFHKLVMRDGRTLVVPCRHEVELVGRASVNQGGSTGISGTACLAKAYAQMWLLLYFHRRDLRILGMA

SEQ ID NO: 12666 - protein, 310 aa, unidentified; identical to SEQ ID NO: 8697

SEQ ID NO: 12667 - protein, 337 aa, unidentified; identical to SEQ ID NO: 8339

SEQ ID NO: 12668 - protein, 337 aa, unidentified; identical to SEQ ID NO: 8339

SEQ ID NO: 12669 - protein, 272 aa, unidentified
VAKGSRTIWYMWLGSRFLEFESFGFLNEEHWASRELCGGGVEGIPLFYLGYHLEKMAEKAGILYADDTAGWDTRITMADLEDEYTLTELMEGEHKKLAETLFNFAYKNKVALCPRPGKNGGTVLDVISRTDQRGSGQVVTYALNTLTNIKVQLIRMAESEGVLDEEFHDNGMLKWLEKHGRDRLQRLMVSGDDCVVNAIDERFGKSLVWLNEMQKIRKDIDLWKPSAGHCNWEEVEFCSNHFHKLVMRDGRTLVVPCRHEVELVGRASVNQG

SEQ ID NO: 12670 - protein, 337 aa, unidentified; identical to SEQ ID NO: 8339

SEQ ID NO: 12671 - protein, 57 aa, unidentified; identical to SEQ ID NO: 8179

SEQ ID NO: 12672 - protein, 227 aa, unidentified; identical to SEQ ID NO: 8473

SEQ ID NO: 12673 - protein, 337 aa, unidentified; identical to SEQ ID NO: 8339

SEQ ID NO: 12674 - protein, 337 aa, unidentified; identical to SEQ ID NO: 8339

SEQ ID NO: 12675 - protein, 333 aa, unidentified; identical to SEQ ID NO: 8351

SEQ ID NO: 12676 - protein, 337 aa, unidentified; identical to SEQ ID NO: 8339

SEQ ID NO: 12677 - protein, 333 aa, unidentified; identical to SEQ ID NO: 8351

SEQ ID NO: 12678 - protein, 337 aa, unidentified; identical to SEQ ID NO: 8339

SEQ ID NO: 12679 - protein, 319 aa, unidentified; identical to SEQ ID NO: 8681

SEQ ID NO: 12680 - protein, 46 aa, unidentified
NLQMFGTNLVLNEEDGMKICHLNNECSLKLPVVRCMNSSLFRVTCG

SEQ ID NO: 12681 - protein, 337 aa, unidentified; identical to SEQ ID NO: 8339

SEQ ID NO: 12682 - protein, 337 aa, unidentified; identical to SEQ ID NO: 8339

SEQ ID NO: 12683 - protein, 337 aa, unidentified; identical to SEQ ID NO: 8339

SEQ ID NO: 12684 - protein, 337 aa, unidentified; identical to SEQ ID NO: 8339

SEQ ID NO: 12685 - protein, 337 aa, unidentified; identical to SEQ ID NO: 8339

SEQ ID NO: 12686 - protein, 337 aa, unidentified; identical to SEQ ID NO: 8339

SEQ ID NO: 12687 - protein, 333 aa, unidentified; identical to SEQ ID NO: 8351

SEQ ID NO: 12688 - protein, 337 aa, unidentified; identical to SEQ ID NO: 8339

SEQ ID NO: 12689 - protein, 337 aa, unidentified; identical to SEQ ID NO: 8339

SEQ ID NO: 12690 - protein, 337 aa, unidentified; identical to SEQ ID NO: 8339

SEQ ID NO: 12691 - protein, 337 aa, unidentified; identical to SEQ ID NO: 8339

SEQ ID NO: 12692 - protein, 337 aa, unidentified; identical to SEQ ID NO: 8339

SEQ ID NO: 12693 - protein, 271 aa, unidentified; identical to SEQ ID NO: 10816

SEQ ID NO: 12694 - protein, 337 aa, unidentified; identical to SEQ ID NO: 8339

SEQ ID NO: 12695 - protein, 337 aa, unidentified; identical to SEQ ID NO: 8339

SEQ ID NO: 12696 - protein, 337 aa, unidentified; identical to SEQ ID NO: 8339

SEQ ID NO: 12697 - protein, 244 aa, unidentified
KPGEFGVAKGSRTIWYMWLGSRFLEFEALGFLNEERWASRDISGGGVEGIGINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFC

SEQ ID NO: 12698 - protein, 235 aa, unidentified; identical to SEQ ID NO: 9303

SEQ ID NO: 12699 - protein, 337 aa, unidentified; identical to SEQ ID NO: 8339

SEQ ID NO: 12700 - protein, 337 aa, unidentified; identical to SEQ ID NO: 8339

SEQ ID NO: 12701 - protein, 337 aa, unidentified; identical to SEQ ID NO: 8339

SEQ ID NO: 12702 - protein, 337 aa, unidentified; identical to SEQ ID NO: 8339

SEQ ID NO: 12703 - protein, 337 aa, unidentified; identical to SEQ ID NO: 8339

SEQ ID NO: 12704 - protein, 275 aa, unidentified
LEKMAEKAGILYADDTAGWDTRITMADLEDEYTLTELMEGEHKKLAETLFNFAYKNKVALCPRPGKNGGTVLDVISRTDQRGSGQVVTYALNTLTNIKVQLIRMAESEGVLDEEFHDNGMLKWLEKHGRDRLQRLMVSGDDCVVNAIDERFGKSLVWLNEMQKIRKDIDLWKPSAGHCNWEEVEFCSNHFHKLVMRDGRTLVVPCRHEVELVGRASVNQGGSTGISGTACLAKAYAQMWLLLYFHRRDLRILGMAICSAVPANWVPTGRTTWSLH

SEQ ID NO: 12705 - protein, 337 aa, unidentified; identical to SEQ ID NO: 8339

SEQ ID NO: 12706 - protein, 337 aa, unidentified; identical to SEQ ID NO: 8339

SEQ ID NO: 12707 - protein, 337 aa, unidentified; identical to SEQ ID NO: 8339

SEQ ID NO: 12708 - protein, 337 aa, unidentified; identical to SEQ ID NO: 8339

SEQ ID NO: 12709 - protein, 337 aa, unidentified; identical to SEQ ID NO: 8339

SEQ ID NO: 12710 - protein, 337 aa, unidentified; identical to SEQ ID NO: 8339

SEQ ID NO: 12711 - protein, 333 aa, unidentified; identical to SEQ ID NO: 8351

SEQ ID NO: 12712 - protein, 337 aa, unidentified; identical to SEQ ID NO: 8339

SEQ ID NO: 12713 - protein, 337 aa, unidentified; identical to SEQ ID NO: 8339

SEQ ID NO: 12714 - protein, 337 aa, unidentified; identical to SEQ ID NO: 8339

SEQ ID NO: 12715 - protein, 337 aa, unidentified; identical to SEQ ID NO: 8339

SEQ ID NO: 12716 - protein, 337 aa, unidentified; identical to SEQ ID NO: 8339

SEQ ID NO: 12717 - protein, 337 aa, unidentified; identical to SEQ ID NO: 8339

SEQ ID NO: 12718 - protein, 333 aa, unidentified; identical to SEQ ID NO: 8351

SEQ ID NO: 12719 - protein, 337 aa, unidentified; identical to SEQ ID NO: 8339

SEQ ID NO: 12720 - protein, 337 aa, unidentified; identical to SEQ ID NO: 8339

SEQ ID NO: 12721 - protein, 337 aa, unidentified; identical to SEQ ID NO: 8339

SEQ ID NO: 12722 - protein, 337 aa, unidentified; identical to SEQ ID NO: 8339

SEQ ID NO: 12723 - protein, 241 aa, unidentified; identical to SEQ ID NO: 12208

SEQ ID NO: 12724 - protein, 337 aa, unidentified; identical to SEQ ID NO: 8339

SEQ ID NO: 12725 - protein, 337 aa, unidentified; identical to SEQ ID NO: 8339

SEQ ID NO: 12726 - protein, 337 aa, unidentified; identical to SEQ ID NO: 8339

SEQ ID NO: 12727 - protein, 337 aa, unidentified; identical to SEQ ID NO: 8339

SEQ ID NO: 12728 - protein, 337 aa, unidentified; identical to SEQ ID NO: 8339

SEQ ID NO: 12729 - protein, 337 aa, unidentified; identical to SEQ ID NO: 8339

SEQ ID NO: 12730 - protein, 333 aa, unidentified; identical to SEQ ID NO: 8351

SEQ ID NO: 12731 - protein, 337 aa, unidentified; identical to SEQ ID NO: 8339

SEQ ID NO: 12732 - protein, 337 aa, unidentified; identical to SEQ ID NO: 8339

SEQ ID NO: 12733 - protein, 337 aa, unidentified; identical to SEQ ID NO: 8339

SEQ ID NO: 12734 - protein, 337 aa, unidentified; identical to SEQ ID NO: 8339

SEQ ID NO: 12735 - protein, 337 aa, unidentified; identical to SEQ ID NO: 8339

SEQ ID NO: 12736 - protein, 337 aa, unidentified; identical to SEQ ID NO: 8339

SEQ ID NO: 12737 - protein, 270 aa, unidentified; identical to SEQ ID NO: 8331

SEQ ID NO: 12738 - protein, 337 aa, unidentified; identical to SEQ ID NO: 8339

SEQ ID NO: 12739 - protein, 337 aa, unidentified; identical to SEQ ID NO: 8339

SEQ ID NO: 12740 - protein, 337 aa, unidentified; identical to SEQ ID NO: 8339

SEQ ID NO: 12741 - protein, 337 aa, unidentified; identical to SEQ ID NO: 8339

SEQ ID NO: 12742 - protein, 337 aa, unidentified; identical to SEQ ID NO: 8339

SEQ ID NO: 12743 - protein, 337 aa, unidentified; identical to SEQ ID NO: 8339

SEQ ID NO: 12744 - protein, 337 aa, unidentified; identical to SEQ ID NO: 8339

SEQ ID NO: 12745 - protein, 337 aa, unidentified; identical to SEQ ID NO: 8339

SEQ ID NO: 12746 - protein, 337 aa, unidentified; identical to SEQ ID NO: 8339

SEQ ID NO: 12747 - protein, 337 aa, unidentified; identical to SEQ ID NO: 8339

SEQ ID NO: 12748 - protein, 225 aa, unidentified
KPGEFGVAKGSRTIWYMWLGSRFLEFEALGFLNEERWASRDISGGGVEGIGINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTRED

SEQ ID NO: 12749 - protein, 337 aa, unidentified; identical to SEQ ID NO: 8339

SEQ ID NO: 12750 - protein, 270 aa, unidentified; identical to SEQ ID NO: 8331

SEQ ID NO: 12751 - protein, 337 aa, unidentified; identical to SEQ ID NO: 8339

SEQ ID NO: 12752 - protein, 337 aa, unidentified; identical to SEQ ID NO: 8339

SEQ ID NO: 12753 - protein, 337 aa, unidentified; identical to SEQ ID NO: 8339

SEQ ID NO: 12754 - protein, 337 aa, unidentified; identical to SEQ ID NO: 8339

SEQ ID NO: 12755 - protein, 337 aa, unidentified; identical to SEQ ID NO: 8339

SEQ ID NO: 12756 - protein, 213 aa, unidentified; identical to SEQ ID NO: 12272

SEQ ID NO: 12757 - protein, 337 aa, unidentified; identical to SEQ ID NO: 8339

SEQ ID NO: 12758 - protein, 333 aa, unidentified; identical to SEQ ID NO: 8351

SEQ ID NO: 12759 - protein, 209 aa, unidentified; identical to SEQ ID NO: 9505

SEQ ID NO: 12760 - protein, 337 aa, unidentified; identical to SEQ ID NO: 8339

SEQ ID NO: 12761 - protein, 95 aa, unidentified; identical to SEQ ID NO: 12664

SEQ ID NO: 12762 - protein, 333 aa, unidentified; identical to SEQ ID NO: 8351

SEQ ID NO: 12763 - protein, 337 aa, unidentified; identical to SEQ ID NO: 8339

SEQ ID NO: 12764 - protein, 337 aa, unidentified; identical to SEQ ID NO: 8339

SEQ ID NO: 12765 - protein, 337 aa, unidentified; identical to SEQ ID NO: 8339

SEQ ID NO: 12766 - protein, 337 aa, unidentified; identical to SEQ ID NO: 8339

SEQ ID NO: 12767 - protein, 337 aa, unidentified; identical to SEQ ID NO: 8339

SEQ ID NO: 12768 - protein, 337 aa, unidentified; identical to SEQ ID NO: 8339

SEQ ID NO: 12769 - protein, 337 aa, unidentified; identical to SEQ ID NO: 8339

SEQ ID NO: 12770 - protein, 337 aa, unidentified; identical to SEQ ID NO: 8339

SEQ ID NO: 12771 - protein, 337 aa, unidentified; identical to SEQ ID NO: 8339

SEQ ID NO: 12772 - protein, 337 aa, unidentified; identical to SEQ ID NO: 8339

SEQ ID NO: 12773 - protein, 337 aa, unidentified; identical to SEQ ID NO: 8339

SEQ ID NO: 12774 - protein, 337 aa, unidentified; identical to SEQ ID NO: 8339

SEQ ID NO: 12775 - protein, 337 aa, unidentified; identical to SEQ ID NO: 8339

SEQ ID NO: 12776 - protein, 337 aa, unidentified; identical to SEQ ID NO: 8339

SEQ ID NO: 12777 - protein, 323 aa, unidentified
SRTIWYMWLGSRFLEFESFGFLNEEHWASRELCGGGVEGIPLFYLGYHLEKMAEKAGILYADDTAGWDTRITMADLEDEYTLTELMEGEHKKLAETLFNFAYKNKVALCPRPGKNGGTVLDVISRTDQRGSGQVVTYALNTLTNIKVQLIRMAESEGVLDEEFHDNGMLKWLEKHGRDRLQRLMVSGDDCVVNAIDERFGKSLVWLNEMQKIRKDIDLWKPSAGHCNWEEVEFCSNHFHKLVMRDGRTLVVPCRHEVELVGRASVNQGGSTGISGTACLAKAYAQMWLLLYFHRRDLRILGMAICSAVPANWVPTGRTTWSLH

SEQ ID NO: 12778 - protein, 337 aa, unidentified; identical to SEQ ID NO: 8339

SEQ ID NO: 12779 - protein, 337 aa, unidentified; identical to SEQ ID NO: 8339

SEQ ID NO: 12780 - protein, 337 aa, unidentified; identical to SEQ ID NO: 8339

SEQ ID NO: 12781 - protein, 337 aa, unidentified; identical to SEQ ID NO: 8339

SEQ ID NO: 12782 - protein, 337 aa, unidentified; identical to SEQ ID NO: 8339

SEQ ID NO: 12783 - protein, 270 aa, unidentified; identical to SEQ ID NO: 8331

SEQ ID NO: 12784 - protein, 337 aa, unidentified; identical to SEQ ID NO: 8339

SEQ ID NO: 12785 - protein, 326 aa, unidentified
RTIWYMWLGSRFLEFEALGFLNEERWASRDISGGGVEGIGINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCSHHFHELFLRDGRKLIVPCRDQHELVGRSMVSQGGSSGVAGTACLAKAYAQMWLMSYFHRRDLRTLGFGIMSSVPKDWFPTGRTTWSVHANHE

SEQ ID NO: 12786 - protein, 337 aa, unidentified; identical to SEQ ID NO: 8339

SEQ ID NO: 12787 - protein, 283 aa, unidentified; identical to SEQ ID NO: 9339

SEQ ID NO: 12788 - protein, 337 aa, unidentified; identical to SEQ ID NO: 8339

SEQ ID NO: 12789 - protein, 337 aa, unidentified; identical to SEQ ID NO: 8339

SEQ ID NO: 12790 - protein, 333 aa, unidentified; identical to SEQ ID NO: 8351

SEQ ID NO: 12791 - protein, 337 aa, unidentified; identical to SEQ ID NO: 8339

SEQ ID NO: 12792 - protein, 337 aa, unidentified; identical to SEQ ID NO: 8339

SEQ ID NO: 12793 - protein, 337 aa, unidentified; identical to SEQ ID NO: 8339

SEQ ID NO: 12794 - protein, 337 aa, unidentified; identical to SEQ ID NO: 8339

SEQ ID NO: 12795 - protein, 337 aa, unidentified; identical to SEQ ID NO: 8339

SEQ ID NO: 12796 - protein, 333 aa, unidentified; identical to SEQ ID NO: 8351

SEQ ID NO: 12797 - protein, 333 aa, unidentified; identical to SEQ ID NO: 8351

SEQ ID NO: 12798 - protein, 337 aa, unidentified; identical to SEQ ID NO: 8339

SEQ ID NO: 12799 - protein, 337 aa, unidentified; identical to SEQ ID NO: 8339

SEQ ID NO: 12800 - protein, 333 aa, unidentified; identical to SEQ ID NO: 8351

SEQ ID NO: 12801 - protein, 337 aa, unidentified; identical to SEQ ID NO: 8339

SEQ ID NO: 12802 - protein, 337 aa, unidentified; identical to SEQ ID NO: 8339

SEQ ID NO: 12803 - protein, 337 aa, unidentified; identical to SEQ ID NO: 8339

SEQ ID NO: 12804 - protein, 337 aa, unidentified; identical to SEQ ID NO: 8339

SEQ ID NO: 12805 - protein, 337 aa, unidentified; identical to SEQ ID NO: 8339

SEQ ID NO: 12806 - protein, 337 aa, unidentified; identical to SEQ ID NO: 8339

SEQ ID NO: 12807 - protein, 337 aa, unidentified; identical to SEQ ID NO: 8339

SEQ ID NO: 12808 - protein, 217 aa, unidentified; identical to SEQ ID NO: 10987

SEQ ID NO: 12809 - protein, 337 aa, unidentified; identical to SEQ ID NO: 8339

SEQ ID NO: 12810 - protein, 337 aa, unidentified; identical to SEQ ID NO: 8339

SEQ ID NO: 12811 - protein, 270 aa, unidentified; identical to SEQ ID NO: 8331

SEQ ID NO: 12812 - protein, 337 aa, unidentified; identical to SEQ ID NO: 8339

SEQ ID NO: 12813 - protein, 337 aa, unidentified; identical to SEQ ID NO: 8339

SEQ ID NO: 12814 - protein, 217 aa, unidentified; identical to SEQ ID NO: 10987

SEQ ID NO: 12815 - protein, 337 aa, unidentified; identical to SEQ ID NO: 8339

SEQ ID NO: 12816 - protein, 337 aa, unidentified; identical to SEQ ID NO: 8339

SEQ ID NO: 12817 - protein, 337 aa, unidentified; identical to SEQ ID NO: 8339

SEQ ID NO: 12818 - protein, 337 aa, unidentified; identical to SEQ ID NO: 8339

SEQ ID NO: 12819 - protein, 337 aa, unidentified; identical to SEQ ID NO: 8339

SEQ ID NO: 12820 - protein, 333 aa, unidentified; identical to SEQ ID NO: 8351

SEQ ID NO: 12821 - protein, 337 aa, unidentified; identical to SEQ ID NO: 8339

SEQ ID NO: 12822 - protein, 337 aa, unidentified; identical to SEQ ID NO: 8339

SEQ ID NO: 12823 - protein, 337 aa, unidentified; identical to SEQ ID NO: 8339

SEQ ID NO: 12824 - protein, 337 aa, unidentified; identical to SEQ ID NO: 8339

SEQ ID NO: 12825 - protein, 337 aa, unidentified; identical to SEQ ID NO: 8339

SEQ ID NO: 12826 - protein, 337 aa, unidentified; identical to SEQ ID NO: 8339

SEQ ID NO: 12827 - protein, 337 aa, unidentified; identical to SEQ ID NO: 8339

SEQ ID NO: 12828 - protein, 337 aa, unidentified; identical to SEQ ID NO: 8339

SEQ ID NO: 12829 - protein, 337 aa, unidentified; identical to SEQ ID NO: 8339

SEQ ID NO: 12830 - protein, 333 aa, unidentified; identical to SEQ ID NO: 8351

SEQ ID NO: 12831 - protein, 333 aa, unidentified; identical to SEQ ID NO: 8351

SEQ ID NO: 12832 - protein, 337 aa, unidentified; identical to SEQ ID NO: 8339

SEQ ID NO: 12833 - protein, 337 aa, unidentified; identical to SEQ ID NO: 8339

SEQ ID NO: 12834 - protein, 225 aa, unidentified; identical to SEQ ID NO: 12748

SEQ ID NO: 12835 - protein, 337 aa, unidentified; identical to SEQ ID NO: 8339

SEQ ID NO: 12836 - protein, 269 aa, unidentified; identical to SEQ ID NO: 11729

SEQ ID NO: 12837 - protein, 271 aa, unidentified; identical to SEQ ID NO: 12642

SEQ ID NO: 12838 - protein, 271 aa, unidentified; identical to SEQ ID NO: 12642

SEQ ID NO: 12839 - protein, 337 aa, unidentified; identical to SEQ ID NO: 8339

SEQ ID NO: 12840 - protein, 333 aa, unidentified; identical to SEQ ID NO: 8351

SEQ ID NO: 12841 - protein, 337 aa, unidentified; identical to SEQ ID NO: 8339

SEQ ID NO: 12842 - protein, 333 aa, unidentified; identical to SEQ ID NO: 8351

SEQ ID NO: 12843 - protein, 333 aa, unidentified; identical to SEQ ID NO: 8351

SEQ ID NO: 12844 - protein, 337 aa, unidentified; identical to SEQ ID NO: 8339

SEQ ID NO: 12845 - protein, 270 aa, unidentified; identical to SEQ ID NO: 8331

SEQ ID NO: 12846 - protein, 333 aa, unidentified; identical to SEQ ID NO: 8351

SEQ ID NO: 12847 - protein, 278 aa, unidentified; identical to SEQ ID NO: 8332

SEQ ID NO: 12848 - protein, 337 aa, unidentified; identical to SEQ ID NO: 8339

SEQ ID NO: 12849 - protein, 337 aa, unidentified; identical to SEQ ID NO: 8339

SEQ ID NO: 12850 - protein, 310 aa, unidentified; identical to SEQ ID NO: 9321

SEQ ID NO: 12851 - protein, 333 aa, unidentified; identical to SEQ ID NO: 8351

SEQ ID NO: 12852 - protein, 223 aa, unidentified
KPGDFGVAKGSRTIWYMWLGSRFLEFESFGFLNEEHWASRELSGGGVEGIPLNYLGYHLREMAQKPGVLYADDTAGWDTRITMADLEDEGILLDMMSGEHKKLASALFSKAYKVKVALCPRPGPKGGTLMDVISRTDQRGSGQVVTYALNTLTNIKVQLIRMAEAEGVLGATFEDFGIDRWLQEHGEDRVERMLVSGDDCVVNAIDERFGSSLNWLNAMEKVR

SEQ ID NO: 12853 - protein, 337 aa, unidentified; identical to SEQ ID NO: 8339

SEQ ID NO: 12854 - protein, 337 aa, unidentified; identical to SEQ ID NO: 8339

SEQ ID NO: 12855 - protein, 337 aa, unidentified; identical to SEQ ID NO: 8339

SEQ ID NO: 12856 - protein, 311 aa, unidentified; identical to SEQ ID NO: 12351

SEQ ID NO: 12857 - protein, 333 aa, unidentified; identical to SEQ ID NO: 8351

SEQ ID NO: 12858 - protein, 337 aa, unidentified; identical to SEQ ID NO: 8339

SEQ ID NO: 12859 - protein, 334 aa, unidentified; identical to SEQ ID NO: 11898

SEQ ID NO: 12860 - protein, 187 aa, unidentified; identical to SEQ ID NO: 10447

SEQ ID NO: 12861 - protein, 333 aa, unidentified; identical to SEQ ID NO: 8351

SEQ ID NO: 12862 - protein, 337 aa, unidentified; identical to SEQ ID NO: 8339

SEQ ID NO: 12863 - protein, 270 aa, unidentified; identical to SEQ ID NO: 8331

SEQ ID NO: 12864 - protein, 333 aa, unidentified; identical to SEQ ID NO: 8351

SEQ ID NO: 12865 - protein, 337 aa, unidentified; identical to SEQ ID NO: 8339

SEQ ID NO: 12866 - protein, 333 aa, unidentified; identical to SEQ ID NO: 8351

SEQ ID NO: 12867 - protein, 333 aa, unidentified; identical to SEQ ID NO: 8351

SEQ ID NO: 12868 - protein, 337 aa, unidentified; identical to SEQ ID NO: 8339

SEQ ID NO: 12869 - protein, 333 aa, unidentified; identical to SEQ ID NO: 8351

SEQ ID NO: 12870 - protein, 337 aa, unidentified; identical to SEQ ID NO: 8339

SEQ ID NO: 12871 - protein, 337 aa, unidentified; identical to SEQ ID NO: 8339

SEQ ID NO: 12872 - protein, 333 aa, unidentified; identical to SEQ ID NO: 8351

SEQ ID NO: 12873 - protein, 337 aa, unidentified; identical to SEQ ID NO: 8339

SEQ ID NO: 12874 - protein, 337 aa, unidentified; identical to SEQ ID NO: 8339

SEQ ID NO: 12875 - protein, 333 aa, unidentified; identical to SEQ ID NO: 8351

SEQ ID NO: 12876 - protein, 337 aa, unidentified; identical to SEQ ID NO: 8339

SEQ ID NO: 12877 - protein, 337 aa, unidentified; identical to SEQ ID NO: 8339

SEQ ID NO: 12878 - protein, 333 aa, unidentified; identical to SEQ ID NO: 8351

SEQ ID NO: 12879 - protein, 333 aa, unidentified; identical to SEQ ID NO: 8351

SEQ ID NO: 12880 - protein, 333 aa, unidentified; identical to SEQ ID NO: 8351

SEQ ID NO: 12881 - protein, 269 aa, unidentified; identical to SEQ ID NO: 11729

SEQ ID NO: 12882 - protein, 333 aa, unidentified; identical to SEQ ID NO: 8351

SEQ ID NO: 12883 - protein, 333 aa, unidentified; identical to SEQ ID NO: 8351

SEQ ID NO: 12884 - protein, 270 aa, unidentified; identical to SEQ ID NO: 8331

SEQ ID NO: 12885 - protein, 333 aa, unidentified; identical to SEQ ID NO: 8351

SEQ ID NO: 12886 - protein, 337 aa, unidentified; identical to SEQ ID NO: 8339

SEQ ID NO: 12887 - protein, 333 aa, unidentified; identical to SEQ ID NO: 8351

SEQ ID NO: 12888 - protein, 337 aa, unidentified; identical to SEQ ID NO: 8339

SEQ ID NO: 12889 - protein, 337 aa, unidentified; identical to SEQ ID NO: 8339

SEQ ID NO: 12890 - protein, 214 aa, unidentified; identical to SEQ ID NO: 9674

SEQ ID NO: 12891 - protein, 337 aa, unidentified; identical to SEQ ID NO: 8339

SEQ ID NO: 12892 - protein, 337 aa, unidentified; identical to SEQ ID NO: 8339

SEQ ID NO: 12893 - protein, 337 aa, unidentified; identical to SEQ ID NO: 8339

SEQ ID NO: 12894 - protein, 337 aa, unidentified; identical to SEQ ID NO: 8339

SEQ ID NO: 12895 - protein, 337 aa, unidentified; identical to SEQ ID NO: 8339

SEQ ID NO: 12896 - protein, 337 aa, unidentified; identical to SEQ ID NO: 8339

SEQ ID NO: 12897 - protein, 337 aa, unidentified; identical to SEQ ID NO: 8339

SEQ ID NO: 12898 - protein, 337 aa, unidentified; identical to SEQ ID NO: 8339

SEQ ID NO: 12899 - protein, 311 aa, unidentified
EALGFLNEERWASRDISGGGVEGIGINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCSHHFHELFLRDGRKLIVPCRDQHELVGRSMVSQGGSSGVAGTACLAKAYAQMWLMSYFHRRDLRTLGFGIMSSVPKDWFPTGRTTWSVHANHE

SEQ ID NO: 12900 - protein, 333 aa, unidentified; identical to SEQ ID NO: 8351

SEQ ID NO: 12901 - protein, 337 aa, unidentified; identical to SEQ ID NO: 8339

SEQ ID NO: 12902 - protein, 275 aa, unidentified; identical to SEQ ID NO: 11524

SEQ ID NO: 12903 - protein, 337 aa, unidentified; identical to SEQ ID NO: 8339

SEQ ID NO: 12904 - protein, 337 aa, unidentified; identical to SEQ ID NO: 8339

SEQ ID NO: 12905 - protein, 333 aa, unidentified; identical to SEQ ID NO: 8351

SEQ ID NO: 12906 - protein, 333 aa, unidentified; identical to SEQ ID NO: 8351

SEQ ID NO: 12907 - protein, 337 aa, unidentified; identical to SEQ ID NO: 8339

SEQ ID NO: 12908 - protein, 337 aa, unidentified; identical to SEQ ID NO: 8339

SEQ ID NO: 12909 - protein, 337 aa, unidentified; identical to SEQ ID NO: 8339

SEQ ID NO: 12910 - protein, 306 aa, unidentified; identical to SEQ ID NO: 10939

SEQ ID NO: 12911 - protein, 337 aa, unidentified; identical to SEQ ID NO: 8339

SEQ ID NO: 12912 - protein, 337 aa, unidentified; identical to SEQ ID NO: 8339

SEQ ID NO: 12913 - protein, 337 aa, unidentified; identical to SEQ ID NO: 8339

SEQ ID NO: 12914 - protein, 337 aa, unidentified; identical to SEQ ID NO: 8339

SEQ ID NO: 12915 - protein, 302 aa, unidentified
SRFLEFESFGFLNEEHWASRELSGGGVESIPLFYLGYHLREMAKKPGKLYADDTAGWDTRITEADLDDECILCDYMEDEHKQLALSLFELCYKNKVALCPRPGRHGGTVMDVIFRRDQRGSGQVVTYALNTLTNIKVQLIRLAESEGVLDEDFNDHGIETWLNHYGEERLSRLLISGDDCLVNAFDERFGKALTWLNTMEKIRKDIDLCAPSNGYENFEKVEFCSNHFHELMLKDGRQLVVPCRSQNELVGRASVNQGGSATVAGTACLAKAYAQMWNLLYFHRRDLRLLGFAIMSATPSNW

SEQ ID NO: 12916 - protein, 306 aa, unidentified
RTIWYMWLGSRFLEFEALGFLNEERWASRDISGGGVEGIGINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCSHHFHELFLRDGRKLIVPCRDQHELVGRSMVSQGGSSGVAGTACLAKAYAQMWLMSYFHRRDLRTLGFGIMSS

SEQ ID NO: 12917 - protein, 201 aa, unidentified
DDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCSHHFHELFLRDGRKLIVPCRDQHELVGR

SEQ ID NO: 12918 - protein, 337 aa, unidentified; identical to SEQ ID NO: 8339

SEQ ID NO: 12919 - protein, 337 aa, unidentified; identical to SEQ ID NO: 8339

SEQ ID NO: 12920 - protein, 97 aa, unidentified; identical to SEQ ID NO: 12372

SEQ ID NO: 12921 - protein, 270 aa, unidentified; identical to SEQ ID NO: 8331

SEQ ID NO: 12922 - protein, 264 aa, unidentified; identical to SEQ ID NO: 11150

SEQ ID NO: 12923 - protein, 333 aa, unidentified; identical to SEQ ID NO: 8351

SEQ ID NO: 12924 - protein, 337 aa, unidentified; identical to SEQ ID NO: 8339

SEQ ID NO: 12925 - protein, 337 aa, unidentified; identical to SEQ ID NO: 8339

SEQ ID NO: 12926 - protein, 337 aa, unidentified; identical to SEQ ID NO: 8339

SEQ ID NO: 12927 - protein, 337 aa, unidentified; identical to SEQ ID NO: 8339

SEQ ID NO: 12928 - protein, 337 aa, unidentified; identical to SEQ ID NO: 8339

SEQ ID NO: 12929 - protein, 333 aa, unidentified; identical to SEQ ID NO: 8351

SEQ ID NO: 12930 - protein, 337 aa, unidentified; identical to SEQ ID NO: 8339

SEQ ID NO: 12931 - protein, 337 aa, unidentified; identical to SEQ ID NO: 8339

SEQ ID NO: 12932 - protein, 337 aa, unidentified; identical to SEQ ID NO: 8339

SEQ ID NO: 12933 - protein, 337 aa, unidentified; identical to SEQ ID NO: 8339

SEQ ID NO: 12934 - protein, 337 aa, unidentified; identical to SEQ ID NO: 8339

SEQ ID NO: 12935 - protein, 337 aa, unidentified; identical to SEQ ID NO: 8339

SEQ ID NO: 12936 - protein, 337 aa, unidentified; identical to SEQ ID NO: 8339

SEQ ID NO: 12937 - protein, 337 aa, unidentified; identical to SEQ ID NO: 8339

SEQ ID NO: 12938 - protein, 337 aa, unidentified; identical to SEQ ID NO: 8339

SEQ ID NO: 12939 - protein, 337 aa, unidentified; identical to SEQ ID NO: 8339

SEQ ID NO: 12940 - protein, 337 aa, unidentified; identical to SEQ ID NO: 8339

SEQ ID NO: 12941 - protein, 333 aa, unidentified; identical to SEQ ID NO: 8351

SEQ ID NO: 12942 - protein, 319 aa, unidentified; identical to SEQ ID NO: 10694

SEQ ID NO: 12943 - protein, 337 aa, unidentified; identical to SEQ ID NO: 8339

SEQ ID NO: 12944 - protein, 337 aa, unidentified; identical to SEQ ID NO: 8339

SEQ ID NO: 12945 - protein, 337 aa, unidentified; identical to SEQ ID NO: 8339

SEQ ID NO: 12946 - protein, 337 aa, unidentified; identical to SEQ ID NO: 8339

SEQ ID NO: 12947 - protein, 337 aa, unidentified; identical to SEQ ID NO: 8339

SEQ ID NO: 12948 - protein, 333 aa, unidentified; identical to SEQ ID NO: 8351

SEQ ID NO: 12949 - protein, 337 aa, unidentified; identical to SEQ ID NO: 8339

SEQ ID NO: 12950 - protein, 337 aa, unidentified; identical to SEQ ID NO: 8339

SEQ ID NO: 12951 - protein, 337 aa, unidentified; identical to SEQ ID NO: 8339

SEQ ID NO: 12952 - protein, 337 aa, unidentified; identical to SEQ ID NO: 8339

SEQ ID NO: 12953 - protein, 337 aa, unidentified; identical to SEQ ID NO: 8339

SEQ ID NO: 12954 - protein, 337 aa, unidentified; identical to SEQ ID NO: 8339

SEQ ID NO: 12955 - protein, 333 aa, unidentified; identical to SEQ ID NO: 8351

SEQ ID NO: 12956 - protein, 337 aa, unidentified; identical to SEQ ID NO: 8339

SEQ ID NO: 12957 - protein, 337 aa, unidentified; identical to SEQ ID NO: 8339

SEQ ID NO: 12958 - protein, 333 aa, unidentified; identical to SEQ ID NO: 8351

SEQ ID NO: 12959 - protein, 337 aa, unidentified; identical to SEQ ID NO: 8339

SEQ ID NO: 12960 - protein, 337 aa, unidentified; identical to SEQ ID NO: 8339

SEQ ID NO: 12961 - protein, 337 aa, unidentified; identical to SEQ ID NO: 8339

SEQ ID NO: 12962 - protein, 337 aa, unidentified; identical to SEQ ID NO: 8339

SEQ ID NO: 12963 - protein, 310 aa, unidentified; identical to SEQ ID NO: 9321

SEQ ID NO: 12964 - protein, 310 aa, unidentified; identical to SEQ ID NO: 9321

SEQ ID NO: 12965 - protein, 337 aa, unidentified; identical to SEQ ID NO: 8339

SEQ ID NO: 12966 - protein, 159 aa, unidentified
GVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTRED

SEQ ID NO: 12967 - protein, 333 aa, unidentified; identical to SEQ ID NO: 8351

SEQ ID NO: 12968 - protein, 333 aa, unidentified; identical to SEQ ID NO: 8351

SEQ ID NO: 12969 - protein, 337 aa, unidentified; identical to SEQ ID NO: 8339

SEQ ID NO: 12970 - protein, 311 aa, unidentified; identical to SEQ ID NO: 12351

SEQ ID NO: 12971 - protein, 311 aa, unidentified; identical to SEQ ID NO: 12351

SEQ ID NO: 12972 - protein, 333 aa, unidentified; identical to SEQ ID NO: 8351

SEQ ID NO: 12973 - protein, 219 aa, unidentified
PHHRALIAVTMRLAYQNIAAVFPRTQSKYGSGFVMDFLGRRDQRGSGQVVTFALNTITNGKVQVARVLESEGLLHADESVLDAWLEKHLEEALGNMVIAGEEVVVSTTNRDFSSALEYLELTGKTRKNVPQGAPSRMESDWEKVEFCFHHYHEMCLKDGRILIAPCRHENEVLGRSRLQKGGVVSIPESACMAKAYAQMWALYFFHRRDLRLGFIAISS

SEQ ID NO: 12974 - protein, 269 aa, unidentified; identical to SEQ ID NO: 11729

SEQ ID NO: 12975 - protein, 333 aa, unidentified; identical to SEQ ID NO: 8351

SEQ ID NO: 12976 - protein, 333 aa, unidentified; identical to SEQ ID NO: 8351

SEQ ID NO: 12977 - protein, 337 aa, unidentified; identical to SEQ ID NO: 8339

SEQ ID NO: 12978 - protein, 337 aa, unidentified; identical to SEQ ID NO: 8339

SEQ ID NO: 12979 - protein, 333 aa, unidentified; identical to SEQ ID NO: 8351

SEQ ID NO: 12980 - protein, 333 aa, unidentified; identical to SEQ ID NO: 8351

SEQ ID NO: 12981 - protein, 333 aa, unidentified; identical to SEQ ID NO: 8351

SEQ ID NO: 12982 - protein, 264 aa, unidentified; identical to SEQ ID NO: 11150

SEQ ID NO: 12983 - protein, 333 aa, unidentified; identical to SEQ ID NO: 8351

SEQ ID NO: 12984 - protein, 333 aa, unidentified; identical to SEQ ID NO: 8351

SEQ ID NO: 12985 - protein, 333 aa, unidentified; identical to SEQ ID NO: 8351

SEQ ID NO: 12986 - protein, 333 aa, unidentified; identical to SEQ ID NO: 8351

SEQ ID NO: 12987 - protein, 333 aa, unidentified; identical to SEQ ID NO: 8351

SEQ ID NO: 12988 - protein, 333 aa, unidentified; identical to SEQ ID NO: 8351

SEQ ID NO: 12989 - protein, 333 aa, unidentified; identical to SEQ ID NO: 8351

SEQ ID NO: 12990 - protein, 337 aa, unidentified; identical to SEQ ID NO: 8339

SEQ ID NO: 12991 - protein, 257 aa, unidentified
KPGEFGVAKGSRTIWYMWLGSRFLEFEALGFLNEERWASRDISGGGVEGIGINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCSHHFHELFLRDGR

SEQ ID NO: 12992 - protein, 333 aa, unidentified; identical to SEQ ID NO: 8351

SEQ ID NO: 12993 - protein, 337 aa, unidentified; identical to SEQ ID NO: 8339

SEQ ID NO: 12994 - protein, 333 aa, unidentified; identical to SEQ ID NO: 8351

SEQ ID NO: 12995 - protein, 337 aa, unidentified; identical to SEQ ID NO: 8339

SEQ ID NO: 12996 - protein, 238 aa, unidentified
GVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCSHHFHELFLRDGRKLIVPCRDQHELVGRSMVSQGGSSGVAGTACLAKAYAQMWLMSYFHR

SEQ ID NO: 12997 - protein, 333 aa, unidentified; identical to SEQ ID NO: 8351

SEQ ID NO: 12998 - protein, 333 aa, unidentified; identical to SEQ ID NO: 8351

SEQ ID NO: 12999 - protein, 333 aa, unidentified; identical to SEQ ID NO: 8351

SEQ ID NO: 13000 - protein, 337 aa, unidentified; identical to SEQ ID NO: 8339

SEQ ID NO: 13001 - protein, 333 aa, unidentified; identical to SEQ ID NO: 8351

SEQ ID NO: 13002 - protein, 333 aa, unidentified; identical to SEQ ID NO: 8351

SEQ ID NO: 13003 - protein, 333 aa, unidentified; identical to SEQ ID NO: 8351

SEQ ID NO: 13004 - protein, 311 aa, unidentified; identical to SEQ ID NO: 12351

SEQ ID NO: 13005 - protein, 217 aa, unidentified; identical to SEQ ID NO: 10987

SEQ ID NO: 13006 - protein, 333 aa, unidentified; identical to SEQ ID NO: 8351

SEQ ID NO: 13007 - protein, 333 aa, unidentified; identical to SEQ ID NO: 8351

SEQ ID NO: 13008 - protein, 333 aa, unidentified; identical to SEQ ID NO: 8351

SEQ ID NO: 13009 - protein, 333 aa, unidentified; identical to SEQ ID NO: 8351

SEQ ID NO: 13010 - protein, 270 aa, unidentified; identical to SEQ ID NO: 8331

SEQ ID NO: 13011 - protein, 337 aa, unidentified; identical to SEQ ID NO: 8339

SEQ ID NO: 13012 - protein, 333 aa, unidentified; identical to SEQ ID NO: 8351

SEQ ID NO: 13013 - protein, 333 aa, unidentified; identical to SEQ ID NO: 8351

SEQ ID NO: 13014 - protein, 333 aa, unidentified; identical to SEQ ID NO: 8351

SEQ ID NO: 13015 - protein, 337 aa, unidentified; identical to SEQ ID NO: 8339

SEQ ID NO: 13016 - protein, 271 aa, unidentified; identical to SEQ ID NO: 10816

SEQ ID NO: 13017 - protein, 92 aa, unidentified
KNLIRTQESLNILEKIVANLSSNQMILSDQVTIDQSTIENILSDLTEHGLRLNEAEKSFNNSHLCIVRNETHDVNHLLRVTHTYNLTTFYHD

SEQ ID NO: 13018 - protein, 337 aa, unidentified; identical to SEQ ID NO: 8339

SEQ ID NO: 13019 - protein, 337 aa, unidentified; identical to SEQ ID NO: 8339

SEQ ID NO: 13020 - protein, 337 aa, unidentified; identical to SEQ ID NO: 8339

SEQ ID NO: 13021 - protein, 337 aa, unidentified; identical to SEQ ID NO: 8339

SEQ ID NO: 13022 - protein, 337 aa, unidentified; identical to SEQ ID NO: 8339

SEQ ID NO: 13023 - protein, 337 aa, unidentified; identical to SEQ ID NO: 8339

SEQ ID NO: 13024 - protein, 337 aa, unidentified; identical to SEQ ID NO: 8339

SEQ ID NO: 13025 - protein, 337 aa, unidentified; identical to SEQ ID NO: 8339

SEQ ID NO: 13026 - protein, 313 aa, unidentified; identical to SEQ ID NO: 11639

SEQ ID NO: 13027 - protein, 337 aa, unidentified; identical to SEQ ID NO: 8339

SEQ ID NO: 13028 - protein, 337 aa, unidentified; identical to SEQ ID NO: 8339

SEQ ID NO: 13029 - protein, 333 aa, unidentified; identical to SEQ ID NO: 8351

SEQ ID NO: 13030 - protein, 267 aa, unidentified
GILYADDTAGWDTRITMADLEDEYTLTELMEGEHKKLAETLFNFAYKNKVALCPRPGKNGGTVLDVISRTDQRGSGQVVTYALNTLTNIKVQLIRMAESEGVLDEEFHDNGMLKWLEKHGRDRLQRLMVSGDDCVVNAIDERFGKSLVWLNEMQKIRKDIDLWKPSAGHCNWEEVEFCSNHFHKLVMRDGRTLVVPCRHEVELVGRASVNQGGSTGISGTACLAKAYAQMWLLLYFHRRDLRILGMAICSAVPANWVPTGRTTWSLH

SEQ ID NO: 13031 - protein, 337 aa, unidentified; identical to SEQ ID NO: 8339

SEQ ID NO: 13032 - protein, 337 aa, unidentified; identical to SEQ ID NO: 8339

SEQ ID NO: 13033 - protein, 337 aa, unidentified; identical to SEQ ID NO: 8339

SEQ ID NO: 13034 - protein, 337 aa, unidentified; identical to SEQ ID NO: 8339

SEQ ID NO: 13035 - protein, 337 aa, unidentified; identical to SEQ ID NO: 8339

SEQ ID NO: 13036 - protein, 337 aa, unidentified; identical to SEQ ID NO: 8339

SEQ ID NO: 13037 - protein, 337 aa, unidentified; identical to SEQ ID NO: 8339

SEQ ID NO: 13038 - protein, 337 aa, unidentified; identical to SEQ ID NO: 8339

SEQ ID NO: 13039 - protein, 337 aa, unidentified; identical to SEQ ID NO: 8339

SEQ ID NO: 13040 - protein, 337 aa, unidentified; identical to SEQ ID NO: 8339

SEQ ID NO: 13041 - protein, 337 aa, unidentified; identical to SEQ ID NO: 8339

SEQ ID NO: 13042 - protein, 337 aa, unidentified; identical to SEQ ID NO: 8339

SEQ ID NO: 13043 - protein, 337 aa, unidentified; identical to SEQ ID NO: 8339

SEQ ID NO: 13044 - protein, 327 aa, unidentified; identical to SEQ ID NO: 11381

SEQ ID NO: 13045 - protein, 337 aa, unidentified; identical to SEQ ID NO: 8339

SEQ ID NO: 13046 - protein, 337 aa, unidentified; identical to SEQ ID NO: 8339

SEQ ID NO: 13047 - protein, 332 aa, unidentified
KPGEFGVAKGSRTIWYMWLGSRFLEFEALGFLNEERWASRDISGGGVEGIGINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCSHHFHELFLRDGRKLIVPCRDQHELVGRSMVSQGGSSGVAGTACLAKAYAQMWLMSYFHRRDLRTLGFGIMSSVPKDWFPTGRTTWSV

SEQ ID NO: 13048 - protein, 337 aa, unidentified; identical to SEQ ID NO: 8339

SEQ ID NO: 13049 - protein, 337 aa, unidentified; identical to SEQ ID NO: 8339

SEQ ID NO: 13050 - protein, 213 aa, unidentified; identical to SEQ ID NO: 12272

SEQ ID NO: 13051 - protein, 337 aa, unidentified; identical to SEQ ID NO: 8339

SEQ ID NO: 13052 - protein, 337 aa, unidentified; identical to SEQ ID NO: 8339

SEQ ID NO: 13053 - protein, 337 aa, unidentified; identical to SEQ ID NO: 8339

SEQ ID NO: 13054 - protein, 337 aa, unidentified; identical to SEQ ID NO: 8339

SEQ ID NO: 13055 - protein, 337 aa, unidentified; identical to SEQ ID NO: 8339

SEQ ID NO: 13056 - protein, 337 aa, unidentified; identical to SEQ ID NO: 8339

SEQ ID NO: 13057 - protein, 337 aa, unidentified; identical to SEQ ID NO: 8339

SEQ ID NO: 13058 - protein, 337 aa, unidentified; identical to SEQ ID NO: 8339

SEQ ID NO: 13059 - protein, 332 aa, unidentified; identical to SEQ ID NO: 13047

SEQ ID NO: 13060 - protein, 337 aa, unidentified; identical to SEQ ID NO: 8339

SEQ ID NO: 13061 - protein, 337 aa, unidentified; identical to SEQ ID NO: 8339

SEQ ID NO: 13062 - protein, 337 aa, unidentified; identical to SEQ ID NO: 8339

SEQ ID NO: 13063 - protein, 337 aa, unidentified; identical to SEQ ID NO: 8339

SEQ ID NO: 13064 - protein, 337 aa, unidentified; identical to SEQ ID NO: 8339

SEQ ID NO: 13065 - protein, 337 aa, unidentified; identical to SEQ ID NO: 8339

SEQ ID NO: 13066 - protein, 337 aa, unidentified; identical to SEQ ID NO: 8339

SEQ ID NO: 13067 - protein, 246 aa, unidentified; identical to SEQ ID NO: 11888

SEQ ID NO: 13068 - protein, 337 aa, unidentified; identical to SEQ ID NO: 8339

SEQ ID NO: 13069 - protein, 333 aa, unidentified; identical to SEQ ID NO: 8351

SEQ ID NO: 13070 - protein, 337 aa, unidentified; identical to SEQ ID NO: 8339

SEQ ID NO: 13071 - protein, 333 aa, unidentified; identical to SEQ ID NO: 8351

SEQ ID NO: 13072 - protein, 337 aa, unidentified; identical to SEQ ID NO: 8339

SEQ ID NO: 13073 - protein, 337 aa, unidentified; identical to SEQ ID NO: 8339

SEQ ID NO: 13074 - protein, 337 aa, unidentified; identical to SEQ ID NO: 8339

SEQ ID NO: 13075 - protein, 337 aa, unidentified; identical to SEQ ID NO: 8339

SEQ ID NO: 13076 - protein, 337 aa, unidentified; identical to SEQ ID NO: 8339

SEQ ID NO: 13077 - protein, 337 aa, unidentified; identical to SEQ ID NO: 8339

SEQ ID NO: 13078 - protein, 337 aa, unidentified; identical to SEQ ID NO: 8339

SEQ ID NO: 13079 - protein, 337 aa, unidentified; identical to SEQ ID NO: 8339

SEQ ID NO: 13080 - protein, 337 aa, unidentified; identical to SEQ ID NO: 8339

SEQ ID NO: 13081 - protein, 337 aa, unidentified; identical to SEQ ID NO: 8339

SEQ ID NO: 13082 - protein, 337 aa, unidentified; identical to SEQ ID NO: 8339

SEQ ID NO: 13083 - protein, 270 aa, unidentified; identical to SEQ ID NO: 8331

SEQ ID NO: 13084 - protein, 337 aa, unidentified; identical to SEQ ID NO: 8339

SEQ ID NO: 13085 - protein, 337 aa, unidentified; identical to SEQ ID NO: 8339

SEQ ID NO: 13086 - protein, 337 aa, unidentified; identical to SEQ ID NO: 8339

SEQ ID NO: 13087 - protein, 337 aa, unidentified; identical to SEQ ID NO: 8339

SEQ ID NO: 13088 - protein, 337 aa, unidentified; identical to SEQ ID NO: 8339

SEQ ID NO: 13089 - protein, 337 aa, unidentified; identical to SEQ ID NO: 8339

SEQ ID NO: 13090 - protein, 337 aa, unidentified; identical to SEQ ID NO: 8339

SEQ ID NO: 13091 - protein, 337 aa, unidentified; identical to SEQ ID NO: 8339

SEQ ID NO: 13092 - protein, 337 aa, unidentified; identical to SEQ ID NO: 8339

SEQ ID NO: 13093 - protein, 337 aa, unidentified; identical to SEQ ID NO: 8339

SEQ ID NO: 13094 - protein, 337 aa, unidentified; identical to SEQ ID NO: 8339

SEQ ID NO: 13095 - protein, 337 aa, unidentified; identical to SEQ ID NO: 8339

SEQ ID NO: 13096 - protein, 337 aa, unidentified; identical to SEQ ID NO: 8339

SEQ ID NO: 13097 - protein, 337 aa, unidentified; identical to SEQ ID NO: 8339

SEQ ID NO: 13098 - protein, 337 aa, unidentified; identical to SEQ ID NO: 8339

SEQ ID NO: 13099 - protein, 261 aa, unidentified; identical to SEQ ID NO: 11471

SEQ ID NO: 13100 - protein, 337 aa, unidentified; identical to SEQ ID NO: 8339

SEQ ID NO: 13101 - protein, 337 aa, unidentified; identical to SEQ ID NO: 8339

SEQ ID NO: 13102 - protein, 337 aa, unidentified; identical to SEQ ID NO: 8339

SEQ ID NO: 13103 - protein, 337 aa, unidentified; identical to SEQ ID NO: 8339

SEQ ID NO: 13104 - protein, 337 aa, unidentified; identical to SEQ ID NO: 8339

SEQ ID NO: 13105 - protein, 337 aa, unidentified; identical to SEQ ID NO: 8339

SEQ ID NO: 13106 - protein, 337 aa, unidentified; identical to SEQ ID NO: 8339

SEQ ID NO: 13107 - protein, 337 aa, unidentified; identical to SEQ ID NO: 8339

SEQ ID NO: 13108 - protein, 337 aa, unidentified; identical to SEQ ID NO: 8339

SEQ ID NO: 13109 - protein, 333 aa, unidentified; identical to SEQ ID NO: 8351

SEQ ID NO: 13110 - protein, 337 aa, unidentified; identical to SEQ ID NO: 8339

SEQ ID NO: 13111 - protein, 270 aa, unidentified; identical to SEQ ID NO: 8331

SEQ ID NO: 13112 - protein, 333 aa, unidentified; identical to SEQ ID NO: 8351

SEQ ID NO: 13113 - protein, 337 aa, unidentified; identical to SEQ ID NO: 8339

SEQ ID NO: 13114 - protein, 337 aa, unidentified; identical to SEQ ID NO: 8339

SEQ ID NO: 13115 - protein, 337 aa, unidentified; identical to SEQ ID NO: 8339

SEQ ID NO: 13116 - protein, 337 aa, unidentified; identical to SEQ ID NO: 8339

SEQ ID NO: 13117 - protein, 337 aa, unidentified; identical to SEQ ID NO: 8339

SEQ ID NO: 13118 - protein, 264 aa, unidentified; identical to SEQ ID NO: 11150

SEQ ID NO: 13119 - protein, 337 aa, unidentified; identical to SEQ ID NO: 8339

SEQ ID NO: 13120 - protein, 337 aa, unidentified; identical to SEQ ID NO: 8339

SEQ ID NO: 13121 - protein, 337 aa, unidentified; identical to SEQ ID NO: 8339

SEQ ID NO: 13122 - protein, 337 aa, unidentified; identical to SEQ ID NO: 8339

SEQ ID NO: 13123 - protein, 337 aa, unidentified; identical to SEQ ID NO: 8339

SEQ ID NO: 13124 - protein, 337 aa, unidentified; identical to SEQ ID NO: 8339

SEQ ID NO: 13125 - protein, 337 aa, unidentified; identical to SEQ ID NO: 8339

SEQ ID NO: 13126 - protein, 337 aa, unidentified; identical to SEQ ID NO: 8339

SEQ ID NO: 13127 - protein, 337 aa, unidentified; identical to SEQ ID NO: 8339

SEQ ID NO: 13128 - protein, 337 aa, unidentified; identical to SEQ ID NO: 8339

SEQ ID NO: 13129 - protein, 337 aa, unidentified; identical to SEQ ID NO: 8339

SEQ ID NO: 13130 - protein, 337 aa, unidentified; identical to SEQ ID NO: 8339

SEQ ID NO: 13131 - protein, 333 aa, unidentified; identical to SEQ ID NO: 8351

SEQ ID NO: 13132 - protein, 337 aa, unidentified; identical to SEQ ID NO: 8339

SEQ ID NO: 13133 - protein, 337 aa, unidentified; identical to SEQ ID NO: 8339

SEQ ID NO: 13134 - protein, 337 aa, unidentified; identical to SEQ ID NO: 8339

SEQ ID NO: 13135 - protein, 323 aa, unidentified; identical to SEQ ID NO: 12777

SEQ ID NO: 13136 - protein, 337 aa, unidentified; identical to SEQ ID NO: 8339

SEQ ID NO: 13137 - protein, 337 aa, unidentified; identical to SEQ ID NO: 8339

SEQ ID NO: 13138 - protein, 318 aa, unidentified
KPGEFGVAKGSRTIWYMWLGSRFLEFEALGFLNEERWASRDISGGGVEGIGINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCSHHFHELFLRDGRKLIVPCRDQHELVGRSMVSQGGSSGVAGTACLAKAYAQMWLMSYFHRRDLRTLGFGIMSSV

SEQ ID NO: 13139 - protein, 337 aa, unidentified; identical to SEQ ID NO: 8339

SEQ ID NO: 13140 - protein, 337 aa, unidentified; identical to SEQ ID NO: 8339

SEQ ID NO: 13141 - protein, 131 aa, unidentified
DDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVV

SEQ ID NO: 13142 - protein, 311 aa, unidentified; identical to SEQ ID NO: 12351

SEQ ID NO: 13143 - protein, 337 aa, unidentified; identical to SEQ ID NO: 8339

SEQ ID NO: 13144 - protein, 298 aa, unidentified
SRTIWYMWLGSRFLEFEALGFLNEERWASRDISGGGVEGIGINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCSHHFHELFLRDGRKLIVPCRDQHELVGRSMVSQGGSSGVAGTACLAKAYAQMWLMSYFHRRDLR

SEQ ID NO: 13145 - protein, 309 aa, unidentified; identical to SEQ ID NO: 12347

SEQ ID NO: 13146 - protein, 337 aa, unidentified; identical to SEQ ID NO: 8339

SEQ ID NO: 13147 - protein, 311 aa, unidentified; identical to SEQ ID NO: 12351

SEQ ID NO: 13148 - protein, 309 aa, unidentified
KGSRTIWYMWLGSRFLEFESFGFLNEEHWASRELCGGGVEGIPLFYLGYHLEKMAEKAGILYADDTAGWDTRITMADLEDEYTLTELMEGEHKKLAETLFNFAYKNKVALCPRPGKNGGTVLDVISRTDQRGSGQVVTYALNTLTNIKVQLIRMAESEGVLDEEFHDNGMLKWLEKHGRDRLQRLMVSGDDCVVNAIDERFGKSLVWLNEMQKIRKDIDLWKPSAGHCNWEEVEFCSNHFHKLVMRDGRTLVVPCRHEVELVGRASVNQGGSTGISGTACLAKAYAQMWLLLYFHRRDLRILGMAICSA

SEQ ID NO: 13149 - protein, 309 aa, unidentified; identical to SEQ ID NO: 13148

SEQ ID NO: 13150 - protein, 313 aa, unidentified; identical to SEQ ID NO: 8356

SEQ ID NO: 13151 - protein, 313 aa, unidentified; identical to SEQ ID NO: 8356

SEQ ID NO: 13152 - protein, 303 aa, unidentified; identical to SEQ ID NO: 8684

SEQ ID NO: 13153 - protein, 333 aa, unidentified; identical to SEQ ID NO: 8351

SEQ ID NO: 13154 - protein, 250 aa, unidentified
DDTAGWDTRITEADLDDECILCDYMEDEHKQLALSLFELCYKNKVALCPRPGRHGGTVMDVIFRRDQRGSGQVVTYALNTLTNIKVQLIRLAESEGVLDEDFNDHGIETWLNHYGEERLSRLLISGDDCLVNAFDERFGKALTWLNTMEKIRKDIDLCAPSNGYENFEKVEFCSNHFHELMLKDGRQLVVPCRSQNELVGRASVNQGGSATVAGTACLAKAYAQMWNLLYFHRRDLRLLGFAIMSATPSN

SEQ ID NO: 13155 - protein, 309 aa, unidentified; identical to SEQ ID NO: 13148

SEQ ID NO: 13156 - protein, 313 aa, unidentified; identical to SEQ ID NO: 8356

SEQ ID NO: 13157 - protein, 313 aa, unidentified; identical to SEQ ID NO: 8356

SEQ ID NO: 13158 - protein, 242 aa, unidentified; identical to SEQ ID NO: 9313

SEQ ID NO: 13159 - protein, 83 aa, unidentified; identical to SEQ ID NO: 9347

SEQ ID NO: 13160 - protein, 242 aa, unidentified; identical to SEQ ID NO: 9313

SEQ ID NO: 13161 - protein, 39 aa, unidentified
TSDMVHTPTNLADVLTSMVEEAKQEVSYNHTASRSVKTL

SEQ ID NO: 13162 - protein, 202 aa, unidentified; identical to SEQ ID NO: 10449

SEQ ID NO: 13163 - protein, 313 aa, unidentified; identical to SEQ ID NO: 8356

SEQ ID NO: 13164 - protein, 316 aa, unidentified
SRTIWYMWLGSRFLEFESFGFLNEEHWASRELSGGGVESIPLFYLGYHLREMAKKPGKLYADDTAGWDTRITEADLDDECILCDYMEDEHKQLALSLFELCYKNKVALCPRPGRHGGTVMDVIFRRDQRGSGQVVTYALNTLTNIKVQLIRLAESEGVLDEDFNDHGIETWLNHYGEERLSRLLISGDDCLVNAFDERFGKALTWLNTMEKIRKDIDLCAPSNGYENFEKVEFCSNHFHELMLKDGRQLVVPCRSQNELVGRASVNQGGSATVAGTACLAKAYAQMWNLLYFHRRDLRLLGFAIMSATPSNWIPTG

SEQ ID NO: 13165 - protein, 258 aa, unidentified; identical to SEQ ID NO: 8309

SEQ ID NO: 13166 - protein, 248 aa, unidentified; identical to SEQ ID NO: 8593

SEQ ID NO: 13167 - protein, 166 aa, unidentified; identical to SEQ ID NO: 9897

SEQ ID NO: 13168 - protein, 71 aa, unidentified
LILGESILYPSAEEYDCTWMQTNEKITDRFLITAISFQFNSTGSLINPQLGSECNVFNSSFCVHRNKAYML

SEQ ID NO: 13169 - protein, 337 aa, unidentified; identical to SEQ ID NO: 8339

SEQ ID NO: 13170 - protein, 324 aa, unidentified
GSRTIWYMWLGSRFLEFESFGFLNEEHWASRELCGGGVEGIPLFYLGYHLEKMAEKAGILYADDTAGWDTRITMADLEDEYTLTELMEGEHKKLAETLFNFAYKNKVALCPRPGKNGGTVLDVISRTDQRGSGQVVTYALNTLTNIKVQLIRMAESEGVLDEEFHDNGMLKWLEKHGRDRLQRLMVSGDDCVVNAIDERFGKSLVWLNEMQKIRKDIDLWKPSAGHCNWEEVEFCSNHFHKLVMRDGRTLVVPCRHEVELVGRASVNQGGSTGISGTACLAKAYAQMWLLLYFHRRDLRILGMAICSAVPANWVPTGRTTWSLH

SEQ ID NO: 13171 - protein, 127 aa, unidentified; identical to SEQ ID NO: 8344

SEQ ID NO: 13172 - protein, 39 aa, unidentified; identical to SEQ ID NO: 13161

SEQ ID NO: 13173 - protein, 39 aa, unidentified; identical to SEQ ID NO: 13161

SEQ ID NO: 13174 - protein, 96 aa, unidentified
TIQGKLVSYRTTEDPKCCIRHSRISGCCKSTPMEMPRVILENPCTKSLIAKGAKIPPYVPEEEWTRNVCIFSWYPRAGFSQALAVPQKCCDKLRGV

SEQ ID NO: 13175 - protein, 313 aa, unidentified; identical to SEQ ID NO: 8356

SEQ ID NO: 13176 - protein, 250 aa, unidentified; identical to SEQ ID NO: 13154

SEQ ID NO: 13177 - protein, 313 aa, unidentified
AKGSRTIWYMWLGSRFLEFESFGFLNEEHWASRELSGGGVESIPLFYLGYHLREMAKKPGKLYADDTAGWDTRITEADLDDECILCDYMEDEHKQLALSLFELCYKNKVALCPRPGRHGGTVMDVIFRRDQRGSGQVVTYALNTLTNIKVQLIRLAESEGVLDEDFNDHGIETWLNHYGEERLSRLLISGDDCLVNAFDERFGKALTWLNTMEKIRKDIDLCAPSNGYENFEKVEFCSNHFHELMLKDGRQLVVPCRSQNELVGRASVNQGGSATVAGTACLAKAYAQMWNLLYFHRRDLRLLGFAIMSATPS

SEQ ID NO: 13178 - protein, 313 aa, unidentified; identical to SEQ ID NO: 8356

SEQ ID NO: 13179 - protein, 313 aa, unidentified; identical to SEQ ID NO: 8356

SEQ ID NO: 13180 - protein, 313 aa, unidentified; identical to SEQ ID NO: 8356

SEQ ID NO: 13181 - protein, 309 aa, unidentified; identical to SEQ ID NO: 13148

SEQ ID NO: 13182 - protein, 39 aa, unidentified; identical to SEQ ID NO: 13161

SEQ ID NO: 13183 - protein, 86 aa, unidentified; identical to SEQ ID NO: 11188

SEQ ID NO: 13184 - protein, 77 aa, unidentified
RCPRIFDDENRGLVAYPAVIRSLSVGNNLGDIHTQGEYVHKVLYRTTCSTGFFGGQTIEKALVEMKLAPREVGVYDT

SEQ ID NO: 13185 - protein, 316 aa, unidentified; identical to SEQ ID NO: 13164

SEQ ID NO: 13186 - protein, 310 aa, unidentified; identical to SEQ ID NO: 8697

SEQ ID NO: 13187 - protein, 71 aa, unidentified; identical to SEQ ID NO: 13168

SEQ ID NO: 13188 - protein, 316 aa, unidentified; identical to SEQ ID NO: 13164

SEQ ID NO: 13189 - protein, 131 aa, unidentified; identical to SEQ ID NO: 13141

SEQ ID NO: 13190 - protein, 144 aa, unidentified
GEEWHVAIPNYIINKASSLGGADVTNCIESKLAYICPRDPTQLIPDNQQKCILGDVSKCPVTKVINNLVPKFAFINGGVVANCIASTCTCGTNRIPVNQDRSRGVTFLTYTNCGLIGINGIELYANKRGRDTTWGNQIIKVGPA

SEQ ID NO: 13191 - protein, 97 aa, unidentified; identical to SEQ ID NO: 12372

SEQ ID NO: 13192 - protein, 313 aa, unidentified
SRTIWYMWLGSRFLEFEALGFLNEERWASRDISGGGVEGIGINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCSHHFHELFLRDGRKLIVPCRDQHELVGRSMVSQGGSSGVAGTACLAKAYAQMWLMSYFHRRDLRTLGFGIMSSVPKDWF

SEQ ID NO: 13193 - protein, 337 aa, unidentified; identical to SEQ ID NO: 8339

SEQ ID NO: 13194 - protein, 311 aa, unidentified; identical to SEQ ID NO: 12351

SEQ ID NO: 13195 - protein, 337 aa, unidentified; identical to SEQ ID NO: 8339

SEQ ID NO: 13196 - protein, 337 aa, unidentified; identical to SEQ ID NO: 8339

SEQ ID NO: 13197 - protein, 302 aa, unidentified
KGSRTIWYMWLGSRFLEFESFGFLNEEHWASRELCGGGVEGIPLFYLGYHLEKMAEKAGILYADDTAGWDTRITMADLEDEYTLTELMEGEHKKLAETLFNFAYKNKVALCPRPGKNGGTVLDVISRTDQRGSGQVVTYALNTLTNIKVQLIRMAESEGVLDEEFHDNGMLKWLEKHGRDRLQRLMVSGDDCVVNAIDERFGKSLVWLNEMQKIRKDIDLWKPSAGHCNWEEVEFCSNHFHKLVMRDGRTLVVPCRHEVELVGRASVNQGGSTGISGTACLAKAYAQMWLLLYFHRRDLRIL

SEQ ID NO: 13198 - protein, 257 aa, unidentified
KMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCSHHFHELFLRDGRKLIVPCRDQHELVGRSMVSQGGSSGVAGTACLAKAYAQMWLMSYFHRRDLRTLGFGIMSS

SEQ ID NO: 13199 - protein, 309 aa, unidentified; identical to SEQ ID NO: 13148

SEQ ID NO: 13200 - protein, 337 aa, unidentified; identical to SEQ ID NO: 10217

SEQ ID NO: 13201 - protein, 337 aa, unidentified; identical to SEQ ID NO: 8339

SEQ ID NO: 13202 - protein, 160 aa, unidentified
KGSRTIWYMWLGSRFLEFESFGFLNEEHWASRELSGGGVEGIPLNYLGYHLREMAQKPGVLYADDTAGWDTRITMADLEDEGILLDMMSGEHKKLASALFSKAYKVKVALCPRPGPKGGTLMDVISRTDQRGSGQVVTYALNTLTNIKVQLIRMAEAEGV

SEQ ID NO: 13203 - protein, 316 aa, unidentified; identical to SEQ ID NO: 13164

SEQ ID NO: 13204 - protein, 310 aa, unidentified; identical to SEQ ID NO: 8617

SEQ ID NO: 13205 - protein, 97 aa, unidentified; identical to SEQ ID NO: 12372

SEQ ID NO: 13206 - protein, 303 aa, unidentified; identical to SEQ ID NO: 8684

SEQ ID NO: 13207 - protein, 211 aa, unidentified
GVEGIPLNYLGYHLREMAQKPGVLYADDTAGWDTRITMADLEDEGILLDMMSGEHKKLASALFSKAYKVKVALCPRPGPKGGTLMDVISRTDQRGSGQVVTYALNTLTNIKVQLIRMAEAEGVLGATFEDFGIDRWLQEHGEDRVERMLVSGDDCVVNAIDERFGSSLNWLNAMEKVRKDIDLWKPSPSFRNWERVEFCSNHFHEMTMKDG

SEQ ID NO: 13208 - protein, 337 aa, unidentified; identical to SEQ ID NO: 8339

SEQ ID NO: 13209 - protein, 110 aa, unidentified
PKYITHSIHNLRPTTNDCEDAIKKYEAGTLINPGFPPDSCAYATVTDSEHLVILITPHHVGVDDYRGAWVDDSFPSGVCETNQCDTTHNSSIWIPKTKTRHNICSQTFAN

SEQ ID NO: 13210 - protein, 333 aa, unidentified; identical to SEQ ID NO: 8351

SEQ ID NO: 13211 - protein, 333 aa, unidentified; identical to SEQ ID NO: 8351

SEQ ID NO: 13212 - protein, 83 aa, unidentified; identical to SEQ ID NO: 10321

SEQ ID NO: 13213 - protein, 91 aa, unidentified
SIERRGEYADMNLRERCLDAIDRITNENTVTLRTLGHFMPRSPGRHPVYILINSTLMCGSAKYKEYTGSLDNDNLWTLLKNSLWVHWADDN

SEQ ID NO: 13214 - protein, 51 aa, unidentified
WVAKHAAAIEGTFPTGSADVRCRVLNALLTSHGGMTLSPNECGTWSLAAAA

SEQ ID NO: 13215 - protein, 333 aa, unidentified; identical to SEQ ID NO: 8351

SEQ ID NO: 13216 - protein, 333 aa, unidentified; identical to SEQ ID NO: 8351

SEQ ID NO: 13217 - protein, 333 aa, unidentified; identical to SEQ ID NO: 8351

SEQ ID NO: 13218 - protein, 271 aa, unidentified
KGSRTIWYMWLGSRFLEFESFGFLNEEHWASRELSGGGVEGIPLNYLGYHLREMAQKPGVLYADDTAGWDTRITMADLEDEGILLDMMSGEHKKLASALFSKAYKVKVALCPRPGPKGGTLMDVISRTDQRGSGQVVTYALNTLTNIKVQLIRMAEAEGVLGATFEDFGIDRWLQEHGEDRVERMLVSGDDCVVNAIDERFGSSLNWLNAMEKVRKDIDLWKPSPSFRNWERVEFCSNHFHEMTMKDGRVIVAPCRGQTELIARGTVNQGG

SEQ ID NO: 13219 - protein, 337 aa, unidentified; identical to SEQ ID NO: 10217

SEQ ID NO: 13220 - protein, 182 aa, unidentified
VEGIPLFYLGYHLEKMAEKAGILYADDTAGWDTRITMADLEDEYTLTELMEGEHKKLAETLFNFAYKNKVALCPRPGKNGGTVLDVISRTDQRGSGQVVTYALNTLTNIKVQLIRMAESEGVLDEEFHDNGMLKWLEKHGRDRLQRLMVSGDDCVVNAIDERFGKSLVWLNEMQKIRKDIDL

SEQ ID NO: 13221 - protein, 337 aa, unidentified; identical to SEQ ID NO: 10217

SEQ ID NO: 13222 - protein, 302 aa, unidentified; identical to SEQ ID NO: 13197

SEQ ID NO: 13223 - protein, 232 aa, unidentified
VEGIPLFYLGYHLEKMAEKAGILYADDTAGWDTRITMADLEDEYTLTELMEGEHKKLAETLFNFAYKNKVALCPRPGKNGGTVLDVISRTDQRGSGQVVTYALNTLTNIKVQLIRMAESEGVLDEEFHDNGMLKWLEKHGRDRLQRLMVSGDDCVVNAIDERFGKSLVWLNEMQKIRKDIDLWKPSAGHCNWEEVEFCSNHFHKLVMRDGRTLVVPCRHEVELVGRASVNQG

SEQ ID NO: 13224 - protein, 55 aa, unidentified; identical to SEQ ID NO: 8530

SEQ ID NO: 13225 - protein, 309 aa, unidentified; identical to SEQ ID NO: 13148

SEQ ID NO: 13226 - protein, 174 aa, unidentified; identical to SEQ ID NO: 8195

SEQ ID NO: 13227 - protein, 309 aa, unidentified; identical to SEQ ID NO: 13148

SEQ ID NO: 13228 - protein, 232 aa, unidentified; identical to SEQ ID NO: 13223

SEQ ID NO: 13229 - protein, 57 aa, unidentified
NDLDQSVIPGPSQPRVSFHPSNPFQIDSVPRPRSASRERPAVETQPSAPPLIQYVPV

SEQ ID NO: 13230 - protein, 22 aa, unidentified
MVPQALLFVPLLVFPLCFGKFP

SEQ ID NO: 13231 - protein, 333 aa, unidentified; identical to SEQ ID NO: 8351

SEQ ID NO: 13232 - protein, 333 aa, unidentified; identical to SEQ ID NO: 8351

SEQ ID NO: 13233 - protein, 333 aa, unidentified; identical to SEQ ID NO: 8351

SEQ ID NO: 13234 - protein, 337 aa, unidentified; identical to SEQ ID NO: 8339

SEQ ID NO: 13235 - protein, 333 aa, unidentified; identical to SEQ ID NO: 8351

SEQ ID NO: 13236 - protein, 333 aa, unidentified; identical to SEQ ID NO: 8351

SEQ ID NO: 13237 - protein, 309 aa, unidentified; identical to SEQ ID NO: 13148

SEQ ID NO: 13238 - protein, 337 aa, unidentified; identical to SEQ ID NO: 10217

SEQ ID NO: 13239 - protein, 337 aa, unidentified; identical to SEQ ID NO: 10217

SEQ ID NO: 13240 - protein, 337 aa, unidentified; identical to SEQ ID NO: 8339

SEQ ID NO: 13241 - protein, 337 aa, unidentified; identical to SEQ ID NO: 8339

SEQ ID NO: 13242 - protein, 213 aa, unidentified; identical to SEQ ID NO: 9689

SEQ ID NO: 13243 - protein, 337 aa, unidentified; identical to SEQ ID NO: 8339

SEQ ID NO: 13244 - protein, 337 aa, unidentified; identical to SEQ ID NO: 8339

SEQ ID NO: 13245 - protein, 337 aa, unidentified; identical to SEQ ID NO: 8339

SEQ ID NO: 13246 - protein, 337 aa, unidentified; identical to SEQ ID NO: 8339

SEQ ID NO: 13247 - protein, 337 aa, unidentified; identical to SEQ ID NO: 8339

SEQ ID NO: 13248 - protein, 309 aa, unidentified
SRTIWYMWLGSRFLEFESFGFLNEEHWASRELSGGGVESIPLFYLGYHLREMAKKPGKLYADDTAGWDTRITEADLDDECILCDYMEDEHKQLALSLFELCYKNKVALCPRPGRHGGTVMDVIFRRDQRGSGQVVTYALNTLTNIKVQLIRLAESEGVLDEDFNDHGIETWLNHYGEERLSRLLISGDDCLVNAFDERFGKALTWLNTMEKIRKDIDLCAPSNGYENFEKVEFCSNHFHELMLKDGRQLVVPCRSQNELVGRASVNQGGSATVAGTACLAKAYAQMWNLLYFHRRDLRLLGFAIMSATP

SEQ ID NO: 13249 - protein, 337 aa, unidentified; identical to SEQ ID NO: 8339

SEQ ID NO: 13250 - protein, 127 aa, unidentified; identical to SEQ ID NO: 8344

SEQ ID NO: 13251 - protein, 337 aa, unidentified; identical to SEQ ID NO: 8339

SEQ ID NO: 13252 - protein, 123 aa, unidentified; identical to SEQ ID NO: 9190

SEQ ID NO: 13253 - protein, 181 aa, unidentified
GSRFLEFESFGFLNEEHWASRELSGGGVESIPLFYLGYHLREMAKKPGKLYADDTAGWDTRITEADLDDECILCDYMEDEHKQLALSLFELCYKNKVALCPRPGRHGGTVMDVIFRRDQRGSGQVVTYALNTLTNIKVQLIRLAESEGVLDEDFNDHGIETWLNHYGEERLSRLLISGDDC

SEQ ID NO: 13254 - protein, 323 aa, unidentified; identical to SEQ ID NO: 8622

SEQ ID NO: 13255 - protein, 321 aa, unidentified; identical to SEQ ID NO: 9199

SEQ ID NO: 13256 - protein, 337 aa, unidentified; identical to SEQ ID NO: 8339

SEQ ID NO: 13257 - protein, 98 aa, unidentified
PQLINPALSPISIQALRSLLGSMTPAVVQATLSTSISAAEILSAGLMEGQIVSVLLDEMQMIVKINIPTIVTQSNALVIDFYSISSFINNQESIIQLP

SEQ ID NO: 13258 - protein, 337 aa, unidentified; identical to SEQ ID NO: 8339

SEQ ID NO: 13259 - protein, 337 aa, unidentified; identical to SEQ ID NO: 8339

SEQ ID NO: 13260 - protein, 337 aa, unidentified; identical to SEQ ID NO: 8339

SEQ ID NO: 13261 - protein, 231 aa, unidentified; identical to SEQ ID NO: 9315

SEQ ID NO: 13262 - protein, 337 aa, unidentified; identical to SEQ ID NO: 8339

SEQ ID NO: 13263 - protein, 337 aa, unidentified; identical to SEQ ID NO: 8339

SEQ ID NO: 13264 - protein, 337 aa, unidentified; identical to SEQ ID NO: 8339

SEQ ID NO: 13265 - protein, 337 aa, unidentified; identical to SEQ ID NO: 8339

SEQ ID NO: 13266 - protein, 337 aa, unidentified; identical to SEQ ID NO: 8339

SEQ ID NO: 13267 - protein, 337 aa, unidentified; identical to SEQ ID NO: 8339

SEQ ID NO: 13268 - protein, 337 aa, unidentified; identical to SEQ ID NO: 8339

SEQ ID NO: 13269 - protein, 337 aa, unidentified; identical to SEQ ID NO: 8339

SEQ ID NO: 13270 - protein, 337 aa, unidentified; identical to SEQ ID NO: 8339

SEQ ID NO: 13271 - protein, 337 aa, unidentified; identical to SEQ ID NO: 8339

SEQ ID NO: 13272 - protein, 337 aa, unidentified; identical to SEQ ID NO: 8339

SEQ ID NO: 13273 - protein, 84 aa, unidentified
IGNLQMFGTNLVLNEEDGMKICHLNNECSLKLPVVRCMNSSLFRVTCGSTTRWWNISSIHSPLIYHCQGSKNEINKELSIPSAI

SEQ ID NO: 13274 - protein, 48 aa, unidentified; identical to SEQ ID NO: 8590

SEQ ID NO: 13275 - protein, 337 aa, unidentified; identical to SEQ ID NO: 8339

SEQ ID NO: 13276 - protein, 337 aa, unidentified; identical to SEQ ID NO: 8339

SEQ ID NO: 13277 - protein, 337 aa, unidentified; identical to SEQ ID NO: 8339

SEQ ID NO: 13278 - protein, 333 aa, unidentified; identical to SEQ ID NO: 8351

SEQ ID NO: 13279 - protein, 337 aa, unidentified; identical to SEQ ID NO: 8339

SEQ ID NO: 13280 - protein, 316 aa, unidentified; identical to SEQ ID NO: 8732

SEQ ID NO: 13281 - protein, 335 aa, unidentified
GEFGVAKGSRTIWYMWLGSRFLEFEALGFLNEERWASRDISGGGVEGIGINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCSHHFHELFLRDGRKLIVPCRDQHELVGRSMVSQGGSSGVAGTACLAKAYAQMWLMSYFHRRDLRTLGFGIMSSVPKDWFPTGRTTWSVHANHE

SEQ ID NO: 13282 - protein, 337 aa, unidentified; identical to SEQ ID NO: 8339

SEQ ID NO: 13283 - protein, 231 aa, unidentified; identical to SEQ ID NO: 9315

SEQ ID NO: 13284 - protein, 161 aa, unidentified
GGVEGIGINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNAL

SEQ ID NO: 13285 - protein, 337 aa, unidentified; identical to SEQ ID NO: 8339

SEQ ID NO: 13286 - protein, 333 aa, unidentified; identical to SEQ ID NO: 8351

SEQ ID NO: 13287 - protein, 337 aa, unidentified; identical to SEQ ID NO: 8339

SEQ ID NO: 13288 - protein, 337 aa, unidentified; identical to SEQ ID NO: 8339

SEQ ID NO: 13289 - protein, 337 aa, unidentified; identical to SEQ ID NO: 8339

SEQ ID NO: 13290 - protein, 337 aa, unidentified; identical to SEQ ID NO: 8339

SEQ ID NO: 13291 - protein, 337 aa, unidentified; identical to SEQ ID NO: 8339

SEQ ID NO: 13292 - protein, 337 aa, unidentified; identical to SEQ ID NO: 8339

SEQ ID NO: 13293 - protein, 337 aa, unidentified; identical to SEQ ID NO: 8339

SEQ ID NO: 13294 - protein, 337 aa, unidentified; identical to SEQ ID NO: 8339

SEQ ID NO: 13295 - protein, 221 aa, unidentified
GGGVEGIGINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCSHHFHELFLRDGRKLIVPCR

SEQ ID NO: 13296 - protein, 337 aa, unidentified; identical to SEQ ID NO: 8339

SEQ ID NO: 13297 - protein, 337 aa, unidentified; identical to SEQ ID NO: 8339

SEQ ID NO: 13298 - protein, 258 aa, unidentified; identical to SEQ ID NO: 8309

SEQ ID NO: 13299 - protein, 337 aa, unidentified; identical to SEQ ID NO: 8339

SEQ ID NO: 13300 - protein, 337 aa, unidentified; identical to SEQ ID NO: 8339

SEQ ID NO: 13301 - protein, 337 aa, unidentified; identical to SEQ ID NO: 8339

SEQ ID NO: 13302 - protein, 337 aa, unidentified; identical to SEQ ID NO: 8339

SEQ ID NO: 13303 - protein, 165 aa, unidentified
ARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIE

SEQ ID NO: 13304 - protein, 337 aa, unidentified; identical to SEQ ID NO: 8339

SEQ ID NO: 13305 - protein, 337 aa, unidentified; identical to SEQ ID NO: 8339

SEQ ID NO: 13306 - protein, 72 aa, unidentified
NYAKISDNELSFVTISPLKALLDPYLMVYVSPIFKGGKCYSQTCSAVEHQGLWMSAQPPSQICKLTKTASSH

SEQ ID NO: 13307 - protein, 333 aa, unidentified; identical to SEQ ID NO: 8351

SEQ ID NO: 13308 - protein, 113 aa, unidentified
YNLTVGDYGGEVGRHLIASLAQIIGDDKAAWVGKCFNNCSANGTCRLTNCEGYTHYNYLIIQNTTWENHCSYSPMSTIRMALNKVAYSSVSRKLLGFFTWDISDSSGRHVPGG

SEQ ID NO: 13309 - protein, 142 aa, unidentified; identical to SEQ ID NO: 8874

SEQ ID NO: 13310 - protein, 50 aa, unidentified; identical to SEQ ID NO: 8765

SEQ ID NO: 13311 - protein, 208 aa, unidentified
ILYADDTAGWDTRITMADLEDEYTLTELMEGEHKKLAETLFNFAYKNKVALCPRPGKNGGTVLDVISRTDQRGSGQVVTYALNTLTNIKVQLIRMAESEGVLDEEFHDNGMLKWLEKHGRDRLQRLMVSGDDCVVNAIDERFGKSLVWLNEMQKIRKDIDLWKPSAGHCNWEEVEFCSNHFHKLVMRDGRTLVVPCRHEVELVGRASV

SEQ ID NO: 13312 - protein, 310 aa, unidentified; identical to SEQ ID NO: 8697

SEQ ID NO: 13313 - protein, 88 aa, unidentified; identical to SEQ ID NO: 8779

SEQ ID NO: 13314 - protein, 142 aa, unidentified; identical to SEQ ID NO: 8874

SEQ ID NO: 13315 - protein, 95 aa, unidentified; identical to SEQ ID NO: 8787

SEQ ID NO: 13316 - protein, 182 aa, unidentified
DDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCSHHFHELFL

SEQ ID NO: 13317 - protein, 310 aa, unidentified; identical to SEQ ID NO: 8697

SEQ ID NO: 13318 - protein, 182 aa, unidentified; identical to SEQ ID NO: 13316

SEQ ID NO: 13319 - protein, 90 aa, unidentified
VNIGTMIDCLPDMPPLYLLGEDWYQISSRGLIRHSKPATMQQDDVNYEFSVLSGLGNGGLYNDETIALYQEALVSGITSEIVKTRVADSI

SEQ ID NO: 13320 - protein, 45 aa, unidentified; identical to SEQ ID NO: 8980

SEQ ID NO: 13321 - protein, 311 aa, unidentified; identical to SEQ ID NO: 9371

SEQ ID NO: 13322 - protein, 50 aa, unidentified; identical to SEQ ID NO: 8765

SEQ ID NO: 13323 - protein, 148 aa, unidentified; identical to SEQ ID NO: 8790

SEQ ID NO: 13324 - protein, 337 aa, unidentified; identical to SEQ ID NO: 8339

SEQ ID NO: 13325 - protein, 111 aa, unidentified; identical to SEQ ID NO: 8936

SEQ ID NO: 13326 - protein, 231 aa, unidentified; identical to SEQ ID NO: 9315

SEQ ID NO: 13327 - protein, 337 aa, unidentified; identical to SEQ ID NO: 8339

SEQ ID NO: 13328 - protein, 310 aa, unidentified; identical to SEQ ID NO: 8697

SEQ ID NO: 13329 - protein, 303 aa, unidentified; identical to SEQ ID NO: 8684

SEQ ID NO: 13330 - protein, 337 aa, unidentified; identical to SEQ ID NO: 8339

SEQ ID NO: 13331 - protein, 95 aa, unidentified; identical to SEQ ID NO: 8787

SEQ ID NO: 13332 - protein, 54 aa, unidentified
LELIKLSIIYDSNFGELPIRDACRLHYCGKPAIKLFNGAIIKIKESPIVLGLPS

SEQ ID NO: 13333 - protein, 76 aa, unidentified; identical to SEQ ID NO: 9023

SEQ ID NO: 13334 - protein, 95 aa, unidentified; identical to SEQ ID NO: 8787

SEQ ID NO: 13335 - protein, 82 aa, unidentified; identical to SEQ ID NO: 8792

SEQ ID NO: 13336 - protein, 43 aa, unidentified
IRILAGVPISAIRIPNQPYNWCNGSLGIEYEDTDTHHWVRGWL

SEQ ID NO: 13337 - protein, 148 aa, unidentified; identical to SEQ ID NO: 8790

SEQ ID NO: 13338 - protein, 50 aa, unidentified; identical to SEQ ID NO: 8765

SEQ ID NO: 13339 - protein, 95 aa, unidentified; identical to SEQ ID NO: 8787

SEQ ID NO: 13340 - protein, 83 aa, unidentified; identical to SEQ ID NO: 10321

SEQ ID NO: 13341 - protein, 305 aa, unidentified; identical to SEQ ID NO: 9096

SEQ ID NO: 13342 - protein, 40 aa, unidentified
HLVYSADNLVQINVEQPYEILNVECGKSTYLHIDKCEEQD

SEQ ID NO: 13343 - protein, 69 aa, unidentified
GSGKELHIYQESGSLDLYLRLLPVIPSNLSHCQSEVITQYNSTVTRLLSPIAKNLNHLLQPRPSGRLFG

SEQ ID NO: 13344 - protein, 95 aa, unidentified; identical to SEQ ID NO: 8787

SEQ ID NO: 13345 - protein, 95 aa, unidentified; identical to SEQ ID NO: 8787

SEQ ID NO: 13346 - protein, 323 aa, unidentified
KGSRTIWYMWLGSRFLEFEALGFLNEERWASRDISGGGVEGIGINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCSHHFHELFLRDGRKLIVPCRDQHELVGRSMVSQGGSSGVAGTACLAKAYAQMWLMSYFHRRDLRTLGFGIMSSVPKDWFPTGRTTWS

SEQ ID NO: 13347 - protein, 74 aa, unidentified; identical to SEQ ID NO: 8774

SEQ ID NO: 13348 - protein, 113 aa, unidentified; identical to SEQ ID NO: 13308

SEQ ID NO: 13349 - protein, 50 aa, unidentified; identical to SEQ ID NO: 8765

SEQ ID NO: 13350 - protein, 95 aa, unidentified; identical to SEQ ID NO: 8787

SEQ ID NO: 13351 - protein, 82 aa, unidentified; identical to SEQ ID NO: 8792

SEQ ID NO: 13352 - protein, 95 aa, unidentified; identical to SEQ ID NO: 8787

SEQ ID NO: 13353 - protein, 337 aa, unidentified; identical to SEQ ID NO: 8339

SEQ ID NO: 13354 - protein, 61 aa, unidentified; identical to SEQ ID NO: 9061

SEQ ID NO: 13355 - protein, 48 aa, unidentified; identical to SEQ ID NO: 8590

SEQ ID NO: 13356 - protein, 73 aa, unidentified; identical to SEQ ID NO: 9121

SEQ ID NO: 13357 - protein, 95 aa, unidentified; identical to SEQ ID NO: 8787

SEQ ID NO: 13358 - protein, 95 aa, unidentified; identical to SEQ ID NO: 8787

SEQ ID NO: 13359 - protein, 235 aa, unidentified; identical to SEQ ID NO: 9303

SEQ ID NO: 13360 - protein, 55 aa, unidentified; identical to SEQ ID NO: 8530

SEQ ID NO: 13361 - protein, 54 aa, unidentified; identical to SEQ ID NO: 8266

SEQ ID NO: 13362 - protein, 55 aa, unidentified; identical to SEQ ID NO: 8530

SEQ ID NO: 13363 - protein, 337 aa, unidentified; identical to SEQ ID NO: 8339

SEQ ID NO: 13364 - protein, 152 aa, unidentified; identical to SEQ ID NO: 8221

SEQ ID NO: 13365 - protein, 337 aa, unidentified; identical to SEQ ID NO: 8339

SEQ ID NO: 13366 - protein, 337 aa, unidentified; identical to SEQ ID NO: 8339

SEQ ID NO: 13367 - protein, 337 aa, unidentified; identical to SEQ ID NO: 8339

SEQ ID NO: 13368 - protein, 337 aa, unidentified; identical to SEQ ID NO: 8339

SEQ ID NO: 13369 - protein, 337 aa, unidentified; identical to SEQ ID NO: 8339

SEQ ID NO: 13370 - protein, 337 aa, unidentified; identical to SEQ ID NO: 8339

SEQ ID NO: 13371 - protein, 87 aa, unidentified
YFSAKTTHSIEHAPIQDYECVGALARLKLGIVPEPEFPVVDCYWNADTVEKREFIILTEHDPQLDPYSYKLLDNVVAANCDHNICQT

SEQ ID NO: 13372 - protein, 337 aa, unidentified; identical to SEQ ID NO: 8339

SEQ ID NO: 13373 - protein, 337 aa, unidentified; identical to SEQ ID NO: 8339

SEQ ID NO: 13374 - protein, 337 aa, unidentified; identical to SEQ ID NO: 8339

SEQ ID NO: 13375 - protein, 337 aa, unidentified; identical to SEQ ID NO: 8339

SEQ ID NO: 13376 - protein, 337 aa, unidentified; identical to SEQ ID NO: 8339

SEQ ID NO: 13377 - protein, 337 aa, unidentified; identical to SEQ ID NO: 8339

SEQ ID NO: 13378 - protein, 337 aa, unidentified; identical to SEQ ID NO: 8339

SEQ ID NO: 13379 - protein, 337 aa, unidentified; identical to SEQ ID NO: 8339

SEQ ID NO: 13380 - protein, 337 aa, unidentified; identical to SEQ ID NO: 8339

SEQ ID NO: 13381 - protein, 337 aa, unidentified; identical to SEQ ID NO: 8339

SEQ ID NO: 13382 - protein, 258 aa, unidentified; identical to SEQ ID NO: 8309

SEQ ID NO: 13383 - protein, 50 aa, unidentified; identical to SEQ ID NO: 8765

SEQ ID NO: 13384 - protein, 50 aa, unidentified; identical to SEQ ID NO: 8765

SEQ ID NO: 13385 - protein, 337 aa, unidentified; identical to SEQ ID NO: 8339

SEQ ID NO: 13386 - protein, 337 aa, unidentified; identical to SEQ ID NO: 8339

SEQ ID NO: 13387 - protein, 50 aa, unidentified; identical to SEQ ID NO: 8765

SEQ ID NO: 13388 - protein, 337 aa, unidentified; identical to SEQ ID NO: 8339

SEQ ID NO: 13389 - protein, 337 aa, unidentified; identical to SEQ ID NO: 8339

SEQ ID NO: 13390 - protein, 320 aa, unidentified; identical to SEQ ID NO: 8962

SEQ ID NO: 13391 - protein, 337 aa, unidentified; identical to SEQ ID NO: 8339

SEQ ID NO: 13392 - protein, 337 aa, unidentified; identical to SEQ ID NO: 8339

SEQ ID NO: 13393 - protein, 50 aa, unidentified; identical to SEQ ID NO: 8765

SEQ ID NO: 13394 - protein, 337 aa, unidentified; identical to SEQ ID NO: 8339

SEQ ID NO: 13395 - protein, 337 aa, unidentified; identical to SEQ ID NO: 8339

SEQ ID NO: 13396 - protein, 50 aa, unidentified; identical to SEQ ID NO: 8765

SEQ ID NO: 13397 - protein, 337 aa, unidentified; identical to SEQ ID NO: 8339

SEQ ID NO: 13398 - protein, 337 aa, unidentified; identical to SEQ ID NO: 8339

SEQ ID NO: 13399 - protein, 219 aa, unidentified
LGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCSHHFHELFLRDGRKLIVPCRDQHELVGRS

SEQ ID NO: 13400 - protein, 337 aa, unidentified; identical to SEQ ID NO: 8339

SEQ ID NO: 13401 - protein, 337 aa, unidentified; identical to SEQ ID NO: 8339

SEQ ID NO: 13402 - protein, 333 aa, unidentified; identical to SEQ ID NO: 8351

SEQ ID NO: 13403 - protein, 84 aa, unidentified; identical to SEQ ID NO: 13273

SEQ ID NO: 13404 - protein, 48 aa, unidentified; identical to SEQ ID NO: 8590

SEQ ID NO: 13405 - protein, 337 aa, unidentified; identical to SEQ ID NO: 8212

SEQ ID NO: 13406 - protein, 337 aa, unidentified; identical to SEQ ID NO: 8339

SEQ ID NO: 13407 - protein, 337 aa, unidentified; identical to SEQ ID NO: 8339

SEQ ID NO: 13408 - protein, 337 aa, unidentified; identical to SEQ ID NO: 8339

SEQ ID NO: 13409 - protein, 337 aa, unidentified; identical to SEQ ID NO: 8339

SEQ ID NO: 13410 - protein, 333 aa, unidentified; identical to SEQ ID NO: 8351

SEQ ID NO: 13411 - protein, 298 aa, unidentified; identical to SEQ ID NO: 8537

SEQ ID NO: 13412 - protein, 203 aa, unidentified
IWYMWLGSRFLEFEALGFLNEERWASRDISGGGVEGIGINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWL

SEQ ID NO: 13413 - protein, 79 aa, unidentified
KNLIRTQESLNILEKIVANLSSNQMILSDQVTIDQSTIENILSDLTEHGLRLNEAEKSFNNSHLCIVRNETHDVNHLLR

SEQ ID NO: 13414 - protein, 337 aa, unidentified; identical to SEQ ID NO: 8339

SEQ ID NO: 13415 - protein, 231 aa, unidentified; identical to SEQ ID NO: 9315

SEQ ID NO: 13416 - protein, 329 aa, unidentified
KPGEFGVAKGSRTIWYMWLGSRFLEFEALGFLNEERWASRDISGGGVEGIGINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCSHHFHELFLRDGRKLIVPCRDQHELVGRSMVSQGGSSGVAGTACLAKAYAQMWLMSYFHRRDLRTLGFGIMSSVPKDWFPTGRTT

SEQ ID NO: 13417 - protein, 337 aa, unidentified; identical to SEQ ID NO: 8339

SEQ ID NO: 13418 - protein, 337 aa, unidentified; identical to SEQ ID NO: 8339

SEQ ID NO: 13419 - protein, 337 aa, unidentified; identical to SEQ ID NO: 8339

SEQ ID NO: 13420 - protein, 337 aa, unidentified; identical to SEQ ID NO: 8339

SEQ ID NO: 13421 - protein, 337 aa, unidentified; identical to SEQ ID NO: 8339

SEQ ID NO: 13422 - protein, 337 aa, unidentified; identical to SEQ ID NO: 8339

SEQ ID NO: 13423 - protein, 337 aa, unidentified; identical to SEQ ID NO: 8339

SEQ ID NO: 13424 - protein, 291 aa, unidentified
KPGEFGVAKGSRTIWYMWLGSRFLEFEALGFLNEERWASRDISGGGVEGIGINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCSHHFHELFLRDGRKLIVPCRDQHELVGRSMVSQGGSSGVAGTACLAK

SEQ ID NO: 13425 - protein, 337 aa, unidentified; identical to SEQ ID NO: 8339

SEQ ID NO: 13426 - protein, 337 aa, unidentified; identical to SEQ ID NO: 8339

SEQ ID NO: 13427 - protein, 102 aa, unidentified; identical to SEQ ID NO: 8731

SEQ ID NO: 13428 - protein, 337 aa, unidentified; identical to SEQ ID NO: 8339

SEQ ID NO: 13429 - protein, 337 aa, unidentified; identical to SEQ ID NO: 8339

SEQ ID NO: 13430 - protein, 337 aa, unidentified; identical to SEQ ID NO: 8339

SEQ ID NO: 13431 - protein, 231 aa, unidentified; identical to SEQ ID NO: 9315

SEQ ID NO: 13432 - protein, 203 aa, unidentified; identical to SEQ ID NO: 9291

SEQ ID NO: 13433 - protein, 337 aa, unidentified; identical to SEQ ID NO: 8339

SEQ ID NO: 13434 - protein, 283 aa, unidentified; identical to SEQ ID NO: 9339

SEQ ID NO: 13435 - protein, 337 aa, unidentified; identical to SEQ ID NO: 8339

SEQ ID NO: 13436 - protein, 337 aa, unidentified; identical to SEQ ID NO: 8339

SEQ ID NO: 13437 - protein, 337 aa, unidentified; identical to SEQ ID NO: 8339

SEQ ID NO: 13438 - protein, 334 aa, unidentified
EFGVAKGSRTIWYMWLGSRFLEFEALGFLNEERWASRDISGGGVEGIGINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCSHHFHELFLRDGRKLIVPCRDQHELVGRSMVSQGGSSGVAGTACLAKAYAQMWLMSYFHRRDLRTLGFGIMSSVPKDWFPTGRTTWSVHANHE

SEQ ID NO: 13439 - protein, 67 aa, unidentified
KLKTLLNGTNKLKARALSAYWHPQGQNKLFRNITRLDYCKYPEAVILLNTTKSDYSLWEGDCNIWAH

SEQ ID NO: 13440 - protein, 45 aa, unidentified; identical to SEQ ID NO: 8980

SEQ ID NO: 13441 - protein, 50 aa, unidentified; identical to SEQ ID NO: 8765

SEQ ID NO: 13442 - protein, 74 aa, unidentified; identical to SEQ ID NO: 8774

SEQ ID NO: 13443 - protein, 111 aa, unidentified; identical to SEQ ID NO: 8936

SEQ ID NO: 13444 - protein, 74 aa, unidentified; identical to SEQ ID NO: 8267

SEQ ID NO: 13445 - protein, 73 aa, unidentified
FHSETTNLTLIPAAVRTLSFGDLGYATISCGLGLSDALNMYIVAGEKHKVLLPKGTIDVWTGLFKVGAVIHGA

SEQ ID NO: 13446 - protein, 164 aa, unidentified
EEIEVQAARLYEDTGEGYAVIFIIKDVAYPMSERSGHCSMIRPDAKGTFECSPVECKEVPLRIHTCTAKQASFLLFQPDYQSLAEEKEKLPSPSLTNSLPPGSTLNETQIRCSVSWVIQLASQHKHIGHKHSDGTVTITIEKAMHRSSMDGGKVQAVVNGVQYE

SEQ ID NO: 13447 - protein, 105 aa, unidentified
PLRIHTCTAKQASFLLFQPDYQSLAEEKEKLPSPSLTNSLPPGSTLNETQIRCSVSWVIQLASQHKHIGHKHSDGTVTITIEKAMHRSSMDGGKVQAVVNGVQYE

SEQ ID NO: 13448 - protein, 318 aa, unidentified; identical to SEQ ID NO: 8615

SEQ ID NO: 13449 - protein, 182 aa, unidentified; identical to SEQ ID NO: 13316

SEQ ID NO: 13450 - protein, 303 aa, unidentified; identical to SEQ ID NO: 8684

SEQ ID NO: 13451 - protein, 273 aa, unidentified
GVEGIGINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCSHHFHELFLRDGRKLIVPCRDQHELVGRSMVSQGGSSGVAGTACLAKAYAQMWLMSYFHRRDLRTLGFGIMSSV

SEQ ID NO: 13452 - protein, 74 aa, unidentified; identical to SEQ ID NO: 8774

SEQ ID NO: 13453 - protein, 95 aa, unidentified; identical to SEQ ID NO: 8787

SEQ ID NO: 13454 - protein, 320 aa, unidentified; identical to SEQ ID NO: 8962

SEQ ID NO: 13455 - protein, 95 aa, unidentified; identical to SEQ ID NO: 8787

SEQ ID NO: 13456 - protein, 55 aa, unidentified; identical to SEQ ID NO: 8530

SEQ ID NO: 13457 - protein, 82 aa, unidentified; identical to SEQ ID NO: 8792

SEQ ID NO: 13458 - protein, 95 aa, unidentified; identical to SEQ ID NO: 8787

SEQ ID NO: 13459 - protein, 112 aa, unidentified
VGKTLKISHDMKLFGEEAINYTIFINRIVFEPASYMNYSSSCRAQKFQACVRVYSDLTNGSKGFPSVKLGFTADELNRTHKSDFHNMGFKVCLSCRDHNGIKLIVYNKINRT

SEQ ID NO: 13460 - protein, 95 aa, unidentified; identical to SEQ ID NO: 8787

SEQ ID NO: 13461 - protein, 95 aa, unidentified; identical to SEQ ID NO: 8787

SEQ ID NO: 13462 - protein, 320 aa, unidentified; identical to SEQ ID NO: 8962

SEQ ID NO: 13463 - protein, 182 aa, unidentified; identical to SEQ ID NO: 13316

SEQ ID NO: 13464 - protein, 174 aa, unidentified; identical to SEQ ID NO: 8933

SEQ ID NO: 13465 - protein, 74 aa, unidentified; identical to SEQ ID NO: 8267

SEQ ID NO: 13466 - protein, 75 aa, unidentified
IHHFTEPGTPVFDGCSLTVQNQTALALCTLTTDGPETDIHNGASLGLALVHFNIRGEFSKHKVDPRNIDTQNQGL

SEQ ID NO: 13467 - protein, 95 aa, unidentified; identical to SEQ ID NO: 8787

SEQ ID NO: 13468 - protein, 50 aa, unidentified; identical to SEQ ID NO: 8765

SEQ ID NO: 13469 - protein, 95 aa, unidentified; identical to SEQ ID NO: 8787

SEQ ID NO: 13470 - protein, 50 aa, unidentified; identical to SEQ ID NO: 8765

SEQ ID NO: 13471 - protein, 50 aa, unidentified; identical to SEQ ID NO: 8765

SEQ ID NO: 13472 - protein, 75 aa, unidentified
GNLQMFGTNLVLNEEDGMKICHLNNECSLKLPVVRCMNSSLFRVTCGSTTRWWNISSIHSPLIYHCQGSKNEINK

SEQ ID NO: 13473 - protein, 65 aa, unidentified
KKIDGSSSDLEQGVLKFEHISSKLPIQFMVGAMSRQGDDKPSHIFHGVPDLRTDGSNTNFAYRMT

SEQ ID NO: 13474 - protein, 104 aa, unidentified
LAEIRNTHHINVLDMSYLTPKHPGKGLAYYFSQDHNNASKYYVKTLKCDYKLIHIHDADIRGFVNISKYPEPNVTILGLQDNLTFANLGIARCHDFTQLNDSRN

SEQ ID NO: 13475 - protein, 242 aa, unidentified; identical to SEQ ID NO: 9069

SEQ ID NO: 13476 - protein, 124 aa, unidentified; identical to SEQ ID NO: 9056

SEQ ID NO: 13477 - protein, 51 aa, unidentified; identical to SEQ ID NO: 8938

SEQ ID NO: 13478 - protein, 54 aa, unidentified; identical to SEQ ID NO: 9051

SEQ ID NO: 13479 - protein, 48 aa, unidentified; identical to SEQ ID NO: 8590

SEQ ID NO: 13480 - protein, 69 aa, unidentified; identical to SEQ ID NO: 8367

SEQ ID NO: 13481 - protein, 243 aa, unidentified
GSRTIWYMWLGSRFLEFEALGFLNEERWASRDISGGGVEGIGINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCSHHFHELF

SEQ ID NO: 13482 - protein, 243 aa, unidentified; identical to SEQ ID NO: 8643

SEQ ID NO: 13483 - protein, 54 aa, unidentified; identical to SEQ ID NO: 8266

SEQ ID NO: 13484 - protein, 319 aa, unidentified; identical to SEQ ID NO: 8652

SEQ ID NO: 13485 - protein, 57 aa, unidentified; identical to SEQ ID NO: 8179

SEQ ID NO: 13486 - protein, 76 aa, unidentified; identical to SEQ ID NO: 8186

SEQ ID NO: 13487 - protein, 180 aa, unidentified
LPKDKENCAEVSIRSYNETLTRILTPLAQSMAAIRGNSTVSTRGREPRLVGAIIGGVALGVATAAQITAATALIQANQNAENIARLAKGLAATNEAVTDLTKGVGSLAIGVGKLQDYVNEQFNRTGEAIECLTIESRVGVQLSLYLTEVIGVFGDQITSPALSDISIQALYNLAGGNLNV

SEQ ID NO: 13488 - protein, 294 aa, unidentified
KPGEFGVAKGSRTIWYMWLGSRFLEFEALGFLNEERWASRDISGGGVEGIGINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCSHHFHELFLRDGRKLIVPCRDQHELVGRSMVSQGGSSGVAGTACLAKAYA

SEQ ID NO: 13489 - protein, 337 aa, unidentified; identical to SEQ ID NO: 8339

SEQ ID NO: 13490 - protein, 337 aa, unidentified; identical to SEQ ID NO: 8339

SEQ ID NO: 13491 - protein, 337 aa, unidentified; identical to SEQ ID NO: 8339

SEQ ID NO: 13492 - protein, 337 aa, unidentified; identical to SEQ ID NO: 8339

SEQ ID NO: 13493 - protein, 258 aa, unidentified; identical to SEQ ID NO: 8309

SEQ ID NO: 13494 - protein, 311 aa, unidentified; identical to SEQ ID NO: 12351

SEQ ID NO: 13495 - protein, 337 aa, unidentified; identical to SEQ ID NO: 8339

SEQ ID NO: 13496 - protein, 337 aa, unidentified; identical to SEQ ID NO: 8339

SEQ ID NO: 13497 - protein, 112 aa, unidentified
DNKMQFMSPRSRILVNIGTMIDCLPDMPPLYLLGEDWYQISSRGLIRHSKPATMQQDDVNYEFSVLSGLGNGGLYNDETIALYQEALVSGITSEIVKTRVADSIGGRSDLPT

SEQ ID NO: 13498 - protein, 78 aa, unidentified
YYNGTEEKKVTCAEWITDRNGMSCINGIVKYGNKIIHPSSLANTAPEEERLFKKSELIDAYHVPTKAVNPWADWNPMH

SEQ ID NO: 13499 - protein, 134 aa, unidentified
GKLYADDTAGWDTRITEADLDDECILCDYMEDEHKQLALSLFELCYKNKVALCPRPGRHGGTVMDVIFRRDQRGSGQVVTYALNTLTNIKVQLIRLAESEGVLDEDFNDHGIETWLNHYGEERLSRLLISGDDC

SEQ ID NO: 13500 - protein, 298 aa, unidentified; identical to SEQ ID NO: 8537

SEQ ID NO: 13501 - protein, 50 aa, unidentified; identical to SEQ ID NO: 8765

SEQ ID NO: 13502 - protein, 337 aa, unidentified; identical to SEQ ID NO: 8339

SEQ ID NO: 13503 - protein, 337 aa, unidentified; identical to SEQ ID NO: 8339

SEQ ID NO: 13504 - protein, 298 aa, unidentified; identical to SEQ ID NO: 8537

SEQ ID NO: 13505 - protein, 313 aa, unidentified; identical to SEQ ID NO: 9730

SEQ ID NO: 13506 - protein, 337 aa, unidentified; identical to SEQ ID NO: 8339

SEQ ID NO: 13507 - protein, 337 aa, unidentified; identical to SEQ ID NO: 8339

SEQ ID NO: 13508 - protein, 50 aa, unidentified; identical to SEQ ID NO: 8765

SEQ ID NO: 13509 - protein, 337 aa, unidentified; identical to SEQ ID NO: 8339

SEQ ID NO: 13510 - protein, 50 aa, unidentified; identical to SEQ ID NO: 8765

SEQ ID NO: 13511 - protein, 337 aa, unidentified; identical to SEQ ID NO: 8339

SEQ ID NO: 13512 - protein, 337 aa, unidentified; identical to SEQ ID NO: 8339

SEQ ID NO: 13513 - protein, 261 aa, unidentified; identical to SEQ ID NO: 11471

SEQ ID NO: 13514 - protein, 337 aa, unidentified; identical to SEQ ID NO: 8339

SEQ ID NO: 13515 - protein, 337 aa, unidentified; identical to SEQ ID NO: 8339

SEQ ID NO: 13516 - protein, 337 aa, unidentified; identical to SEQ ID NO: 8339

SEQ ID NO: 13517 - protein, 231 aa, unidentified; identical to SEQ ID NO: 9315

SEQ ID NO: 13518 - protein, 313 aa, unidentified; identical to SEQ ID NO: 8356

SEQ ID NO: 13519 - protein, 276 aa, unidentified
MARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCSHHFHELFLRDGRKLIVPCRDQHELVGRSMVSQGGSSGVAGTACLAKAYAQMWLMSYFHRRDLRTLGFGIMSSVPKDWFPTGRTTWSVHANHE

SEQ ID NO: 13520 - protein, 314 aa, unidentified
LEFESFGFLNEEHWASRELSGGGVEGIPLNYLGYHLREMAQKPGVLYADDTAGWDTRITMADLEDEGILLDMMSGEHKKLASALFSKAYKVKVALCPRPGPKGGTLMDVISRTDQRGSGQVVTYALNTLTNIKVQLIRMAEAEGVLGATFEDFGIDRWLQEHGEDRVERMLVSGDDCVVNAIDERFGSSLNWLNAMEKVRKDIDLWKPSPSFRNWERVEFCSNHFHEMTMKDGRVIVAPCRGQTELIARGTVNQGGCVGVESTGCLAKAYAQMWLLLYFHRRDLRTLALAVMSAVPSNWIPTGRTTWSLMVKGE

SEQ ID NO: 13521 - protein, 337 aa, unidentified; identical to SEQ ID NO: 8339

SEQ ID NO: 13522 - protein, 298 aa, unidentified; identical to SEQ ID NO: 8537

SEQ ID NO: 13523 - protein, 254 aa, unidentified
EGIGINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCSHHFHELFLRDGRKLIVPCRDQHELVGRSMVSQGGSSGVAGTACLAKAYAQMWLMSY

SEQ ID NO: 13524 - protein, 231 aa, unidentified; identical to SEQ ID NO: 9315

SEQ ID NO: 13525 - protein, 337 aa, unidentified; identical to SEQ ID NO: 8339

SEQ ID NO: 13526 - protein, 337 aa, unidentified; identical to SEQ ID NO: 8339

SEQ ID NO: 13527 - protein, 177 aa, unidentified
GGVEGIGINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEK

SEQ ID NO: 13528 - protein, 337 aa, unidentified; identical to SEQ ID NO: 8339

SEQ ID NO: 13529 - protein, 337 aa, unidentified; identical to SEQ ID NO: 8339

SEQ ID NO: 13530 - protein, 337 aa, unidentified; identical to SEQ ID NO: 8339

SEQ ID NO: 13531 - protein, 337 aa, unidentified; identical to SEQ ID NO: 8339

SEQ ID NO: 13532 - protein, 337 aa, unidentified; identical to SEQ ID NO: 8339

SEQ ID NO: 13533 - protein, 337 aa, unidentified; identical to SEQ ID NO: 8339

SEQ ID NO: 13534 - protein, 337 aa, unidentified; identical to SEQ ID NO: 8339

SEQ ID NO: 13535 - protein, 337 aa, unidentified; identical to SEQ ID NO: 8339

SEQ ID NO: 13536 - protein, 333 aa, unidentified; identical to SEQ ID NO: 8351

SEQ ID NO: 13537 - protein, 185 aa, unidentified
RDISGGGVEGIGINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTRE

SEQ ID NO: 13538 - protein, 337 aa, unidentified; identical to SEQ ID NO: 8339

SEQ ID NO: 13539 - protein, 46 aa, unidentified
GEEVVVSTTNRDFSSALEYLELTGKTRKNVPQGAPSRMESDWEKVE

SEQ ID NO: 13540 - protein, 105 aa, unidentified
LFGEEAINYTIFVNKIAFEPVSYYNISGTCRQQGFSACVRVYSDLTNNSRGFPSMKLGFTAIELNKIKNSDFHNMGFKICFSCRDYKGVRLVAYSKKNHTAQLMM

SEQ ID NO: 13541 - protein, 50 aa, unidentified; identical to SEQ ID NO: 8765

SEQ ID NO: 13542 - protein, 54 aa, unidentified; identical to SEQ ID NO: 8783

SEQ ID NO: 13543 - protein, 74 aa, unidentified; identical to SEQ ID NO: 8267

SEQ ID NO: 13544 - protein, 182 aa, unidentified; identical to SEQ ID NO: 13316

SEQ ID NO: 13545 - protein, 271 aa, unidentified; identical to SEQ ID NO: 13218

SEQ ID NO: 13546 - protein, 95 aa, unidentified; identical to SEQ ID NO: 8787

SEQ ID NO: 13547 - protein, 303 aa, unidentified; identical to SEQ ID NO: 8684

SEQ ID NO: 13548 - protein, 182 aa, unidentified; identical to SEQ ID NO: 13316

SEQ ID NO: 13549 - protein, 308 aa, unidentified
IWYMWLGSRFLEFESFGFLNEEHWASRELSGGGVESIPLFYLGYHLREMAKKPGKLYADDTAGWDTRITEADLDDECILCDYMEDEHKQLALSLFELCYKNKVALCPRPGRHGGTVMDVIFRRDQRGSGQVVTYALNTLTNIKVQLIRLAESEGVLDEDFNDHGIETWLNHYGEERLSRLLISGDDCLVNAFDERFGKALTWLNTMEKIRKDIDLCAPSNGYENFEKVEFCSNHFHELMLKDGRQLVVPCRSQNELVGRASVNQGGSATVAGTACLAKAYAQMWNLLYFHRRDLRLLGFAIMSATPSN

SEQ ID NO: 13550 - protein, 303 aa, unidentified; identical to SEQ ID NO: 8684

SEQ ID NO: 13551 - protein, 337 aa, unidentified; identical to SEQ ID NO: 8339

SEQ ID NO: 13552 - protein, 99 aa, unidentified; identical to SEQ ID NO: 12089

SEQ ID NO: 13553 - protein, 67 aa, unidentified
NDLDQSVIPGPSQPRVSFHPSNPFQIDSVPRPRSASRERPAVETQPSAPPLIQYVPVPPPVFPPSVN

SEQ ID NO: 13554 - protein, 111 aa, unidentified; identical to SEQ ID NO: 8936

SEQ ID NO: 13555 - protein, 111 aa, unidentified; identical to SEQ ID NO: 8936

SEQ ID NO: 13556 - protein, 318 aa, unidentified; identical to SEQ ID NO: 8615

SEQ ID NO: 13557 - protein, 88 aa, unidentified; identical to SEQ ID NO: 8779

SEQ ID NO: 13558 - protein, 95 aa, unidentified; identical to SEQ ID NO: 8787

SEQ ID NO: 13559 - protein, 76 aa, unidentified
IGNLQMFGTNLVLNEEDGMKICHLNNECSLKLPVVRCMNSSLFRVTCGSTTRWWNISSIHSPLIYHCQGSKNEINK

SEQ ID NO: 13560 - protein, 95 aa, unidentified; identical to SEQ ID NO: 8787

SEQ ID NO: 13561 - protein, 95 aa, unidentified; identical to SEQ ID NO: 8787

SEQ ID NO: 13562 - protein, 50 aa, unidentified; identical to SEQ ID NO: 8765

SEQ ID NO: 13563 - protein, 337 aa, unidentified; identical to SEQ ID NO: 8339

SEQ ID NO: 13564 - protein, 337 aa, unidentified; identical to SEQ ID NO: 8339

SEQ ID NO: 13565 - protein, 95 aa, unidentified; identical to SEQ ID NO: 8787

SEQ ID NO: 13566 - protein, 48 aa, unidentified; identical to SEQ ID NO: 8590

SEQ ID NO: 13567 - protein, 95 aa, unidentified; identical to SEQ ID NO: 8787

SEQ ID NO: 13568 - protein, 95 aa, unidentified; identical to SEQ ID NO: 8787

SEQ ID NO: 13569 - protein, 45 aa, unidentified; identical to SEQ ID NO: 8980

SEQ ID NO: 13570 - protein, 95 aa, unidentified; identical to SEQ ID NO: 8787

SEQ ID NO: 13571 - protein, 308 aa, unidentified; identical to SEQ ID NO: 13549

SEQ ID NO: 13572 - protein, 55 aa, unidentified; identical to SEQ ID NO: 8530

SEQ ID NO: 13573 - protein, 95 aa, unidentified; identical to SEQ ID NO: 8787

SEQ ID NO: 13574 - protein, 82 aa, unidentified; identical to SEQ ID NO: 8792

SEQ ID NO: 13575 - protein, 57 aa, unidentified; identical to SEQ ID NO: 8264

SEQ ID NO: 13576 - protein, 337 aa, unidentified; identical to SEQ ID NO: 8339

SEQ ID NO: 13577 - protein, 57 aa, unidentified; identical to SEQ ID NO: 8179

SEQ ID NO: 13578 - protein, 60 aa, unidentified
GNSSDTSDCPVWAEAVKEPFVQVNPLKNGSYLVLASSTDCQIPPYVPSIVTVNETTSCFG

SEQ ID NO: 13579 - protein, 57 aa, unidentified; identical to SEQ ID NO: 8179

SEQ ID NO: 13580 - protein, 225 aa, unidentified
VESIPLFYLGYHLREMAKKPGKLYADDTAGWDTRITEADLDDECILCDYMEDEHKQLALSLFELCYKNKVALCPRPGRHGGTVMDVIFRRDQRGSGQVVTYALNTLTNIKVQLIRLAESEGVLDEDFNDHGIETWLNHYGEERLSRLLISGDDCLVNAFDERFGKALTWLNTMEKIRKDIDLCAPSNGYENFEKVEFCSNHFHELMLKDGRQLVVPCRSQNELVG

SEQ ID NO: 13581 - protein, 337 aa, unidentified; identical to SEQ ID NO: 8339

SEQ ID NO: 13582 - protein, 337 aa, unidentified; identical to SEQ ID NO: 8339

SEQ ID NO: 13583 - protein, 125 aa, unidentified
GLITGQIVSVDLRLMQITIAANVPTLSRLENAIAHDIMRITTNVNNTEVIVQLPETIMEHAGRLYQFNKDHCLSSTQRFFCPYSDAKLLTSKISSCLSGIRGDCIFSPVVGNFATRFISVKGVII

SEQ ID NO: 13584 - protein, 337 aa, unidentified; identical to SEQ ID NO: 8339

SEQ ID NO: 13585 - protein, 337 aa, unidentified; identical to SEQ ID NO: 8339

SEQ ID NO: 13586 - protein, 337 aa, unidentified; identical to SEQ ID NO: 8339

SEQ ID NO: 13587 - protein, 337 aa, unidentified; identical to SEQ ID NO: 8339

SEQ ID NO: 13588 - protein, 337 aa, unidentified; identical to SEQ ID NO: 8339

SEQ ID NO: 13589 - protein, 248 aa, unidentified; identical to SEQ ID NO: 8593

SEQ ID NO: 13590 - protein, 127 aa, unidentified; identical to SEQ ID NO: 8344

SEQ ID NO: 13591 - protein, 337 aa, unidentified; identical to SEQ ID NO: 8339

SEQ ID NO: 13592 - protein, 337 aa, unidentified; identical to SEQ ID NO: 8339

SEQ ID NO: 13593 - protein, 258 aa, unidentified; identical to SEQ ID NO: 8309

SEQ ID NO: 13594 - protein, 112 aa, unidentified; identical to SEQ ID NO: 13497

SEQ ID NO: 13595 - protein, 50 aa, unidentified; identical to SEQ ID NO: 8765

SEQ ID NO: 13596 - protein, 50 aa, unidentified; identical to SEQ ID NO: 8765

SEQ ID NO: 13597 - protein, 50 aa, unidentified; identical to SEQ ID NO: 8765

SEQ ID NO: 13598 - protein, 337 aa, unidentified; identical to SEQ ID NO: 8339

SEQ ID NO: 13599 - protein, 337 aa, unidentified; identical to SEQ ID NO: 8339

SEQ ID NO: 13600 - protein, 131 aa, unidentified
DMVGFILTKSETTTFCHENLLGGEEKRILQVRDLPFREVDTEDRIQVEKLRKATFEAKIPEWECSYFSDNTVKTKIYHVKKMNYQYDPSTRKIVIPPGITSEEGNGIFKLGNNSLFITMSPKPVFPECNIE

SEQ ID NO: 13601 - protein, 131 aa, unidentified; identical to SEQ ID NO: 13600

SEQ ID NO: 13602 - protein, 298 aa, unidentified; identical to SEQ ID NO: 8537

SEQ ID NO: 13603 - protein, 50 aa, unidentified; identical to SEQ ID NO: 8765

SEQ ID NO: 13604 - protein, 292 aa, unidentified
RFLEFESFGFLNEEHWASRELCGGGVEGIPLFYLGYHLEKMAEKAGILYADDTAGWDTRITMADLEDEYTLTELMEGEHKKLAETLFNFAYKNKVALCPRPGKNGGTVLDVISRTDQRGSGQVVTYALNTLTNIKVQLIRMAESEGVLDEEFHDNGMLKWLEKHGRDRLQRLMVSGDDCVVNAIDERFGKSLVWLNEMQKIRKDIDLWKPSAGHCNWEEVEFCSNHFHKLVMRDGRTLVVPCRHEVELVGRASVNQGGSTGISGTACLAKAYAQMWLLLYFHRRDLRILGMA

SEQ ID NO: 13605 - protein, 337 aa, unidentified; identical to SEQ ID NO: 8339

SEQ ID NO: 13606 - protein, 337 aa, unidentified; identical to SEQ ID NO: 8339

SEQ ID NO: 13607 - protein, 74 aa, unidentified; identical to SEQ ID NO: 8774

SEQ ID NO: 13608 - protein, 337 aa, unidentified; identical to SEQ ID NO: 8339

SEQ ID NO: 13609 - protein, 337 aa, unidentified; identical to SEQ ID NO: 8339

SEQ ID NO: 13610 - protein, 337 aa, unidentified; identical to SEQ ID NO: 8339

SEQ ID NO: 13611 - protein, 337 aa, unidentified; identical to SEQ ID NO: 8339

SEQ ID NO: 13612 - protein, 337 aa, unidentified; identical to SEQ ID NO: 8339

SEQ ID NO: 13613 - protein, 247 aa, unidentified
KPGEFGVAKGSRTIWYMWLGSRFLEFEALGFLNEERWASRDISGGGVEGIGINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCSHH

SEQ ID NO: 13614 - protein, 337 aa, unidentified; identical to SEQ ID NO: 8339

SEQ ID NO: 13615 - protein, 231 aa, unidentified; identical to SEQ ID NO: 9315

SEQ ID NO: 13616 - protein, 279 aa, unidentified; identical to SEQ ID NO: 10682

SEQ ID NO: 13617 - protein, 337 aa, unidentified; identical to SEQ ID NO: 8339

SEQ ID NO: 13618 - protein, 337 aa, unidentified; identical to SEQ ID NO: 8339

SEQ ID NO: 13619 - protein, 337 aa, unidentified; identical to SEQ ID NO: 8339

SEQ ID NO: 13620 - protein, 337 aa, unidentified; identical to SEQ ID NO: 8339

SEQ ID NO: 13621 - protein, 246 aa, unidentified; identical to SEQ ID NO: 11888

SEQ ID NO: 13622 - protein, 337 aa, unidentified; identical to SEQ ID NO: 8339

SEQ ID NO: 13623 - protein, 337 aa, unidentified; identical to SEQ ID NO: 8339

SEQ ID NO: 13624 - protein, 84 aa, unidentified; identical to SEQ ID NO: 13273

SEQ ID NO: 13625 - protein, 48 aa, unidentified; identical to SEQ ID NO: 8590

SEQ ID NO: 13626 - protein, 337 aa, unidentified; identical to SEQ ID NO: 8339

SEQ ID NO: 13627 - protein, 337 aa, unidentified; identical to SEQ ID NO: 8339

SEQ ID NO: 13628 - protein, 258 aa, unidentified; identical to SEQ ID NO: 8309

SEQ ID NO: 13629 - protein, 337 aa, unidentified; identical to SEQ ID NO: 8339

SEQ ID NO: 13630 - protein, 337 aa, unidentified; identical to SEQ ID NO: 8339

SEQ ID NO: 13631 - protein, 205 aa, unidentified; identical to SEQ ID NO: 11753

SEQ ID NO: 13632 - protein, 310 aa, unidentified; identical to SEQ ID NO: 8697

SEQ ID NO: 13633 - protein, 337 aa, unidentified; identical to SEQ ID NO: 8339

SEQ ID NO: 13634 - protein, 231 aa, unidentified; identical to SEQ ID NO: 9315

SEQ ID NO: 13635 - protein, 337 aa, unidentified; identical to SEQ ID NO: 8339

SEQ ID NO: 13636 - protein, 337 aa, unidentified; identical to SEQ ID NO: 8339

SEQ ID NO: 13637 - protein, 337 aa, unidentified; identical to SEQ ID NO: 8339

SEQ ID NO: 13638 - protein, 72 aa, unidentified; identical to SEQ ID NO: 13306

SEQ ID NO: 13639 - protein, 76 aa, unidentified; identical to SEQ ID NO: 8755

SEQ ID NO: 13640 - protein, 225 aa, unidentified; identical to SEQ ID NO: 12748

SEQ ID NO: 13641 - protein, 337 aa, unidentified; identical to SEQ ID NO: 8339

SEQ ID NO: 13642 - protein, 337 aa, unidentified; identical to SEQ ID NO: 8339

SEQ ID NO: 13643 - protein, 337 aa, unidentified; identical to SEQ ID NO: 8339

SEQ ID NO: 13644 - protein, 337 aa, unidentified; identical to SEQ ID NO: 8339

SEQ ID NO: 13645 - protein, 251 aa, unidentified; identical to SEQ ID NO: 8663

SEQ ID NO: 13646 - protein, 337 aa, unidentified; identical to SEQ ID NO: 8339

SEQ ID NO: 13647 - protein, 333 aa, unidentified; identical to SEQ ID NO: 8351

SEQ ID NO: 13648 - protein, 337 aa, unidentified; identical to SEQ ID NO: 8339

SEQ ID NO: 13649 - protein, 337 aa, unidentified; identical to SEQ ID NO: 8339

SEQ ID NO: 13650 - protein, 231 aa, unidentified; identical to SEQ ID NO: 9315

SEQ ID NO: 13651 - protein, 337 aa, unidentified; identical to SEQ ID NO: 8339

SEQ ID NO: 13652 - protein, 337 aa, unidentified; identical to SEQ ID NO: 8339

SEQ ID NO: 13653 - protein, 311 aa, unidentified; identical to SEQ ID NO: 9371

SEQ ID NO: 13654 - protein, 335 aa, unidentified; identical to SEQ ID NO: 8722

SEQ ID NO: 13655 - protein, 42 aa, unidentified; identical to SEQ ID NO: 10390

SEQ ID NO: 13656 - protein, 311 aa, unidentified; identical to SEQ ID NO: 9371

SEQ ID NO: 13657 - protein, 53 aa, unidentified
SDTLKCDDIGYTYNLHDMYHKKTCGGDIYDLDGPSPFKYLTKEIMKRREKIVG

SEQ ID NO: 13658 - protein, 182 aa, unidentified; identical to SEQ ID NO: 13316

SEQ ID NO: 13659 - protein, 303 aa, unidentified; identical to SEQ ID NO: 8684

SEQ ID NO: 13660 - protein, 47 aa, unidentified; identical to SEQ ID NO: 9070

SEQ ID NO: 13661 - protein, 111 aa, unidentified; identical to SEQ ID NO: 8936

SEQ ID NO: 13662 - protein, 51 aa, unidentified; identical to SEQ ID NO: 8938

SEQ ID NO: 13663 - protein, 74 aa, unidentified; identical to SEQ ID NO: 8774

SEQ ID NO: 13664 - protein, 182 aa, unidentified; identical to SEQ ID NO: 13316

SEQ ID NO: 13665 - protein, 182 aa, unidentified; identical to SEQ ID NO: 13316

SEQ ID NO: 13666 - protein, 74 aa, unidentified; identical to SEQ ID NO: 8774

SEQ ID NO: 13667 - protein, 67 aa, unidentified; identical to SEQ ID NO: 13439

SEQ ID NO: 13668 - protein, 310 aa, unidentified; identical to SEQ ID NO: 9321

SEQ ID NO: 13669 - protein, 48 aa, unidentified; identical to SEQ ID NO: 8590

SEQ ID NO: 13670 - protein, 51 aa, unidentified; identical to SEQ ID NO: 8938

SEQ ID NO: 13671 - protein, 82 aa, unidentified; identical to SEQ ID NO: 8792

SEQ ID NO: 13672 - protein, 74 aa, unidentified; identical to SEQ ID NO: 8267

SEQ ID NO: 13673 - protein, 50 aa, unidentified; identical to SEQ ID NO: 8765

SEQ ID NO: 13674 - protein, 50 aa, unidentified; identical to SEQ ID NO: 8765

SEQ ID NO: 13675 - protein, 50 aa, unidentified; identical to SEQ ID NO: 8765

SEQ ID NO: 13676 - protein, 95 aa, unidentified; identical to SEQ ID NO: 8787

SEQ ID NO: 13677 - protein, 95 aa, unidentified; identical to SEQ ID NO: 8787

SEQ ID NO: 13678 - protein, 95 aa, unidentified; identical to SEQ ID NO: 8787

SEQ ID NO: 13679 - protein, 95 aa, unidentified; identical to SEQ ID NO: 8787

SEQ ID NO: 13680 - protein, 95 aa, unidentified; identical to SEQ ID NO: 8787

SEQ ID NO: 13681 - protein, 148 aa, unidentified; identical to SEQ ID NO: 8790

SEQ ID NO: 13682 - protein, 95 aa, unidentified; identical to SEQ ID NO: 8787

SEQ ID NO: 13683 - protein, 48 aa, unidentified; identical to SEQ ID NO: 8590

SEQ ID NO: 13684 - protein, 196 aa, unidentified
KGSRTIWYMWLGSRFLEFEALGFLNEERWASRDISGGGVEGIGINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNA

SEQ ID NO: 13685 - protein, 95 aa, unidentified; identical to SEQ ID NO: 8787

SEQ ID NO: 13686 - protein, 95 aa, unidentified; identical to SEQ ID NO: 8787

SEQ ID NO: 13687 - protein, 95 aa, unidentified; identical to SEQ ID NO: 8787

SEQ ID NO: 13688 - protein, 54 aa, unidentified; identical to SEQ ID NO: 8783

SEQ ID NO: 13689 - protein, 57 aa, unidentified; identical to SEQ ID NO: 8179

SEQ ID NO: 13690 - protein, 337 aa, unidentified; identical to SEQ ID NO: 8339

SEQ ID NO: 13691 - protein, 337 aa, unidentified; identical to SEQ ID NO: 8339

SEQ ID NO: 13692 - protein, 337 aa, unidentified; identical to SEQ ID NO: 8339

SEQ ID NO: 13693 - protein, 87 aa, unidentified
GPGPVYRIRNKTLESATGIYKRVFWEPTDNRIGKYYNGTTEKEIVCKEWIQDENGHSCVNGIVRYGKKIIHPSSLANTAPEEERLFA

SEQ ID NO: 13694 - protein, 57 aa, unidentified; identical to SEQ ID NO: 8179

SEQ ID NO: 13695 - protein, 337 aa, unidentified; identical to SEQ ID NO: 8339

SEQ ID NO: 13696 - protein, 60 aa, unidentified; identical to SEQ ID NO: 8986

SEQ ID NO: 13697 - protein, 57 aa, unidentified; identical to SEQ ID NO: 8179

SEQ ID NO: 13698 - protein, 337 aa, unidentified; identical to SEQ ID NO: 8339

SEQ ID NO: 13699 - protein, 193 aa, unidentified; identical to SEQ ID NO: 8665

SEQ ID NO: 13700 - protein, 69 aa, unidentified; identical to SEQ ID NO: 8367

SEQ ID NO: 13701 - protein, 172 aa, unidentified
ADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVE

SEQ ID NO: 13702 - protein, 50 aa, unidentified; identical to SEQ ID NO: 9064

SEQ ID NO: 13703 - protein, 69 aa, unidentified; identical to SEQ ID NO: 8367

SEQ ID NO: 13704 - protein, 86 aa, unidentified; identical to SEQ ID NO: 9083

SEQ ID NO: 13705 - protein, 69 aa, unidentified; identical to SEQ ID NO: 8367

SEQ ID NO: 13706 - protein, 69 aa, unidentified; identical to SEQ ID NO: 8367

SEQ ID NO: 13707 - protein, 69 aa, unidentified; identical to SEQ ID NO: 8367

SEQ ID NO: 13708 - protein, 278 aa, unidentified; identical to SEQ ID NO: 8332

SEQ ID NO: 13709 - protein, 244 aa, unidentified
FCQKLPCPLSTLDKIFMNRTNLKNSCPRKQVIELYRRNQTSPDFYSTELLATTLLGSCQLMVCGDSGLRLSTGEWVSLDARSVAEQAWFKSYPKCPDHSIVNDVSLVGIISHLEKLSKADDSFRMCYNVKEKLMAGEPISREDLSFIAHSAPTAGPVYRLNNGTVEAGFSEYQTMLSVNPIAEGISHEAIGRHPVTHLPFLWKHWVKSTPTSQDGPNGIVSIAGYLLNPLVGLDSPGLYRDQLE

SEQ ID NO: 13710 - protein, 70 aa, unidentified; identical to SEQ ID NO: 8269

SEQ ID NO: 13711 - protein, 109 aa, unidentified; identical to SEQ ID NO: 8703

SEQ ID NO: 13712 - protein, 40 aa, unidentified; identical to SEQ ID NO: 8636

SEQ ID NO: 13713 - protein, 55 aa, unidentified; identical to SEQ ID NO: 8530

SEQ ID NO: 13714 - protein, 244 aa, unidentified; identical to SEQ ID NO: 13709

SEQ ID NO: 13715 - protein, 69 aa, unidentified; identical to SEQ ID NO: 8367

SEQ ID NO: 13716 - protein, 109 aa, unidentified; identical to SEQ ID NO: 8703

SEQ ID NO: 13717 - protein, 48 aa, unidentified
RNLRKVEHISLLLQTENKSLSTWEEYFKLESKHTFEGFSRISDWFNSL

SEQ ID NO: 13718 - protein, 39 aa, unidentified
AMSLACPKRKINGPDGYYDEYFAKMWHPPTHASPEVKGY

SEQ ID NO: 13719 - protein, 337 aa, unidentified; identical to SEQ ID NO: 8339

SEQ ID NO: 13720 - protein, 71 aa, unidentified; identical to SEQ ID NO: 13168

SEQ ID NO: 13721 - protein, 71 aa, unidentified; identical to SEQ ID NO: 13168

SEQ ID NO: 13722 - protein, 244 aa, unidentified; identical to SEQ ID NO: 13709

SEQ ID NO: 13723 - protein, 40 aa, unidentified
LLLCGRSCSSVYKGNYNLSSVDLDLSHLNMTMPLSCSKNN

SEQ ID NO: 13724 - protein, 254 aa, unidentified; identical to SEQ ID NO: 10329

SEQ ID NO: 13725 - protein, 244 aa, unidentified; identical to SEQ ID NO: 13709

SEQ ID NO: 13726 - protein, 40 aa, unidentified; identical to SEQ ID NO: 13723

SEQ ID NO: 13727 - protein, 74 aa, unidentified
SNCPIIHCKYSKAENCRLSMGVNSKSHYILRSGLLKYNLSLGGDIILQFIEIADNRLTIGSPSKIYNSLGQPVF

SEQ ID NO: 13728 - protein, 86 aa, unidentified
VNIGTMIDCLPDMPPLYLLGEDWYQISSRGLIRHSKPATMQQDDVNYEFSVLSGLGNGGLYNDETIALYQEALVSGITSEIVKTRV

SEQ ID NO: 13729 - protein, 42 aa, unidentified; identical to SEQ ID NO: 8416

SEQ ID NO: 13730 - protein, 337 aa, unidentified; identical to SEQ ID NO: 8339

SEQ ID NO: 13731 - protein, 337 aa, unidentified; identical to SEQ ID NO: 8339

SEQ ID NO: 13732 - protein, 333 aa, unidentified; identical to SEQ ID NO: 8351

SEQ ID NO: 13733 - protein, 337 aa, unidentified; identical to SEQ ID NO: 8339

SEQ ID NO: 13734 - protein, 40 aa, unidentified; identical to SEQ ID NO: 8636

SEQ ID NO: 13735 - protein, 126 aa, unidentified
RTRVVNTHVPKFALSGGVVFANCAPIVCKCQDPMANINQEPKVTNVMVSSDTCKEVYVDGIYITLGKKTLPRAMYAEDVALGGPISVDPIDLGNDVSAIQDAINKSKEHLDEANHLLDKVNPNIVN

SEQ ID NO: 13736 - protein, 40 aa, unidentified; identical to SEQ ID NO: 8636

SEQ ID NO: 13737 - protein, 337 aa, unidentified; identical to SEQ ID NO: 8339

SEQ ID NO: 13738 - protein, 69 aa, unidentified; identical to SEQ ID NO: 8367

SEQ ID NO: 13739 - protein, 337 aa, unidentified; identical to SEQ ID NO: 8339

SEQ ID NO: 13740 - protein, 337 aa, unidentified; identical to SEQ ID NO: 8339

SEQ ID NO: 13741 - protein, 236 aa, unidentified
YANTTEDELIKAHVSDCKDRKPGIRVHNDHTDYETYDIRAEMENERCQNTISKILNSEPINTVDMSYLSPTRPGRDYAYRFKQVNWTETFCLRWVQTGLSKDCNKFWKYSDRGGKVTKDHVGIGEYTRALCEFRPIIDKDGDGYISKEELGKHNMSTSFSLMRLDKKGGNQGADSIEVGFNGIVRIPKSEKDGEKYMVRMTSVYDGLEQRNRLIKFEVLEFEDVVAKYQGEGNYDV

SEQ ID NO: 13742 - protein, 76 aa, unidentified; identical to SEQ ID NO: 8186

SEQ ID NO: 13743 - protein, 86 aa, unidentified
LTPIDLSYLSPQRPGPGLGFLLINGTMHMSHLTYKALELANDSVWVLDRADRDNPSQVMWSRWERMAGVMVGPNGIVKQGSKIIFP

SEQ ID NO: 13744 - protein, 244 aa, unidentified; identical to SEQ ID NO: 13709

SEQ ID NO: 13745 - protein, 70 aa, unidentified; identical to SEQ ID NO: 8269

SEQ ID NO: 13746 - protein, 57 aa, unidentified; identical to SEQ ID NO: 8179

SEQ ID NO: 13747 - protein, 96 aa, unidentified; identical to SEQ ID NO: 8271

SEQ ID NO: 13748 - protein, 226 aa, unidentified
GDFGVAKGSRTIWYMWLGSRFLEFESFGFLNEEHWASRELSGGGVEGIPLNYLGYHLREMAQKPGVLYADDTAGWDTRITMADLEDEGILLDMMSGEHKKLASALFSKAYKVKVALCPRPGPKGGTLMDVISRTDQRGSGQVVTYALNTLTNIKVQLIRMAEAEGVLGATFEDFGIDRWLQEHGEDRVERMLVSGDDCVVNAIDERFGSSLNWLNAMEKVRKDIDL

SEQ ID NO: 13749 - protein, 55 aa, unidentified
HFNNASENPFQNYRTTRSVNGQYFTTSTPLPSKYPITISYLNVSEENNTHYNDST

SEQ ID NO: 13750 - protein, 54 aa, unidentified
CLKKPDIGNLQMFGTNLVLNEEDGMKICHLNNECSLKLPVVRCMNSSLFRVTCG

SEQ ID NO: 13751 - protein, 48 aa, unidentified; identical to SEQ ID NO: 8590

SEQ ID NO: 13752 - protein, 51 aa, unidentified; identical to SEQ ID NO: 8938

SEQ ID NO: 13753 - protein, 48 aa, unidentified; identical to SEQ ID NO: 8590

SEQ ID NO: 13754 - protein, 337 aa, unidentified; identical to SEQ ID NO: 8339

SEQ ID NO: 13755 - protein, 337 aa, unidentified; identical to SEQ ID NO: 8339

SEQ ID NO: 13756 - protein, 197 aa, unidentified; identical to SEQ ID NO: 8646

SEQ ID NO: 13757 - protein, 337 aa, unidentified; identical to SEQ ID NO: 8339

SEQ ID NO: 13758 - protein, 71 aa, unidentified; identical to SEQ ID NO: 13168

SEQ ID NO: 13759 - protein, 337 aa, unidentified; identical to SEQ ID NO: 8339

SEQ ID NO: 13760 - protein, 337 aa, unidentified; identical to SEQ ID NO: 8339

SEQ ID NO: 13761 - protein, 337 aa, unidentified; identical to SEQ ID NO: 8339

SEQ ID NO: 13762 - protein, 337 aa, unidentified; identical to SEQ ID NO: 8339

SEQ ID NO: 13763 - protein, 337 aa, unidentified; identical to SEQ ID NO: 8339

SEQ ID NO: 13764 - protein, 337 aa, unidentified; identical to SEQ ID NO: 8339

SEQ ID NO: 13765 - protein, 207 aa, unidentified
GVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCSHHFHELFLRDGRKLIVPCRDQHELVGRS

SEQ ID NO: 13766 - protein, 69 aa, unidentified; identical to SEQ ID NO: 8367

SEQ ID NO: 13767 - protein, 337 aa, unidentified; identical to SEQ ID NO: 8339

SEQ ID NO: 13768 - protein, 74 aa, unidentified
SLEVCGQNLVHIPDIGNFVGDDRFVRKLKKCKSLPSLRNAIENNSEDIVGNEKCLDFRLKMLDNPDKSIKYHDI

SEQ ID NO: 13769 - protein, 66 aa, unidentified
LLVEIIGLGLRTSHRAYVRTLYNDSDHDNALTIPTKFLDPKWTPVTALDIICPTEKQLMPEFRIST

SEQ ID NO: 13770 - protein, 42 aa, unidentified
NMLTPHVIRTKCTNWMTGLHLGEELLAHEGKLPITYCRAIHE

SEQ ID NO: 13771 - protein, 337 aa, unidentified; identical to SEQ ID NO: 8339

SEQ ID NO: 13772 - protein, 337 aa, unidentified; identical to SEQ ID NO: 8339

SEQ ID NO: 13773 - protein, 337 aa, unidentified; identical to SEQ ID NO: 8339

SEQ ID NO: 13774 - protein, 45 aa, unidentified; identical to SEQ ID NO: 8980

SEQ ID NO: 13775 - protein, 337 aa, unidentified; identical to SEQ ID NO: 8339

SEQ ID NO: 13776 - protein, 337 aa, unidentified; identical to SEQ ID NO: 8339

SEQ ID NO: 13777 - protein, 337 aa, unidentified; identical to SEQ ID NO: 8339

SEQ ID NO: 13778 - protein, 337 aa, unidentified; identical to SEQ ID NO: 8339

SEQ ID NO: 13779 - protein, 337 aa, unidentified; identical to SEQ ID NO: 8339

SEQ ID NO: 13780 - protein, 66 aa, unidentified; identical to SEQ ID NO: 13769

SEQ ID NO: 13781 - protein, 337 aa, unidentified; identical to SEQ ID NO: 8339

SEQ ID NO: 13782 - protein, 45 aa, unidentified; identical to SEQ ID NO: 8980

SEQ ID NO: 13783 - protein, 66 aa, unidentified; identical to SEQ ID NO: 13769

SEQ ID NO: 13784 - protein, 66 aa, unidentified; identical to SEQ ID NO: 13769

SEQ ID NO: 13785 - protein, 337 aa, unidentified; identical to SEQ ID NO: 8339

SEQ ID NO: 13786 - protein, 337 aa, unidentified; identical to SEQ ID NO: 8339

SEQ ID NO: 13787 - protein, 337 aa, unidentified; identical to SEQ ID NO: 8339

SEQ ID NO: 13788 - protein, 337 aa, unidentified; identical to SEQ ID NO: 8339

SEQ ID NO: 13789 - protein, 174 aa, unidentified; identical to SEQ ID NO: 8195

SEQ ID NO: 13790 - protein, 337 aa, unidentified; identical to SEQ ID NO: 8339

SEQ ID NO: 13791 - protein, 337 aa, unidentified; identical to SEQ ID NO: 8339

SEQ ID NO: 13792 - protein, 127 aa, unidentified; identical to SEQ ID NO: 9935

SEQ ID NO: 13793 - protein, 337 aa, unidentified; identical to SEQ ID NO: 8339

SEQ ID NO: 13794 - protein, 337 aa, unidentified; identical to SEQ ID NO: 8339

SEQ ID NO: 13795 - protein, 69 aa, unidentified; identical to SEQ ID NO: 8367

SEQ ID NO: 13796 - protein, 73 aa, unidentified
GPVLKKMTGKVSGTPTKRELWTEWFPYDDVEIGPNGVLKTPEGYKFPLYMIGHGLLDSDLQKTSQAEVFHHPQ

SEQ ID NO: 13797 - protein, 192 aa, unidentified; identical to SEQ ID NO: 9314

SEQ ID NO: 13798 - protein, 69 aa, unidentified; identical to SEQ ID NO: 8367

SEQ ID NO: 13799 - protein, 48 aa, unidentified; identical to SEQ ID NO: 8590

SEQ ID NO: 13800 - protein, 55 aa, unidentified; identical to SEQ ID NO: 8530

SEQ ID NO: 13801 - protein, 148 aa, unidentified
KSDGVDLAYMSFMNGKTLKAIKIEHLYARTSAPCSLVSYHGYYILAQCPPGDTVTVGFQDGANKHMCTIAHKVEFKPVGREKYRHPPEHGVELPCTKYTHKRADQGHYVEMHQPGLVADHSLLSMSSTKVKITVPSGSQVKYYCKCPD

SEQ ID NO: 13802 - protein, 337 aa, unidentified; identical to SEQ ID NO: 8339

SEQ ID NO: 13803 - protein, 337 aa, unidentified; identical to SEQ ID NO: 8339

SEQ ID NO: 13804 - protein, 74 aa, unidentified; identical to SEQ ID NO: 8267

SEQ ID NO: 13805 - protein, 69 aa, unidentified; identical to SEQ ID NO: 8367

SEQ ID NO: 13806 - protein, 69 aa, unidentified; identical to SEQ ID NO: 8367

SEQ ID NO: 13807 - protein, 55 aa, unidentified; identical to SEQ ID NO: 8530

SEQ ID NO: 13808 - protein, 69 aa, unidentified; identical to SEQ ID NO: 8367

SEQ ID NO: 13809 - protein, 325 aa, unidentified; identical to SEQ ID NO: 8411

SEQ ID NO: 13810 - protein, 69 aa, unidentified; identical to SEQ ID NO: 8367

SEQ ID NO: 13811 - protein, 69 aa, unidentified; identical to SEQ ID NO: 8367

SEQ ID NO: 13812 - protein, 238 aa, unidentified
SRTIWYMWLGSRFLEFESFGFLNEEHWASRELCGGGVEGIPLFYLGYHLEKMAEKAGILYADDTAGWDTRITMADLEDEYTLTELMEGEHKKLAETLFNFAYKNKVALCPRPGKNGGTVLDVISRTDQRGSGQVVTYALNTLTNIKVQLIRMAESEGVLDEEFHDNGMLKWLEKHGRDRLQRLMVSGDDCVVNAIDERFGKSLVWLNEMQKIRKDIDLWKPSAGHCNWEEVEFCSNHF

SEQ ID NO: 13813 - protein, 58 aa, unidentified
YAYRFEYETKVHHKCLDYNMSYSKPNCNRLFTDDEGTGGGYYNWTASHLKTIKRAHCQ

SEQ ID NO: 13814 - protein, 69 aa, unidentified; identical to SEQ ID NO: 8367

SEQ ID NO: 13815 - protein, 69 aa, unidentified; identical to SEQ ID NO: 8367

SEQ ID NO: 13816 - protein, 98 aa, unidentified
GFETFPGEHLSASACVQDLELCYRALEHDSIDLSTTAANNTPLNSRSTTTMTPATVHGETSQITATGKLSSTIVNKSSDQPRVSPTLSEDQDGFATTA

SEQ ID NO: 13817 - protein, 69 aa, unidentified; identical to SEQ ID NO: 8367

SEQ ID NO: 13818 - protein, 332 aa, unidentified; identical to SEQ ID NO: 9622

SEQ ID NO: 13819 - protein, 45 aa, unidentified; identical to SEQ ID NO: 8980

SEQ ID NO: 13820 - protein, 51 aa, unidentified; identical to SEQ ID NO: 8938

SEQ ID NO: 13821 - protein, 55 aa, unidentified; identical to SEQ ID NO: 8530

SEQ ID NO: 13822 - protein, 69 aa, unidentified; identical to SEQ ID NO: 8367

SEQ ID NO: 13823 - protein, 244 aa, unidentified; identical to SEQ ID NO: 13709

SEQ ID NO: 13824 - protein, 70 aa, unidentified; identical to SEQ ID NO: 8269

SEQ ID NO: 13825 - protein, 303 aa, unidentified
KPGDFGVAKGSRTIWYMWLGSRFLEFESFGFLNEEHWASRELCGGGVEGIPLFYLGYHLEKMAEKAGILYADDTAGWDTRITMADLEDEYTLTELMEGEHKKLAETLFNFAYKNKVALCPRPGKNGGTVLDVISRTDQRGSGQVVTYALNTLTNIKVQLIRMAESEGVLDEEFHDNGMLKWLEKHGRDRLQRLMVSGDDCVVNAIDERFGKSLVWLNEMQKIRKDIDLWKPSAGHCNWEEVEFCSNHFHKLVMRDGRTLVVPCRHEVELVGRASVNQGGSTGISGTACLAKAYAQMWLLLYFH

SEQ ID NO: 13826 - protein, 276 aa, unidentified; identical to SEQ ID NO: 12441

SEQ ID NO: 13827 - protein, 337 aa, unidentified; identical to SEQ ID NO: 8339

SEQ ID NO: 13828 - protein, 69 aa, unidentified; identical to SEQ ID NO: 8367

SEQ ID NO: 13829 - protein, 69 aa, unidentified; identical to SEQ ID NO: 8367

SEQ ID NO: 13830 - protein, 244 aa, unidentified; identical to SEQ ID NO: 13709

SEQ ID NO: 13831 - protein, 337 aa, unidentified; identical to SEQ ID NO: 8339

SEQ ID NO: 13832 - protein, 109 aa, unidentified; identical to SEQ ID NO: 8703

SEQ ID NO: 13833 - protein, 40 aa, unidentified; identical to SEQ ID NO: 8636

SEQ ID NO: 13834 - protein, 56 aa, unidentified; identical to SEQ ID NO: 8628

SEQ ID NO: 13835 - protein, 40 aa, unidentified; identical to SEQ ID NO: 8636

SEQ ID NO: 13836 - protein, 337 aa, unidentified; identical to SEQ ID NO: 8339

SEQ ID NO: 13837 - protein, 128 aa, unidentified
PHHRALIAVTMRLAYQNIAAVFPRTQSKYGSGFVMDFLGRRDQRGSGQVVTFALNTITNGKVQVARVLESEGLLHADESVLDAWLEKHLEEALGNMVIAGEEVVVSTTNRDFSSALEYLELTGKTRKN

SEQ ID NO: 13838 - protein, 73 aa, unidentified; identical to SEQ ID NO: 8578

SEQ ID NO: 13839 - protein, 333 aa, unidentified; identical to SEQ ID NO: 8351

SEQ ID NO: 13840 - protein, 48 aa, unidentified; identical to SEQ ID NO: 13717

SEQ ID NO: 13841 - protein, 337 aa, unidentified; identical to SEQ ID NO: 8339

SEQ ID NO: 13842 - protein, 39 aa, unidentified; identical to SEQ ID NO: 9144

SEQ ID NO: 13843 - protein, 337 aa, unidentified; identical to SEQ ID NO: 8339

SEQ ID NO: 13844 - protein, 48 aa, unidentified; identical to SEQ ID NO: 13717

SEQ ID NO: 13845 - protein, 70 aa, unidentified
DISYLVQQYPGIGPAYKIEDSQLFTATGMYTVLDTRNLNLKENMIGNTLSGDEVYSDFNMVSTNVSYGIN

SEQ ID NO: 13846 - protein, 248 aa, unidentified; identical to SEQ ID NO: 8593

SEQ ID NO: 13847 - protein, 244 aa, unidentified; identical to SEQ ID NO: 13709

SEQ ID NO: 13848 - protein, 70 aa, unidentified; identical to SEQ ID NO: 8269

SEQ ID NO: 13849 - protein, 57 aa, unidentified; identical to SEQ ID NO: 8179

SEQ ID NO: 13850 - protein, 57 aa, unidentified; identical to SEQ ID NO: 8179

SEQ ID NO: 13851 - protein, 96 aa, unidentified; identical to SEQ ID NO: 8271

SEQ ID NO: 13852 - protein, 337 aa, unidentified; identical to SEQ ID NO: 8339

SEQ ID NO: 13853 - protein, 75 aa, unidentified
PDFRTTTSITLSDNKNRKSCSVGVSEYGCDLLCSVVTETENEDYKSEPPTDMIYGRLFFNGTYSEVDLPVSTLFS

SEQ ID NO: 13854 - protein, 39 aa, unidentified
CYNGSVVLPVKLKTSIEPINSHSLICHSSLSTYNLDQIN

SEQ ID NO: 13855 - protein, 32 aa, unidentified
LIIYPPYIANTSWEESELHIHRTSKWTPYIDG

SEQ ID NO: 13856 - protein, 45 aa, unidentified; identical to SEQ ID NO: 8980

SEQ ID NO: 13857 - protein, 337 aa, unidentified; identical to SEQ ID NO: 8339

SEQ ID NO: 13858 - protein, 337 aa, unidentified; identical to SEQ ID NO: 8339

SEQ ID NO: 13859 - protein, 337 aa, unidentified; identical to SEQ ID NO: 8339

SEQ ID NO: 13860 - protein, 62 aa, unidentified; identical to SEQ ID NO: 8777

SEQ ID NO: 13861 - protein, 325 aa, unidentified
KPGEFGVAKGSRTIWYMWLGSRFLEFEALGFLNEERWASRDISGGGVEGIGINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCSHHFHELFLRDGRKLIVPCRDQHELVGRSMVSQGGSSGVAGTACLAKAYAQMWLMSYFHRRDLRTLGFGIMSSVPKDWFPT

SEQ ID NO: 13862 - protein, 45 aa, unidentified; identical to SEQ ID NO: 8980

SEQ ID NO: 13863 - protein, 337 aa, unidentified; identical to SEQ ID NO: 8339

SEQ ID NO: 13864 - protein, 104 aa, unidentified
SFYDFVPKNSYTVVSNEGLKETLARKNSFSTSWEKSHSSSKTESYNVFVAAWNGITAFFQHITLILTVSATLIGLIFGYVLLRQIFPPRSATNYKYNQELQTFP

SEQ ID NO: 13865 - protein, 231 aa, unidentified; identical to SEQ ID NO: 9315

SEQ ID NO: 13866 - protein, 337 aa, unidentified; identical to SEQ ID NO: 8339

SEQ ID NO: 13867 - protein, 337 aa, unidentified; identical to SEQ ID NO: 8339

SEQ ID NO: 13868 - protein, 337 aa, unidentified; identical to SEQ ID NO: 8339

SEQ ID NO: 13869 - protein, 337 aa, unidentified; identical to SEQ ID NO: 8339

SEQ ID NO: 13870 - protein, 337 aa, unidentified; identical to SEQ ID NO: 8339

SEQ ID NO: 13871 - protein, 248 aa, unidentified; identical to SEQ ID NO: 8593

SEQ ID NO: 13872 - protein, 248 aa, unidentified; identical to SEQ ID NO: 8593

SEQ ID NO: 13873 - protein, 258 aa, unidentified; identical to SEQ ID NO: 8309

SEQ ID NO: 13874 - protein, 337 aa, unidentified; identical to SEQ ID NO: 8339

SEQ ID NO: 13875 - protein, 337 aa, unidentified; identical to SEQ ID NO: 8339

SEQ ID NO: 13876 - protein, 258 aa, unidentified; identical to SEQ ID NO: 8309

SEQ ID NO: 13877 - protein, 258 aa, unidentified; identical to SEQ ID NO: 8309

SEQ ID NO: 13878 - protein, 337 aa, unidentified; identical to SEQ ID NO: 8339

SEQ ID NO: 13879 - protein, 337 aa, unidentified; identical to SEQ ID NO: 8339

SEQ ID NO: 13880 - protein, 337 aa, unidentified; identical to SEQ ID NO: 8339

SEQ ID NO: 13881 - protein, 337 aa, unidentified; identical to SEQ ID NO: 8339

SEQ ID NO: 13882 - protein, 337 aa, unidentified; identical to SEQ ID NO: 8339

SEQ ID NO: 13883 - protein, 337 aa, unidentified; identical to SEQ ID NO: 8339

SEQ ID NO: 13884 - protein, 248 aa, unidentified; identical to SEQ ID NO: 8593

SEQ ID NO: 13885 - protein, 127 aa, unidentified; identical to SEQ ID NO: 8344

SEQ ID NO: 13886 - protein, 96 aa, unidentified; identical to SEQ ID NO: 8176

SEQ ID NO: 13887 - protein, 333 aa, unidentified; identical to SEQ ID NO: 8351

SEQ ID NO: 13888 - protein, 199 aa, unidentified
FEALGFLNEERWASRDISGGGVEGIGINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTRE

SEQ ID NO: 13889 - protein, 337 aa, unidentified; identical to SEQ ID NO: 8339

SEQ ID NO: 13890 - protein, 337 aa, unidentified; identical to SEQ ID NO: 8339

SEQ ID NO: 13891 - protein, 337 aa, unidentified; identical to SEQ ID NO: 8339

SEQ ID NO: 13892 - protein, 58 aa, unidentified
LWTEWFPYEGVEIGPNGILKTPTGYKFPLFMIGHGMLDSDLHKTSQAEVFEHPHLAEA

SEQ ID NO: 13893 - protein, 337 aa, unidentified; identical to SEQ ID NO: 8339

SEQ ID NO: 13894 - protein, 69 aa, unidentified; identical to SEQ ID NO: 8367

SEQ ID NO: 13895 - protein, 48 aa, unidentified; identical to SEQ ID NO: 8590

SEQ ID NO: 13896 - protein, 55 aa, unidentified; identical to SEQ ID NO: 8530

SEQ ID NO: 13897 - protein, 69 aa, unidentified; identical to SEQ ID NO: 8367

SEQ ID NO: 13898 - protein, 69 aa, unidentified; identical to SEQ ID NO: 8367

SEQ ID NO: 13899 - protein, 278 aa, unidentified; identical to SEQ ID NO: 8332

SEQ ID NO: 13900 - protein, 50 aa, unidentified; identical to SEQ ID NO: 9145

SEQ ID NO: 13901 - protein, 268 aa, unidentified; identical to SEQ ID NO: 9364

SEQ ID NO: 13902 - protein, 337 aa, unidentified; identical to SEQ ID NO: 8339

SEQ ID NO: 13903 - protein, 325 aa, unidentified; identical to SEQ ID NO: 8411

SEQ ID NO: 13904 - protein, 69 aa, unidentified; identical to SEQ ID NO: 8367

SEQ ID NO: 13905 - protein, 69 aa, unidentified; identical to SEQ ID NO: 8367

SEQ ID NO: 13906 - protein, 332 aa, unidentified; identical to SEQ ID NO: 9622

SEQ ID NO: 13907 - protein, 337 aa, unidentified; identical to SEQ ID NO: 8339

SEQ ID NO: 13908 - protein, 69 aa, unidentified; identical to SEQ ID NO: 8367

SEQ ID NO: 13909 - protein, 337 aa, unidentified; identical to SEQ ID NO: 8339

SEQ ID NO: 13910 - protein, 231 aa, unidentified; identical to SEQ ID NO: 9315

SEQ ID NO: 13911 - protein, 244 aa, unidentified; identical to SEQ ID NO: 13709

SEQ ID NO: 13912 - protein, 70 aa, unidentified; identical to SEQ ID NO: 8269

SEQ ID NO: 13913 - protein, 57 aa, unidentified; identical to SEQ ID NO: 8179

SEQ ID NO: 13914 - protein, 57 aa, unidentified; identical to SEQ ID NO: 8179

SEQ ID NO: 13915 - protein, 96 aa, unidentified; identical to SEQ ID NO: 8271

SEQ ID NO: 13916 - protein, 48 aa, unidentified; identical to SEQ ID NO: 13717

SEQ ID NO: 13917 - protein, 229 aa, unidentified; identical to SEQ ID NO: 8171

SEQ ID NO: 13918 - protein, 50 aa, unidentified; identical to SEQ ID NO: 9145

SEQ ID NO: 13919 - protein, 50 aa, unidentified; identical to SEQ ID NO: 9145

SEQ ID NO: 13920 - protein, 337 aa, unidentified; identical to SEQ ID NO: 8339

SEQ ID NO: 13921 - protein, 337 aa, unidentified; identical to SEQ ID NO: 8339

SEQ ID NO: 13922 - protein, 70 aa, unidentified; identical to SEQ ID NO: 13845

SEQ ID NO: 13923 - protein, 50 aa, unidentified; identical to SEQ ID NO: 9145

SEQ ID NO: 13924 - protein, 50 aa, unidentified; identical to SEQ ID NO: 9145

SEQ ID NO: 13925 - protein, 268 aa, unidentified; identical to SEQ ID NO: 9364

SEQ ID NO: 13926 - protein, 337 aa, unidentified; identical to SEQ ID NO: 8339

SEQ ID NO: 13927 - protein, 333 aa, unidentified; identical to SEQ ID NO: 8351

SEQ ID NO: 13928 - protein, 244 aa, unidentified; identical to SEQ ID NO: 13709

SEQ ID NO: 13929 - protein, 266 aa, unidentified; identical to SEQ ID NO: 8360

SEQ ID NO: 13930 - protein, 325 aa, unidentified; identical to SEQ ID NO: 8411

SEQ ID NO: 13931 - protein, 69 aa, unidentified; identical to SEQ ID NO: 8367

SEQ ID NO: 13932 - protein, 69 aa, unidentified; identical to SEQ ID NO: 8367

SEQ ID NO: 13933 - protein, 69 aa, unidentified; identical to SEQ ID NO: 8367

SEQ ID NO: 13934 - protein, 50 aa, unidentified; identical to SEQ ID NO: 9145

SEQ ID NO: 13935 - protein, 109 aa, unidentified; identical to SEQ ID NO: 8703

SEQ ID NO: 13936 - protein, 108 aa, unidentified; identical to SEQ ID NO: 8633

SEQ ID NO: 13937 - protein, 278 aa, unidentified; identical to SEQ ID NO: 8332

SEQ ID NO: 13938 - protein, 325 aa, unidentified; identical to SEQ ID NO: 8411

SEQ ID NO: 13939 - protein, 337 aa, unidentified; identical to SEQ ID NO: 8339

SEQ ID NO: 13940 - protein, 104 aa, unidentified; identical to SEQ ID NO: 13474

SEQ ID NO: 13941 - protein, 258 aa, unidentified; identical to SEQ ID NO: 8309

SEQ ID NO: 13942 - protein, 337 aa, unidentified; identical to SEQ ID NO: 8339

SEQ ID NO: 13943 - protein, 59 aa, unidentified
WWLNGLRKHNWNQQGFFLRQLAKTRGIVSRRTRRSTSQSSGPILPLCPRLSEFKNTRVD

SEQ ID NO: 13944 - protein, 189 aa, unidentified
PHHRALIAVTMRLAYQNIAAVFPRTQSKYGSGFVMDFLGRRDQRGSGQVVTFALNTITNGKVQVARVLESEGLLHADESVLDAWLEKHLEEALGNMVIAGEEVVVSTTNRDFSSALEYLELTGKTRKNVPQGAPSRMESDWEKVEFCFHHYHEMCLKDGRILIAPCRHENEVLGRSRLQKGGVVSIPES

SEQ ID NO: 13945 - protein, 249 aa, unidentified; identical to SEQ ID NO: 10206

SEQ ID NO: 13946 - protein, 96 aa, unidentified
SGIHLTAPEAVTWASAVAAIFTRTHGSFPMHNLSAILTGIANGEGVESAYNLGMMLSNGDFNLVYGIVRGLLPGQAAVAYMQQRLDAEPSDALRAQ

SEQ ID NO: 13947 - protein, 47 aa, unidentified; identical to SEQ ID NO: 8587

SEQ ID NO: 13948 - protein, 337 aa, unidentified; identical to SEQ ID NO: 8339

SEQ ID NO: 13949 - protein, 337 aa, unidentified; identical to SEQ ID NO: 8339

SEQ ID NO: 13950 - protein, 337 aa, unidentified; identical to SEQ ID NO: 8339

SEQ ID NO: 13951 - protein, 337 aa, unidentified; identical to SEQ ID NO: 8339

SEQ ID NO: 13952 - protein, 69 aa, unidentified; identical to SEQ ID NO: 8367

SEQ ID NO: 13953 - protein, 184 aa, unidentified; identical to SEQ ID NO: 9590

SEQ ID NO: 13954 - protein, 337 aa, unidentified; identical to SEQ ID NO: 8339

SEQ ID NO: 13955 - protein, 76 aa, unidentified
CVGWNDWIPVKENLKQGFNGIMSDHGRIIYPIRYLLGDEWNPEMHALQYVKFMPHPLLHPYSHQIKDKGRSELVMD

SEQ ID NO: 13956 - protein, 337 aa, unidentified; identical to SEQ ID NO: 8339

SEQ ID NO: 13957 - protein, 76 aa, unidentified; identical to SEQ ID NO: 13955

SEQ ID NO: 13958 - protein, 45 aa, unidentified; identical to SEQ ID NO: 8980

SEQ ID NO: 13959 - protein, 45 aa, unidentified; identical to SEQ ID NO: 8980

SEQ ID NO: 13960 - protein, 90 aa, unidentified; identical to SEQ ID NO: 13319

SEQ ID NO: 13961 - protein, 74 aa, unidentified; identical to SEQ ID NO: 13768

SEQ ID NO: 13962 - protein, 66 aa, unidentified; identical to SEQ ID NO: 13769

SEQ ID NO: 13963 - protein, 337 aa, unidentified; identical to SEQ ID NO: 8339

SEQ ID NO: 13964 - protein, 248 aa, unidentified; identical to SEQ ID NO: 8593

SEQ ID NO: 13965 - protein, 337 aa, unidentified; identical to SEQ ID NO: 8339

SEQ ID NO: 13966 - protein, 337 aa, unidentified; identical to SEQ ID NO: 8339

SEQ ID NO: 13967 - protein, 248 aa, unidentified; identical to SEQ ID NO: 8593

SEQ ID NO: 13968 - protein, 248 aa, unidentified; identical to SEQ ID NO: 8593

SEQ ID NO: 13969 - protein, 69 aa, unidentified; identical to SEQ ID NO: 8367

SEQ ID NO: 13970 - protein, 337 aa, unidentified; identical to SEQ ID NO: 8339

SEQ ID NO: 13971 - protein, 337 aa, unidentified; identical to SEQ ID NO: 8339

SEQ ID NO: 13972 - protein, 337 aa, unidentified; identical to SEQ ID NO: 8339

SEQ ID NO: 13973 - protein, 333 aa, unidentified; identical to SEQ ID NO: 8351

SEQ ID NO: 13974 - protein, 337 aa, unidentified; identical to SEQ ID NO: 8339

SEQ ID NO: 13975 - protein, 337 aa, unidentified; identical to SEQ ID NO: 8339

SEQ ID NO: 13976 - protein, 127 aa, unidentified; identical to SEQ ID NO: 8344

SEQ ID NO: 13977 - protein, 337 aa, unidentified; identical to SEQ ID NO: 8339

SEQ ID NO: 13978 - protein, 333 aa, unidentified; identical to SEQ ID NO: 8351

SEQ ID NO: 13979 - protein, 258 aa, unidentified; identical to SEQ ID NO: 8309

SEQ ID NO: 13980 - protein, 337 aa, unidentified; identical to SEQ ID NO: 8339

SEQ ID NO: 13981 - protein, 337 aa, unidentified; identical to SEQ ID NO: 8339

SEQ ID NO: 13982 - protein, 337 aa, unidentified; identical to SEQ ID NO: 8339

SEQ ID NO: 13983 - protein, 174 aa, unidentified; identical to SEQ ID NO: 8195

SEQ ID NO: 13984 - protein, 45 aa, unidentified; identical to SEQ ID NO: 8980

SEQ ID NO: 13985 - protein, 71 aa, unidentified; identical to SEQ ID NO: 13168

SEQ ID NO: 13986 - protein, 157 aa, unidentified
GVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTR

SEQ ID NO: 13987 - protein, 337 aa, unidentified; identical to SEQ ID NO: 8339

SEQ ID NO: 13988 - protein, 337 aa, unidentified; identical to SEQ ID NO: 8339

SEQ ID NO: 13989 - protein, 337 aa, unidentified; identical to SEQ ID NO: 8339

SEQ ID NO: 13990 - protein, 337 aa, unidentified; identical to SEQ ID NO: 8339

SEQ ID NO: 13991 - protein, 66 aa, unidentified; identical to SEQ ID NO: 13769

SEQ ID NO: 13992 - protein, 45 aa, unidentified; identical to SEQ ID NO: 8980

SEQ ID NO: 13993 - protein, 69 aa, unidentified; identical to SEQ ID NO: 8367

SEQ ID NO: 13994 - protein, 69 aa, unidentified; identical to SEQ ID NO: 8367

SEQ ID NO: 13995 - protein, 81 aa, unidentified
VNIGTMIDCLPDMPPLYLLGEDWYQISSRGLIRHSKPATMQQDDVNYEFSVLSGLGNGGLYNDETIALYQEALVSGITSEI

SEQ ID NO: 13996 - protein, 50 aa, unidentified; identical to SEQ ID NO: 9145

SEQ ID NO: 13997 - protein, 244 aa, unidentified; identical to SEQ ID NO: 13709

SEQ ID NO: 13998 - protein, 337 aa, unidentified; identical to SEQ ID NO: 8339

SEQ ID NO: 13999 - protein, 337 aa, unidentified; identical to SEQ ID NO: 8339

SEQ ID NO: 14000 - protein, 244 aa, unidentified; identical to SEQ ID NO: 13709

SEQ ID NO: 14001 - protein, 76 aa, unidentified; identical to SEQ ID NO: 8186

SEQ ID NO: 14002 - protein, 68 aa, unidentified; identical to SEQ ID NO: 8664

SEQ ID NO: 14003 - protein, 337 aa, unidentified; identical to SEQ ID NO: 8339

SEQ ID NO: 14004 - protein, 244 aa, unidentified; identical to SEQ ID NO: 13709

SEQ ID NO: 14005 - protein, 69 aa, unidentified; identical to SEQ ID NO: 8367

SEQ ID NO: 14006 - protein, 337 aa, unidentified; identical to SEQ ID NO: 8339

SEQ ID NO: 14007 - protein, 69 aa, unidentified; identical to SEQ ID NO: 8367

SEQ ID NO: 14008 - protein, 246 aa, unidentified
GDFGVAKGSRTIWYMWLGSRFLEFESFGFLNEEHWASRELSGGGVEGIPLNYLGYHLREMAQKPGVLYADDTAGWDTRITMADLEDEGILLDMMSGEHKKLASALFSKAYKVKVALCPRPGPKGGTLMDVISRTDQRGSGQVVTYALNTLTNIKVQLIRMAEAEGVLGATFEDFGIDRWLQEHGEDRVERMLVSGDDCVVNAIDERFGSSLNWLNAMEKVRKDIDLWKPSPSFRNWERVEFCSNHF

SEQ ID NO: 14009 - protein, 50 aa, unidentified; identical to SEQ ID NO: 9145

SEQ ID NO: 14010 - protein, 292 aa, unidentified
KPGEFGVAKGSRTIWYMWLGSRFLEFEALGFLNEERWASRDISGGGVEGIGINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCSHHFHELFLRDGRKLIVPCRDQHELVGRSMVSQGGSSGVAGTACLAKA

SEQ ID NO: 14011 - protein, 50 aa, unidentified; identical to SEQ ID NO: 9145

SEQ ID NO: 14012 - protein, 50 aa, unidentified; identical to SEQ ID NO: 9145

SEQ ID NO: 14013 - protein, 42 aa, unidentified; identical to SEQ ID NO: 8630

SEQ ID NO: 14014 - protein, 59 aa, unidentified
NHTYWRSDAGDGFNTTLAVTNLAYVLSANESTKIFKQMQDDLRKRIENMTSSNLTTLSP

SEQ ID NO: 14015 - protein, 325 aa, unidentified; identical to SEQ ID NO: 8411

SEQ ID NO: 14016 - protein, 65 aa, unidentified
CKEVYVDGIYITLGKKTLPRAMYAEDVALGGPISVDPIDLGNDVSAIQDAINKSKEHLDEANHLL

SEQ ID NO: 14017 - protein, 101 aa, unidentified
YASMDTIYVNLGRPKPNFKVTVEGYLCTKIVLQTVCEAFLFSANEVNHIRKEAPIDKSECDSAIYRFIKGDVIDETFLPDYFSGYKRTVRQRIYIKVITHE

SEQ ID NO: 14018 - protein, 69 aa, unidentified
EDHVGSMQLILQNAHNQVMRFRKLQNFFSWSLVDSAGNSMPGGYCLEKWMLVASELKCFGNTAVAKCNI

SEQ ID NO: 14019 - protein, 48 aa, unidentified; identical to SEQ ID NO: 13717

SEQ ID NO: 14020 - protein, 332 aa, unidentified; identical to SEQ ID NO: 9622

SEQ ID NO: 14021 - protein, 109 aa, unidentified; identical to SEQ ID NO: 8703

SEQ ID NO: 14022 - protein, 141 aa, unidentified
NNSHHYISMGTSGLELTFTNDSILSHNFCNLTDSFRKRTFDHVLMSIVTSLHLSVRGNNNYKAVSCDFNNGITIQYNLSFSGAQEAVNQCNTFRGRVLDMFRTAFGGKFMRSGYGWKDAQGRTTWCSQTSYQYLIIQNRTW

SEQ ID NO: 14023 - protein, 50 aa, unidentified; identical to SEQ ID NO: 9145

SEQ ID NO: 14024 - protein, 69 aa, unidentified; identical to SEQ ID NO: 8367

SEQ ID NO: 14025 - protein, 42 aa, unidentified; identical to SEQ ID NO: 8416

SEQ ID NO: 14026 - protein, 42 aa, unidentified; identical to SEQ ID NO: 8416

SEQ ID NO: 14027 - protein, 49 aa, unidentified; identical to SEQ ID NO: 8516

SEQ ID NO: 14028 - protein, 74 aa, unidentified; identical to SEQ ID NO: 8267

SEQ ID NO: 14029 - protein, 337 aa, unidentified; identical to SEQ ID NO: 8339

SEQ ID NO: 14030 - protein, 333 aa, unidentified; identical to SEQ ID NO: 8351

SEQ ID NO: 14031 - protein, 337 aa, unidentified; identical to SEQ ID NO: 8339

SEQ ID NO: 14032 - protein, 50 aa, unidentified; identical to SEQ ID NO: 9145

SEQ ID NO: 14033 - protein, 50 aa, unidentified; identical to SEQ ID NO: 9145

SEQ ID NO: 14034 - protein, 109 aa, unidentified; identical to SEQ ID NO: 8703

SEQ ID NO: 14035 - protein, 73 aa, unidentified; identical to SEQ ID NO: 8578

SEQ ID NO: 14036 - protein, 48 aa, unidentified; identical to SEQ ID NO: 13717

SEQ ID NO: 14037 - protein, 333 aa, unidentified; identical to SEQ ID NO: 8351

SEQ ID NO: 14038 - protein, 337 aa, unidentified; identical to SEQ ID NO: 8339

SEQ ID NO: 14039 - protein, 337 aa, unidentified; identical to SEQ ID NO: 8339

SEQ ID NO: 14040 - protein, 154 aa, unidentified; identical to SEQ ID NO: 9158

SEQ ID NO: 14041 - protein, 209 aa, unidentified
SRTIWYMWLGSRFLEFESFGFLNEEHWASRELSGGGVEGIPLNYLGYHLREMAQKPGVLYADDTAGWDTRITMADLEDEGILLDMMSGEHKKLASALFSKAYKVKVALCPRPGPKGGTLMDVISRTDQRGSGQVVTYALNTLTNIKVQLIRMAEAEGVLGATFEDFGIDRWLQEHGEDRVERMLVSGDDCVVNAIDERFGSSLNWLNAM

SEQ ID NO: 14042 - protein, 76 aa, unidentified; identical to SEQ ID NO: 8186

SEQ ID NO: 14043 - protein, 157 aa, unidentified
LYADDTAGWDTRITMADLEDEGILLDMMSGEHKKLASALFSKAYKVKVALCPRPGPKGGTLMDVISRTDQRGSGQVVTYALNTLTNIKVQLIRMAEAEGVLGATFEDFGIDRWLQEHGEDRVERMLVSGDDCVVNAIDERFGSSLNWLNAMEKVRKD

SEQ ID NO: 14044 - protein, 75 aa, unidentified; identical to SEQ ID NO: 13853

SEQ ID NO: 14045 - protein, 59 aa, unidentified; identical to SEQ ID NO: 13943

SEQ ID NO: 14046 - protein, 258 aa, unidentified; identical to SEQ ID NO: 8309

SEQ ID NO: 14047 - protein, 66 aa, unidentified; identical to SEQ ID NO: 13769

SEQ ID NO: 14048 - protein, 90 aa, unidentified; identical to SEQ ID NO: 13319

SEQ ID NO: 14049 - protein, 76 aa, unidentified
KTKQYEPITYQECLKTMNKSIIESIFDLKDDGLFPPTRCKWYSSETVEKSVITRNPVTADYDPFTDSLRHGLLNPE

SEQ ID NO: 14050 - protein, 139 aa, unidentified
EKAGILYADDTAGWDTRITMADLEDEYTLTELMEGEHKKLAETLFNFAYKNKVALCPRPGKNGGTVLDVISRTDQRGSGQVVTYALNTLTNIKVQLIRMAESEGVLDEEFHDNGMLKWLEKHGRDRLQRLMVSGDDCVV

SEQ ID NO: 14051 - protein, 337 aa, unidentified; identical to SEQ ID NO: 8339

SEQ ID NO: 14052 - protein, 337 aa, unidentified; identical to SEQ ID NO: 8339

SEQ ID NO: 14053 - protein, 337 aa, unidentified; identical to SEQ ID NO: 8339

SEQ ID NO: 14054 - protein, 310 aa, unidentified; identical to SEQ ID NO: 9321

SEQ ID NO: 14055 - protein, 337 aa, unidentified; identical to SEQ ID NO: 8339

SEQ ID NO: 14056 - protein, 246 aa, unidentified; identical to SEQ ID NO: 10234

SEQ ID NO: 14057 - protein, 337 aa, unidentified; identical to SEQ ID NO: 8339

SEQ ID NO: 14058 - protein, 325 aa, unidentified; identical to SEQ ID NO: 13861

SEQ ID NO: 14059 - protein, 337 aa, unidentified; identical to SEQ ID NO: 8339

SEQ ID NO: 14060 - protein, 337 aa, unidentified; identical to SEQ ID NO: 8339

SEQ ID NO: 14061 - protein, 71 aa, unidentified; identical to SEQ ID NO: 13168

SEQ ID NO: 14062 - protein, 74 aa, unidentified; identical to SEQ ID NO: 13768

SEQ ID NO: 14063 - protein, 48 aa, unidentified; identical to SEQ ID NO: 13717

SEQ ID NO: 14064 - protein, 337 aa, unidentified; identical to SEQ ID NO: 8339

SEQ ID NO: 14065 - protein, 89 aa, unidentified; identical to SEQ ID NO: 9170

SEQ ID NO: 14066 - protein, 71 aa, unidentified; identical to SEQ ID NO: 13168

SEQ ID NO: 14067 - protein, 231 aa, unidentified; identical to SEQ ID NO: 9315

SEQ ID NO: 14068 - protein, 217 aa, unidentified
RDISGGGVEGIGINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCSHHFHELFLRDG

SEQ ID NO: 14069 - protein, 337 aa, unidentified; identical to SEQ ID NO: 8339

SEQ ID NO: 14070 - protein, 337 aa, unidentified; identical to SEQ ID NO: 8339

SEQ ID NO: 14071 - protein, 248 aa, unidentified; identical to SEQ ID NO: 8593

SEQ ID NO: 14072 - protein, 337 aa, unidentified; identical to SEQ ID NO: 8339

SEQ ID NO: 14073 - protein, 71 aa, unidentified; identical to SEQ ID NO: 13168

SEQ ID NO: 14074 - protein, 45 aa, unidentified; identical to SEQ ID NO: 8980

SEQ ID NO: 14075 - protein, 102 aa, unidentified
PLRIHTCTAKQASFLLFQPDYQSLAEEKEKLPSPSLTNSLPPGSTLNETQIRCSVSWVIQLASQHKHIGHKHSDGTVTITIEKAMHRSSMDGGKVQAVVNGV

SEQ ID NO: 14076 - protein, 73 aa, unidentified; identical to SEQ ID NO: 8578

SEQ ID NO: 14077 - protein, 319 aa, unidentified; identical to SEQ ID NO: 8858

SEQ ID NO: 14078 - protein, 258 aa, unidentified; identical to SEQ ID NO: 8309

SEQ ID NO: 14079 - protein, 258 aa, unidentified; identical to SEQ ID NO: 8309

SEQ ID NO: 14080 - protein, 252 aa, unidentified
VLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCSHHFHELFLRDGRKLIVPCRDQHELVGRSMVSQGGSSGVAGTACLAKAYAQMWLMSYFHRRDLRTLGFGIMSSVP

SEQ ID NO: 14081 - protein, 229 aa, unidentified; identical to SEQ ID NO: 8171

SEQ ID NO: 14082 - protein, 226 aa, unidentified; identical to SEQ ID NO: 10104

SEQ ID NO: 14083 - protein, 154 aa, unidentified; identical to SEQ ID NO: 8743

SEQ ID NO: 14084 - protein, 337 aa, unidentified; identical to SEQ ID NO: 8339

SEQ ID NO: 14085 - protein, 248 aa, unidentified; identical to SEQ ID NO: 8593

SEQ ID NO: 14086 - protein, 127 aa, unidentified; identical to SEQ ID NO: 8344

SEQ ID NO: 14087 - protein, 337 aa, unidentified; identical to SEQ ID NO: 8339

SEQ ID NO: 14088 - protein, 337 aa, unidentified; identical to SEQ ID NO: 8339

SEQ ID NO: 14089 - protein, 337 aa, unidentified; identical to SEQ ID NO: 8339

SEQ ID NO: 14090 - protein, 127 aa, unidentified; identical to SEQ ID NO: 8344

SEQ ID NO: 14091 - protein, 258 aa, unidentified; identical to SEQ ID NO: 8309

SEQ ID NO: 14092 - protein, 319 aa, unidentified; identical to SEQ ID NO: 8858

SEQ ID NO: 14093 - protein, 248 aa, unidentified; identical to SEQ ID NO: 8593

SEQ ID NO: 14094 - protein, 258 aa, unidentified; identical to SEQ ID NO: 8309

SEQ ID NO: 14095 - protein, 258 aa, unidentified; identical to SEQ ID NO: 8309

SEQ ID NO: 14096 - protein, 337 aa, unidentified; identical to SEQ ID NO: 8339

SEQ ID NO: 14097 - protein, 22 aa, unidentified
MVPQALLFVPLLVFPLCFGKFP

SEQ ID NO: 14098 - protein, 127 aa, unidentified; identical to SEQ ID NO: 8344

SEQ ID NO: 14099 - protein, 22 aa, unidentified
MVPQALLFVPLLVFPLCFGKFP

SEQ ID NO: 14100 - protein, 337 aa, unidentified; identical to SEQ ID NO: 8339

SEQ ID NO: 14101 - protein, 333 aa, unidentified; identical to SEQ ID NO: 8351

SEQ ID NO: 14102 - protein, 248 aa, unidentified; identical to SEQ ID NO: 8593

SEQ ID NO: 14103 - protein, 337 aa, unidentified; identical to SEQ ID NO: 8339

SEQ ID NO: 14104 - protein, 337 aa, unidentified; identical to SEQ ID NO: 8339

SEQ ID NO: 14105 - protein, 168 aa, unidentified
LNEEHWASRELCGGGVEGIPLFYLGYHLEKMAEKAGILYADDTAGWDTRITMADLEDEYTLTELMEGEHKKLAETLFNFAYKNKVALCPRPGKNGGTVLDVISRTDQRGSGQVVTYALNTLTNIKVQLIRMAESEGVLDEEFHDNGMLKWLEKHGRDRLQRLMVSGDD

SEQ ID NO: 14106 - protein, 55 aa, unidentified; identical to SEQ ID NO: 8530

SEQ ID NO: 14107 - protein, 335 aa, unidentified; identical to SEQ ID NO: 8722

SEQ ID NO: 14108 - protein, 335 aa, unidentified; identical to SEQ ID NO: 8722

SEQ ID NO: 14109 - protein, 127 aa, unidentified; identical to SEQ ID NO: 8344

SEQ ID NO: 14110 - protein, 248 aa, unidentified; identical to SEQ ID NO: 8593

SEQ ID NO: 14111 - protein, 258 aa, unidentified; identical to SEQ ID NO: 8309

SEQ ID NO: 14112 - protein, 335 aa, unidentified; identical to SEQ ID NO: 8722

SEQ ID NO: 14113 - protein, 335 aa, unidentified; identical to SEQ ID NO: 8722

SEQ ID NO: 14114 - protein, 174 aa, unidentified; identical to SEQ ID NO: 8195

SEQ ID NO: 14115 - protein, 335 aa, unidentified; identical to SEQ ID NO: 8722

SEQ ID NO: 14116 - protein, 335 aa, unidentified; identical to SEQ ID NO: 8722

SEQ ID NO: 14117 - protein, 258 aa, unidentified; identical to SEQ ID NO: 8309

SEQ ID NO: 14118 - protein, 258 aa, unidentified; identical to SEQ ID NO: 8309

SEQ ID NO: 14119 - protein, 335 aa, unidentified; identical to SEQ ID NO: 8722

SEQ ID NO: 14120 - protein, 335 aa, unidentified; identical to SEQ ID NO: 8722

SEQ ID NO: 14121 - protein, 335 aa, unidentified; identical to SEQ ID NO: 8722

SEQ ID NO: 14122 - protein, 127 aa, unidentified; identical to SEQ ID NO: 8344

SEQ ID NO: 14123 - protein, 337 aa, unidentified; identical to SEQ ID NO: 8339

SEQ ID NO: 14124 - protein, 333 aa, unidentified; identical to SEQ ID NO: 8351

SEQ ID NO: 14125 - protein, 337 aa, unidentified; identical to SEQ ID NO: 8339

SEQ ID NO: 14126 - protein, 337 aa, unidentified; identical to SEQ ID NO: 8339

SEQ ID NO: 14127 - protein, 333 aa, unidentified; identical to SEQ ID NO: 8351

SEQ ID NO: 14128 - protein, 337 aa, unidentified; identical to SEQ ID NO: 8339

SEQ ID NO: 14129 - protein, 337 aa, unidentified; identical to SEQ ID NO: 8339

SEQ ID NO: 14130 - protein, 333 aa, unidentified; identical to SEQ ID NO: 8351

SEQ ID NO: 14131 - protein, 127 aa, unidentified; identical to SEQ ID NO: 8344

SEQ ID NO: 14132 - protein, 337 aa, unidentified; identical to SEQ ID NO: 8339

SEQ ID NO: 14133 - protein, 337 aa, unidentified; identical to SEQ ID NO: 8339

SEQ ID NO: 14134 - protein, 337 aa, unidentified; identical to SEQ ID NO: 8339

SEQ ID NO: 14135 - protein, 337 aa, unidentified; identical to SEQ ID NO: 8339

SEQ ID NO: 14136 - protein, 337 aa, unidentified; identical to SEQ ID NO: 8339

SEQ ID NO: 14137 - protein, 337 aa, unidentified; identical to SEQ ID NO: 8339

SEQ ID NO: 14138 - protein, 337 aa, unidentified; identical to SEQ ID NO: 8339

SEQ ID NO: 14139 - protein, 271 aa, unidentified; identical to SEQ ID NO: 12642

SEQ ID NO: 14140 - protein, 248 aa, unidentified; identical to SEQ ID NO: 8593

SEQ ID NO: 14141 - protein, 337 aa, unidentified; identical to SEQ ID NO: 8339

SEQ ID NO: 14142 - protein, 337 aa, unidentified; identical to SEQ ID NO: 8339

SEQ ID NO: 14143 - protein, 337 aa, unidentified; identical to SEQ ID NO: 8339

SEQ ID NO: 14144 - protein, 337 aa, unidentified; identical to SEQ ID NO: 8339

SEQ ID NO: 14145 - protein, 337 aa, unidentified; identical to SEQ ID NO: 8339

SEQ ID NO: 14146 - protein, 337 aa, unidentified; identical to SEQ ID NO: 8339

SEQ ID NO: 14147 - protein, 337 aa, unidentified; identical to SEQ ID NO: 8339

SEQ ID NO: 14148 - protein, 337 aa, unidentified; identical to SEQ ID NO: 8339

SEQ ID NO: 14149 - protein, 337 aa, unidentified; identical to SEQ ID NO: 8339

SEQ ID NO: 14150 - protein, 337 aa, unidentified; identical to SEQ ID NO: 8339

SEQ ID NO: 14151 - protein, 337 aa, unidentified; identical to SEQ ID NO: 8339

SEQ ID NO: 14152 - protein, 337 aa, unidentified; identical to SEQ ID NO: 8339

SEQ ID NO: 14153 - protein, 337 aa, unidentified; identical to SEQ ID NO: 8339

SEQ ID NO: 14154 - protein, 337 aa, unidentified; identical to SEQ ID NO: 8339

SEQ ID NO: 14155 - protein, 337 aa, unidentified; identical to SEQ ID NO: 8339

SEQ ID NO: 14156 - protein, 244 aa, unidentified; identical to SEQ ID NO: 12697

SEQ ID NO: 14157 - protein, 337 aa, unidentified; identical to SEQ ID NO: 8339

SEQ ID NO: 14158 - protein, 337 aa, unidentified; identical to SEQ ID NO: 8339

SEQ ID NO: 14159 - protein, 337 aa, unidentified; identical to SEQ ID NO: 8339

SEQ ID NO: 14160 - protein, 271 aa, unidentified; identical to SEQ ID NO: 10816

SEQ ID NO: 14161 - protein, 337 aa, unidentified; identical to SEQ ID NO: 8339

SEQ ID NO: 14162 - protein, 337 aa, unidentified; identical to SEQ ID NO: 8339

SEQ ID NO: 14163 - protein, 337 aa, unidentified; identical to SEQ ID NO: 8339

SEQ ID NO: 14164 - protein, 337 aa, unidentified; identical to SEQ ID NO: 8339

SEQ ID NO: 14165 - protein, 337 aa, unidentified; identical to SEQ ID NO: 8339

SEQ ID NO: 14166 - protein, 337 aa, unidentified; identical to SEQ ID NO: 8339

SEQ ID NO: 14167 - protein, 337 aa, unidentified; identical to SEQ ID NO: 8339

SEQ ID NO: 14168 - protein, 337 aa, unidentified; identical to SEQ ID NO: 8339

SEQ ID NO: 14169 - protein, 337 aa, unidentified; identical to SEQ ID NO: 8339

SEQ ID NO: 14170 - protein, 337 aa, unidentified; identical to SEQ ID NO: 8339

SEQ ID NO: 14171 - protein, 337 aa, unidentified; identical to SEQ ID NO: 8339

SEQ ID NO: 14172 - protein, 337 aa, unidentified; identical to SEQ ID NO: 8339

SEQ ID NO: 14173 - protein, 337 aa, unidentified; identical to SEQ ID NO: 8339

SEQ ID NO: 14174 - protein, 337 aa, unidentified; identical to SEQ ID NO: 8339

SEQ ID NO: 14175 - protein, 337 aa, unidentified; identical to SEQ ID NO: 8339

SEQ ID NO: 14176 - protein, 337 aa, unidentified; identical to SEQ ID NO: 8339

SEQ ID NO: 14177 - protein, 337 aa, unidentified; identical to SEQ ID NO: 8339

SEQ ID NO: 14178 - protein, 337 aa, unidentified; identical to SEQ ID NO: 8339

SEQ ID NO: 14179 - protein, 337 aa, unidentified; identical to SEQ ID NO: 8339

SEQ ID NO: 14180 - protein, 337 aa, unidentified; identical to SEQ ID NO: 8339

SEQ ID NO: 14181 - protein, 214 aa, unidentified; identical to SEQ ID NO: 11482

SEQ ID NO: 14182 - protein, 337 aa, unidentified; identical to SEQ ID NO: 8339

SEQ ID NO: 14183 - protein, 337 aa, unidentified; identical to SEQ ID NO: 8339

SEQ ID NO: 14184 - protein, 337 aa, unidentified; identical to SEQ ID NO: 8339

SEQ ID NO: 14185 - protein, 337 aa, unidentified; identical to SEQ ID NO: 8339

SEQ ID NO: 14186 - protein, 217 aa, unidentified; identical to SEQ ID NO: 10987

SEQ ID NO: 14187 - protein, 337 aa, unidentified; identical to SEQ ID NO: 8339

SEQ ID NO: 14188 - protein, 337 aa, unidentified; identical to SEQ ID NO: 8339

SEQ ID NO: 14189 - protein, 337 aa, unidentified; identical to SEQ ID NO: 8339

SEQ ID NO: 14190 - protein, 337 aa, unidentified; identical to SEQ ID NO: 8339

SEQ ID NO: 14191 - protein, 337 aa, unidentified; identical to SEQ ID NO: 8339

SEQ ID NO: 14192 - protein, 337 aa, unidentified; identical to SEQ ID NO: 8339

SEQ ID NO: 14193 - protein, 337 aa, unidentified; identical to SEQ ID NO: 8339

SEQ ID NO: 14194 - protein, 337 aa, unidentified; identical to SEQ ID NO: 8339

SEQ ID NO: 14195 - protein, 244 aa, unidentified; identical to SEQ ID NO: 12697

SEQ ID NO: 14196 - protein, 337 aa, unidentified; identical to SEQ ID NO: 8339

SEQ ID NO: 14197 - protein, 337 aa, unidentified; identical to SEQ ID NO: 8339

SEQ ID NO: 14198 - protein, 337 aa, unidentified; identical to SEQ ID NO: 8339

SEQ ID NO: 14199 - protein, 337 aa, unidentified; identical to SEQ ID NO: 8339

SEQ ID NO: 14200 - protein, 337 aa, unidentified; identical to SEQ ID NO: 8339

SEQ ID NO: 14201 - protein, 337 aa, unidentified; identical to SEQ ID NO: 8339

SEQ ID NO: 14202 - protein, 258 aa, unidentified; identical to SEQ ID NO: 8309

SEQ ID NO: 14203 - protein, 258 aa, unidentified; identical to SEQ ID NO: 8309

SEQ ID NO: 14204 - protein, 258 aa, unidentified; identical to SEQ ID NO: 8309

SEQ ID NO: 14205 - protein, 258 aa, unidentified; identical to SEQ ID NO: 8309

SEQ ID NO: 14206 - protein, 248 aa, unidentified; identical to SEQ ID NO: 8593

SEQ ID NO: 14207 - protein, 258 aa, unidentified; identical to SEQ ID NO: 8309

SEQ ID NO: 14208 - protein, 258 aa, unidentified; identical to SEQ ID NO: 8309

SEQ ID NO: 14209 - protein, 258 aa, unidentified; identical to SEQ ID NO: 8309

SEQ ID NO: 14210 - protein, 333 aa, unidentified; identical to SEQ ID NO: 8351

SEQ ID NO: 14211 - protein, 276 aa, unidentified; identical to SEQ ID NO: 12441

SEQ ID NO: 14212 - protein, 337 aa, unidentified; identical to SEQ ID NO: 8339

SEQ ID NO: 14213 - protein, 337 aa, unidentified; identical to SEQ ID NO: 8339

SEQ ID NO: 14214 - protein, 264 aa, unidentified
DTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCSHHFHELFLRDGRKLIVPCRDQHELVGRSMVSQGGSSGVAGTACLAKAYAQMWLMSYFHRRDLRTLGFGIMSSVPKDWFPTGRTTWSVHANH

SEQ ID NO: 14215 - protein, 276 aa, unidentified; identical to SEQ ID NO: 12441

SEQ ID NO: 14216 - protein, 333 aa, unidentified; identical to SEQ ID NO: 8351

SEQ ID NO: 14217 - protein, 127 aa, unidentified; identical to SEQ ID NO: 8344

SEQ ID NO: 14218 - protein, 248 aa, unidentified; identical to SEQ ID NO: 8593

SEQ ID NO: 14219 - protein, 337 aa, unidentified; identical to SEQ ID NO: 8339

SEQ ID NO: 14220 - protein, 127 aa, unidentified; identical to SEQ ID NO: 8344

SEQ ID NO: 14221 - protein, 337 aa, unidentified; identical to SEQ ID NO: 8339

SEQ ID NO: 14222 - protein, 337 aa, unidentified; identical to SEQ ID NO: 8339

SEQ ID NO: 14223 - protein, 332 aa, unidentified
GVAKGSRTIWYMWLGSRFLEFEALGFLNEERWASRDISGGGVEGIGINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCSHHFHELFLRDGRKLIVPCRDQHELVGRSMVSQGGSSGVAGTACLAKAYAQMWLMSYFHRRDLRTLGFGIMSSVPKDWFPTGRTTWSVHANHE

SEQ ID NO: 14224 - protein, 337 aa, unidentified; identical to SEQ ID NO: 8339

SEQ ID NO: 14225 - protein, 337 aa, unidentified; identical to SEQ ID NO: 8339

SEQ ID NO: 14226 - protein, 337 aa, unidentified; identical to SEQ ID NO: 8339

SEQ ID NO: 14227 - protein, 337 aa, unidentified; identical to SEQ ID NO: 8339

SEQ ID NO: 14228 - protein, 337 aa, unidentified; identical to SEQ ID NO: 8339

SEQ ID NO: 14229 - protein, 337 aa, unidentified; identical to SEQ ID NO: 8339

SEQ ID NO: 14230 - protein, 248 aa, unidentified; identical to SEQ ID NO: 8593

SEQ ID NO: 14231 - protein, 127 aa, unidentified; identical to SEQ ID NO: 8344

SEQ ID NO: 14232 - protein, 127 aa, unidentified; identical to SEQ ID NO: 8344

SEQ ID NO: 14233 - protein, 258 aa, unidentified; identical to SEQ ID NO: 8309

SEQ ID NO: 14234 - protein, 127 aa, unidentified; identical to SEQ ID NO: 8344

SEQ ID NO: 14235 - protein, 127 aa, unidentified; identical to SEQ ID NO: 9935

SEQ ID NO: 14236 - protein, 248 aa, unidentified; identical to SEQ ID NO: 8593

SEQ ID NO: 14237 - protein, 127 aa, unidentified; identical to SEQ ID NO: 8594

SEQ ID NO: 14238 - protein, 127 aa, unidentified; identical to SEQ ID NO: 8344

SEQ ID NO: 14239 - protein, 337 aa, unidentified; identical to SEQ ID NO: 8339

SEQ ID NO: 14240 - protein, 142 aa, unidentified
VLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERF

SEQ ID NO: 14241 - protein, 248 aa, unidentified; identical to SEQ ID NO: 8593

SEQ ID NO: 14242 - protein, 248 aa, unidentified; identical to SEQ ID NO: 8593

SEQ ID NO: 14243 - protein, 127 aa, unidentified; identical to SEQ ID NO: 8344

SEQ ID NO: 14244 - protein, 154 aa, unidentified; identical to SEQ ID NO: 8743

SEQ ID NO: 14245 - protein, 220 aa, unidentified; identical to SEQ ID NO: 9246

SEQ ID NO: 14246 - protein, 127 aa, unidentified; identical to SEQ ID NO: 8594

SEQ ID NO: 14247 - protein, 319 aa, unidentified; identical to SEQ ID NO: 8652

SEQ ID NO: 14248 - protein, 337 aa, unidentified; identical to SEQ ID NO: 8339

SEQ ID NO: 14249 - protein, 266 aa, unidentified; identical to SEQ ID NO: 10749

SEQ ID NO: 14250 - protein, 337 aa, unidentified; identical to SEQ ID NO: 8339

SEQ ID NO: 14251 - protein, 337 aa, unidentified; identical to SEQ ID NO: 8339

SEQ ID NO: 14252 - protein, 256 aa, unidentified
KPGEFGVAKGSRTIWYMWLGSRFLEFEALGFLNEERWASRDISGGGVEGIGINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCSHHFHELFLRDG

SEQ ID NO: 14253 - protein, 337 aa, unidentified; identical to SEQ ID NO: 8339

SEQ ID NO: 14254 - protein, 337 aa, unidentified; identical to SEQ ID NO: 8339

SEQ ID NO: 14255 - protein, 174 aa, unidentified; identical to SEQ ID NO: 8195

SEQ ID NO: 14256 - protein, 127 aa, unidentified; identical to SEQ ID NO: 8344

SEQ ID NO: 14257 - protein, 337 aa, unidentified; identical to SEQ ID NO: 8339

SEQ ID NO: 14258 - protein, 337 aa, unidentified; identical to SEQ ID NO: 8339

SEQ ID NO: 14259 - protein, 337 aa, unidentified; identical to SEQ ID NO: 8339

SEQ ID NO: 14260 - protein, 127 aa, unidentified; identical to SEQ ID NO: 8344

SEQ ID NO: 14261 - protein, 337 aa, unidentified; identical to SEQ ID NO: 8339

SEQ ID NO: 14262 - protein, 174 aa, unidentified; identical to SEQ ID NO: 8195

SEQ ID NO: 14263 - protein, 337 aa, unidentified; identical to SEQ ID NO: 8339

SEQ ID NO: 14264 - protein, 337 aa, unidentified; identical to SEQ ID NO: 8339

SEQ ID NO: 14265 - protein, 258 aa, unidentified; identical to SEQ ID NO: 8309

SEQ ID NO: 14266 - protein, 258 aa, unidentified; identical to SEQ ID NO: 8309

SEQ ID NO: 14267 - protein, 127 aa, unidentified; identical to SEQ ID NO: 8344

SEQ ID NO: 14268 - protein, 229 aa, unidentified; identical to SEQ ID NO: 8171

SEQ ID NO: 14269 - protein, 333 aa, unidentified; identical to SEQ ID NO: 8351

SEQ ID NO: 14270 - protein, 337 aa, unidentified; identical to SEQ ID NO: 8339

SEQ ID NO: 14271 - protein, 258 aa, unidentified; identical to SEQ ID NO: 8309

SEQ ID NO: 14272 - protein, 333 aa, unidentified; identical to SEQ ID NO: 8351

SEQ ID NO: 14273 - protein, 278 aa, unidentified
HLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCSHHFHELFLRDGRKLIVPCRDQHELVGRSMVSQGGSSGVAGTACLAKAYAQMWLMSYFHRRDLRTLGFGIMSSVPKDWFPTGRTTWSVHAN

SEQ ID NO: 14274 - protein, 335 aa, unidentified; identical to SEQ ID NO: 8722

SEQ ID NO: 14275 - protein, 337 aa, unidentified; identical to SEQ ID NO: 8339

SEQ ID NO: 14276 - protein, 337 aa, unidentified; identical to SEQ ID NO: 8339

SEQ ID NO: 14277 - protein, 164 aa, unidentified
HWASRELCGGGVEGIPLFYLGYHLEKMAEKAGILYADDTAGWDTRITMADLEDEYTLTELMEGEHKKLAETLFNFAYKNKVALCPRPGKNGGTVLDVISRTDQRGSGQVVTYALNTLTNIKVQLIRMAESEGVLDEEFHDNGMLKWLEKHGRDRLQRLMVSGDD

SEQ ID NO: 14278 - protein, 306 aa, unidentified; identical to SEQ ID NO: 10939

SEQ ID NO: 14279 - protein, 337 aa, unidentified; identical to SEQ ID NO: 8339

SEQ ID NO: 14280 - protein, 337 aa, unidentified; identical to SEQ ID NO: 8339

SEQ ID NO: 14281 - protein, 337 aa, unidentified; identical to SEQ ID NO: 8339

SEQ ID NO: 14282 - protein, 127 aa, unidentified; identical to SEQ ID NO: 8344

SEQ ID NO: 14283 - protein, 333 aa, unidentified; identical to SEQ ID NO: 8351

SEQ ID NO: 14284 - protein, 337 aa, unidentified; identical to SEQ ID NO: 8339

SEQ ID NO: 14285 - protein, 337 aa, unidentified; identical to SEQ ID NO: 8339

SEQ ID NO: 14286 - protein, 337 aa, unidentified; identical to SEQ ID NO: 8339

SEQ ID NO: 14287 - protein, 258 aa, unidentified; identical to SEQ ID NO: 8309

SEQ ID NO: 14288 - protein, 258 aa, unidentified; identical to SEQ ID NO: 8309

SEQ ID NO: 14289 - protein, 127 aa, unidentified; identical to SEQ ID NO: 8594

SEQ ID NO: 14290 - protein, 248 aa, unidentified; identical to SEQ ID NO: 8593

SEQ ID NO: 14291 - protein, 127 aa, unidentified; identical to SEQ ID NO: 8594

SEQ ID NO: 14292 - protein, 337 aa, unidentified; identical to SEQ ID NO: 8339

SEQ ID NO: 14293 - protein, 337 aa, unidentified; identical to SEQ ID NO: 8339

SEQ ID NO: 14294 - protein, 337 aa, unidentified; identical to SEQ ID NO: 8339

SEQ ID NO: 14295 - protein, 297 aa, unidentified
KPGEFGVAKGSRTIWYMWLGSRFLEFEALGFLNEERWASRDISGGGVEGIGINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCSHHFHELFLRDGRKLIVPCRDQHELVGRSMVSQGGSSGVAGTACLAKAYAQMW

SEQ ID NO: 14296 - protein, 337 aa, unidentified; identical to SEQ ID NO: 8339

SEQ ID NO: 14297 - protein, 337 aa, unidentified; identical to SEQ ID NO: 8339

SEQ ID NO: 14298 - protein, 337 aa, unidentified; identical to SEQ ID NO: 8339

SEQ ID NO: 14299 - protein, 258 aa, unidentified; identical to SEQ ID NO: 8309

SEQ ID NO: 14300 - protein, 333 aa, unidentified; identical to SEQ ID NO: 8351

SEQ ID NO: 14301 - protein, 335 aa, unidentified; identical to SEQ ID NO: 8722

SEQ ID NO: 14302 - protein, 337 aa, unidentified; identical to SEQ ID NO: 8339

SEQ ID NO: 14303 - protein, 337 aa, unidentified; identical to SEQ ID NO: 8339

SEQ ID NO: 14304 - protein, 337 aa, unidentified; identical to SEQ ID NO: 8339

SEQ ID NO: 14305 - protein, 337 aa, unidentified; identical to SEQ ID NO: 8339

SEQ ID NO: 14306 - protein, 337 aa, unidentified; identical to SEQ ID NO: 8339

SEQ ID NO: 14307 - protein, 337 aa, unidentified; identical to SEQ ID NO: 8339

SEQ ID NO: 14308 - protein, 337 aa, unidentified; identical to SEQ ID NO: 8339

SEQ ID NO: 14309 - protein, 337 aa, unidentified; identical to SEQ ID NO: 8339

SEQ ID NO: 14310 - protein, 223 aa, unidentified; identical to SEQ ID NO: 12108

SEQ ID NO: 14311 - protein, 337 aa, unidentified; identical to SEQ ID NO: 8339

SEQ ID NO: 14312 - protein, 337 aa, unidentified; identical to SEQ ID NO: 8339

SEQ ID NO: 14313 - protein, 337 aa, unidentified; identical to SEQ ID NO: 8339

SEQ ID NO: 14314 - protein, 337 aa, unidentified; identical to SEQ ID NO: 8339

SEQ ID NO: 14315 - protein, 337 aa, unidentified; identical to SEQ ID NO: 8339

SEQ ID NO: 14316 - protein, 216 aa, unidentified; identical to SEQ ID NO: 12608

SEQ ID NO: 14317 - protein, 337 aa, unidentified; identical to SEQ ID NO: 8339

SEQ ID NO: 14318 - protein, 337 aa, unidentified; identical to SEQ ID NO: 8339

SEQ ID NO: 14319 - protein, 337 aa, unidentified; identical to SEQ ID NO: 8339

SEQ ID NO: 14320 - protein, 337 aa, unidentified; identical to SEQ ID NO: 8339

SEQ ID NO: 14321 - protein, 337 aa, unidentified; identical to SEQ ID NO: 8339

SEQ ID NO: 14322 - protein, 337 aa, unidentified; identical to SEQ ID NO: 8339

SEQ ID NO: 14323 - protein, 337 aa, unidentified; identical to SEQ ID NO: 8339

SEQ ID NO: 14324 - protein, 337 aa, unidentified; identical to SEQ ID NO: 8339

SEQ ID NO: 14325 - protein, 337 aa, unidentified; identical to SEQ ID NO: 8339

SEQ ID NO: 14326 - protein, 337 aa, unidentified; identical to SEQ ID NO: 8339

SEQ ID NO: 14327 - protein, 303 aa, unidentified; identical to SEQ ID NO: 9990

SEQ ID NO: 14328 - protein, 337 aa, unidentified; identical to SEQ ID NO: 8339

SEQ ID NO: 14329 - protein, 243 aa, unidentified; identical to SEQ ID NO: 8643

SEQ ID NO: 14330 - protein, 337 aa, unidentified; identical to SEQ ID NO: 8339

SEQ ID NO: 14331 - protein, 337 aa, unidentified; identical to SEQ ID NO: 8339

SEQ ID NO: 14332 - protein, 337 aa, unidentified; identical to SEQ ID NO: 8339

SEQ ID NO: 14333 - protein, 337 aa, unidentified; identical to SEQ ID NO: 8339

SEQ ID NO: 14334 - protein, 229 aa, unidentified; identical to SEQ ID NO: 8171

SEQ ID NO: 14335 - protein, 337 aa, unidentified; identical to SEQ ID NO: 8339

SEQ ID NO: 14336 - protein, 337 aa, unidentified; identical to SEQ ID NO: 8339

SEQ ID NO: 14337 - protein, 337 aa, unidentified; identical to SEQ ID NO: 8339

SEQ ID NO: 14338 - protein, 337 aa, unidentified; identical to SEQ ID NO: 8339

SEQ ID NO: 14339 - protein, 337 aa, unidentified; identical to SEQ ID NO: 8339

SEQ ID NO: 14340 - protein, 337 aa, unidentified; identical to SEQ ID NO: 8339

SEQ ID NO: 14341 - protein, 337 aa, unidentified; identical to SEQ ID NO: 8339

SEQ ID NO: 14342 - protein, 337 aa, unidentified; identical to SEQ ID NO: 8339

SEQ ID NO: 14343 - protein, 337 aa, unidentified; identical to SEQ ID NO: 8339

SEQ ID NO: 14344 - protein, 337 aa, unidentified; identical to SEQ ID NO: 8339

SEQ ID NO: 14345 - protein, 223 aa, unidentified; identical to SEQ ID NO: 12108

SEQ ID NO: 14346 - protein, 337 aa, unidentified; identical to SEQ ID NO: 8339

SEQ ID NO: 14347 - protein, 337 aa, unidentified; identical to SEQ ID NO: 8339

SEQ ID NO: 14348 - protein, 337 aa, unidentified; identical to SEQ ID NO: 8339

SEQ ID NO: 14349 - protein, 337 aa, unidentified; identical to SEQ ID NO: 8339

SEQ ID NO: 14350 - protein, 337 aa, unidentified; identical to SEQ ID NO: 8339

SEQ ID NO: 14351 - protein, 337 aa, unidentified; identical to SEQ ID NO: 8339

SEQ ID NO: 14352 - protein, 337 aa, unidentified; identical to SEQ ID NO: 8339

SEQ ID NO: 14353 - protein, 248 aa, unidentified; identical to SEQ ID NO: 8593

SEQ ID NO: 14354 - protein, 337 aa, unidentified; identical to SEQ ID NO: 8339

SEQ ID NO: 14355 - protein, 337 aa, unidentified; identical to SEQ ID NO: 8339

SEQ ID NO: 14356 - protein, 217 aa, unidentified; identical to SEQ ID NO: 10987

SEQ ID NO: 14357 - protein, 337 aa, unidentified; identical to SEQ ID NO: 8339

SEQ ID NO: 14358 - protein, 337 aa, unidentified; identical to SEQ ID NO: 8339

SEQ ID NO: 14359 - protein, 337 aa, unidentified; identical to SEQ ID NO: 8339

SEQ ID NO: 14360 - protein, 337 aa, unidentified; identical to SEQ ID NO: 8339

SEQ ID NO: 14361 - protein, 337 aa, unidentified; identical to SEQ ID NO: 8339

SEQ ID NO: 14362 - protein, 337 aa, unidentified; identical to SEQ ID NO: 8339

SEQ ID NO: 14363 - protein, 337 aa, unidentified; identical to SEQ ID NO: 8339

SEQ ID NO: 14364 - protein, 227 aa, unidentified; identical to SEQ ID NO: 9886

SEQ ID NO: 14365 - protein, 337 aa, unidentified; identical to SEQ ID NO: 8339

SEQ ID NO: 14366 - protein, 337 aa, unidentified; identical to SEQ ID NO: 8339

SEQ ID NO: 14367 - protein, 337 aa, unidentified; identical to SEQ ID NO: 8339

SEQ ID NO: 14368 - protein, 337 aa, unidentified; identical to SEQ ID NO: 8339

SEQ ID NO: 14369 - protein, 258 aa, unidentified; identical to SEQ ID NO: 8309

SEQ ID NO: 14370 - protein, 337 aa, unidentified; identical to SEQ ID NO: 8339

SEQ ID NO: 14371 - protein, 242 aa, unidentified
EKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCSHHFHELFLRDGRKLIVPCRDQHELVGRSMVSQGGSSGVAGTACLAKAYAQMWLMSY

SEQ ID NO: 14372 - protein, 337 aa, unidentified; identical to SEQ ID NO: 8339

SEQ ID NO: 14373 - protein, 229 aa, unidentified; identical to SEQ ID NO: 8171

SEQ ID NO: 14374 - protein, 250 aa, unidentified; identical to SEQ ID NO: 11752

SEQ ID NO: 14375 - protein, 248 aa, unidentified; identical to SEQ ID NO: 8593

SEQ ID NO: 14376 - protein, 138 aa, unidentified
LYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALD

SEQ ID NO: 14377 - protein, 217 aa, unidentified; identical to SEQ ID NO: 10987

SEQ ID NO: 14378 - protein, 154 aa, unidentified; identical to SEQ ID NO: 8743

SEQ ID NO: 14379 - protein, 174 aa, unidentified; identical to SEQ ID NO: 8195

SEQ ID NO: 14380 - protein, 337 aa, unidentified; identical to SEQ ID NO: 8339

SEQ ID NO: 14381 - protein, 258 aa, unidentified; identical to SEQ ID NO: 8309

SEQ ID NO: 14382 - protein, 248 aa, unidentified; identical to SEQ ID NO: 8593

SEQ ID NO: 14383 - protein, 127 aa, unidentified; identical to SEQ ID NO: 8594

SEQ ID NO: 14384 - protein, 337 aa, unidentified; identical to SEQ ID NO: 8339

SEQ ID NO: 14385 - protein, 127 aa, unidentified; identical to SEQ ID NO: 8594

SEQ ID NO: 14386 - protein, 337 aa, unidentified; identical to SEQ ID NO: 8339

SEQ ID NO: 14387 - protein, 337 aa, unidentified; identical to SEQ ID NO: 8339

SEQ ID NO: 14388 - protein, 200 aa, unidentified
FLNEERWASRDISGGGVEGIGINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWK

SEQ ID NO: 14389 - protein, 337 aa, unidentified; identical to SEQ ID NO: 8339

SEQ ID NO: 14390 - protein, 337 aa, unidentified; identical to SEQ ID NO: 8339

SEQ ID NO: 14391 - protein, 337 aa, unidentified; identical to SEQ ID NO: 8339

SEQ ID NO: 14392 - protein, 337 aa, unidentified; identical to SEQ ID NO: 8339

SEQ ID NO: 14393 - protein, 337 aa, unidentified; identical to SEQ ID NO: 8339

SEQ ID NO: 14394 - protein, 337 aa, unidentified; identical to SEQ ID NO: 8339

SEQ ID NO: 14395 - protein, 337 aa, unidentified; identical to SEQ ID NO: 8339

SEQ ID NO: 14396 - protein, 174 aa, unidentified; identical to SEQ ID NO: 8195

SEQ ID NO: 14397 - protein, 337 aa, unidentified; identical to SEQ ID NO: 8339

SEQ ID NO: 14398 - protein, 337 aa, unidentified; identical to SEQ ID NO: 8339

SEQ ID NO: 14399 - protein, 127 aa, unidentified; identical to SEQ ID NO: 8344

SEQ ID NO: 14400 - protein, 337 aa, unidentified; identical to SEQ ID NO: 8339

SEQ ID NO: 14401 - protein, 174 aa, unidentified; identical to SEQ ID NO: 8195

SEQ ID NO: 14402 - protein, 258 aa, unidentified; identical to SEQ ID NO: 8309

SEQ ID NO: 14403 - protein, 255 aa, unidentified; identical to SEQ ID NO: 9520

SEQ ID NO: 14404 - protein, 248 aa, unidentified; identical to SEQ ID NO: 8593

SEQ ID NO: 14405 - protein, 248 aa, unidentified; identical to SEQ ID NO: 8593

SEQ ID NO: 14406 - protein, 127 aa, unidentified; identical to SEQ ID NO: 8344

SEQ ID NO: 14407 - protein, 154 aa, unidentified; identical to SEQ ID NO: 8743

SEQ ID NO: 14408 - protein, 337 aa, unidentified; identical to SEQ ID NO: 8339

SEQ ID NO: 14409 - protein, 258 aa, unidentified; identical to SEQ ID NO: 8309

SEQ ID NO: 14410 - protein, 154 aa, unidentified; identical to SEQ ID NO: 8743

SEQ ID NO: 14411 - protein, 337 aa, unidentified; identical to SEQ ID NO: 8339

SEQ ID NO: 14412 - protein, 337 aa, unidentified; identical to SEQ ID NO: 8339

SEQ ID NO: 14413 - protein, 264 aa, unidentified; identical to SEQ ID NO: 11150

SEQ ID NO: 14414 - protein, 286 aa, unidentified
IGINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCSHHFHELFLRDGRKLIVPCRDQHELVGRSMVSQGGSSGVAGTACLAKAYAQMWLMSYFHRRDLRTLGFGIMSSVPKDWFPTGRTTWSVHAN

SEQ ID NO: 14415 - protein, 258 aa, unidentified; identical to SEQ ID NO: 8309

SEQ ID NO: 14416 - protein, 248 aa, unidentified; identical to SEQ ID NO: 8593

SEQ ID NO: 14417 - protein, 258 aa, unidentified; identical to SEQ ID NO: 8309

SEQ ID NO: 14418 - protein, 258 aa, unidentified; identical to SEQ ID NO: 8309

SEQ ID NO: 14419 - protein, 248 aa, unidentified; identical to SEQ ID NO: 8593

SEQ ID NO: 14420 - protein, 258 aa, unidentified; identical to SEQ ID NO: 8309

SEQ ID NO: 14421 - protein, 258 aa, unidentified; identical to SEQ ID NO: 8309

SEQ ID NO: 14422 - protein, 335 aa, unidentified; identical to SEQ ID NO: 8722

SEQ ID NO: 14423 - protein, 248 aa, unidentified; identical to SEQ ID NO: 8593

SEQ ID NO: 14424 - protein, 174 aa, unidentified; identical to SEQ ID NO: 8195

SEQ ID NO: 14425 - protein, 127 aa, unidentified; identical to SEQ ID NO: 8594

SEQ ID NO: 14426 - protein, 335 aa, unidentified; identical to SEQ ID NO: 8722

SEQ ID NO: 14427 - protein, 335 aa, unidentified; identical to SEQ ID NO: 8722

SEQ ID NO: 14428 - protein, 337 aa, unidentified; identical to SEQ ID NO: 8339

SEQ ID NO: 14429 - protein, 337 aa, unidentified; identical to SEQ ID NO: 8339

SEQ ID NO: 14430 - protein, 337 aa, unidentified; identical to SEQ ID NO: 8339

SEQ ID NO: 14431 - protein, 335 aa, unidentified; identical to SEQ ID NO: 8722

SEQ ID NO: 14432 - protein, 337 aa, unidentified; identical to SEQ ID NO: 8339

SEQ ID NO: 14433 - protein, 227 aa, unidentified; identical to SEQ ID NO: 9886

SEQ ID NO: 14434 - protein, 159 aa, unidentified; identical to SEQ ID NO: 12966

SEQ ID NO: 14435 - protein, 337 aa, unidentified; identical to SEQ ID NO: 8339

SEQ ID NO: 14436 - protein, 333 aa, unidentified; identical to SEQ ID NO: 8351

SEQ ID NO: 14437 - protein, 337 aa, unidentified; identical to SEQ ID NO: 8339

SEQ ID NO: 14438 - protein, 337 aa, unidentified; identical to SEQ ID NO: 8339

SEQ ID NO: 14439 - protein, 337 aa, unidentified; identical to SEQ ID NO: 8339

SEQ ID NO: 14440 - protein, 337 aa, unidentified; identical to SEQ ID NO: 8339

SEQ ID NO: 14441 - protein, 205 aa, unidentified; identical to SEQ ID NO: 11753

SEQ ID NO: 14442 - protein, 196 aa, unidentified
LGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCSHHFHE

SEQ ID NO: 14443 - protein, 337 aa, unidentified; identical to SEQ ID NO: 8339

SEQ ID NO: 14444 - protein, 337 aa, unidentified; identical to SEQ ID NO: 8339

SEQ ID NO: 14445 - protein, 337 aa, unidentified; identical to SEQ ID NO: 8339

SEQ ID NO: 14446 - protein, 337 aa, unidentified; identical to SEQ ID NO: 8339

SEQ ID NO: 14447 - protein, 337 aa, unidentified; identical to SEQ ID NO: 8339

SEQ ID NO: 14448 - protein, 308 aa, unidentified; identical to SEQ ID NO: 11001

SEQ ID NO: 14449 - protein, 337 aa, unidentified; identical to SEQ ID NO: 8339

SEQ ID NO: 14450 - protein, 337 aa, unidentified; identical to SEQ ID NO: 8339

SEQ ID NO: 14451 - protein, 337 aa, unidentified; identical to SEQ ID NO: 8339

SEQ ID NO: 14452 - protein, 337 aa, unidentified; identical to SEQ ID NO: 8339

SEQ ID NO: 14453 - protein, 337 aa, unidentified; identical to SEQ ID NO: 8339

SEQ ID NO: 14454 - protein, 216 aa, unidentified; identical to SEQ ID NO: 12608

SEQ ID NO: 14455 - protein, 337 aa, unidentified; identical to SEQ ID NO: 8339

SEQ ID NO: 14456 - protein, 337 aa, unidentified; identical to SEQ ID NO: 8339

SEQ ID NO: 14457 - protein, 337 aa, unidentified; identical to SEQ ID NO: 8339

SEQ ID NO: 14458 - protein, 337 aa, unidentified; identical to SEQ ID NO: 8339

SEQ ID NO: 14459 - protein, 337 aa, unidentified; identical to SEQ ID NO: 8339

SEQ ID NO: 14460 - protein, 209 aa, unidentified; identical to SEQ ID NO: 9505

SEQ ID NO: 14461 - protein, 337 aa, unidentified; identical to SEQ ID NO: 8339

SEQ ID NO: 14462 - protein, 337 aa, unidentified; identical to SEQ ID NO: 8339

SEQ ID NO: 14463 - protein, 337 aa, unidentified; identical to SEQ ID NO: 8339

SEQ ID NO: 14464 - protein, 258 aa, unidentified; identical to SEQ ID NO: 8309

SEQ ID NO: 14465 - protein, 337 aa, unidentified; identical to SEQ ID NO: 8339

SEQ ID NO: 14466 - protein, 337 aa, unidentified; identical to SEQ ID NO: 8339

SEQ ID NO: 14467 - protein, 265 aa, unidentified; identical to SEQ ID NO: 12423

SEQ ID NO: 14468 - protein, 337 aa, unidentified; identical to SEQ ID NO: 8339

SEQ ID NO: 14469 - protein, 127 aa, unidentified; identical to SEQ ID NO: 8344

SEQ ID NO: 14470 - protein, 337 aa, unidentified; identical to SEQ ID NO: 8339

SEQ ID NO: 14471 - protein, 217 aa, unidentified; identical to SEQ ID NO: 10987

SEQ ID NO: 14472 - protein, 260 aa, unidentified
KPGEFGVAKGSRTIWYMWLGSRFLEFEALGFLNEERWASRDISGGGVEGIGINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCSHHFHELFLRDGRKLI

SEQ ID NO: 14473 - protein, 337 aa, unidentified; identical to SEQ ID NO: 8339

SEQ ID NO: 14474 - protein, 337 aa, unidentified; identical to SEQ ID NO: 8339

SEQ ID NO: 14475 - protein, 227 aa, unidentified; identical to SEQ ID NO: 9886

SEQ ID NO: 14476 - protein, 337 aa, unidentified; identical to SEQ ID NO: 8339

SEQ ID NO: 14477 - protein, 337 aa, unidentified; identical to SEQ ID NO: 8339

SEQ ID NO: 14478 - protein, 337 aa, unidentified; identical to SEQ ID NO: 8339

SEQ ID NO: 14479 - protein, 227 aa, unidentified; identical to SEQ ID NO: 9886

SEQ ID NO: 14480 - protein, 337 aa, unidentified; identical to SEQ ID NO: 8339

SEQ ID NO: 14481 - protein, 337 aa, unidentified; identical to SEQ ID NO: 8339

SEQ ID NO: 14482 - protein, 337 aa, unidentified; identical to SEQ ID NO: 8339

SEQ ID NO: 14483 - protein, 337 aa, unidentified; identical to SEQ ID NO: 8339

SEQ ID NO: 14484 - protein, 337 aa, unidentified; identical to SEQ ID NO: 8339

SEQ ID NO: 14485 - protein, 284 aa, unidentified
YLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCSHHFHELFLRDGRKLIVPCRDQHELVGRSMVSQGGSSGVAGTACLAKAYAQMWLMSYFHRRDLRTLGFGIMSSVPKDWFPTGRTTWSVHANHE

SEQ ID NO: 14486 - protein, 266 aa, unidentified
DDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCSHHFHELFLRDGRKLIVPCRDQHELVGRSMVSQGGSSGVAGTACLAKAYAQMWLMSYFHRRDLRTLGFGIMSSVPKDWFPTGRTTWSVHANHE

SEQ ID NO: 14487 - protein, 258 aa, unidentified; identical to SEQ ID NO: 8309

SEQ ID NO: 14488 - protein, 337 aa, unidentified; identical to SEQ ID NO: 8339

SEQ ID NO: 14489 - protein, 248 aa, unidentified; identical to SEQ ID NO: 8593

SEQ ID NO: 14490 - protein, 127 aa, unidentified; identical to SEQ ID NO: 8344

SEQ ID NO: 14491 - protein, 271 aa, unidentified; identical to SEQ ID NO: 12642

SEQ ID NO: 14492 - protein, 322 aa, unidentified
RTIWYMWLGSRFLEFESFGFLNEEHWASRELCGGGVEGIPLFYLGYHLEKMAEKAGILYADDTAGWDTRITMADLEDEYTLTELMEGEHKKLAETLFNFAYKNKVALCPRPGKNGGTVLDVISRTDQRGSGQVVTYALNTLTNIKVQLIRMAESEGVLDEEFHDNGMLKWLEKHGRDRLQRLMVSGDDCVVNAIDERFGKSLVWLNEMQKIRKDIDLWKPSAGHCNWEEVEFCSNHFHKLVMRDGRTLVVPCRHEVELVGRASVNQGGSTGISGTACLAKAYAQMWLLLYFHRRDLRILGMAICSAVPANWVPTGRTTWSLH

SEQ ID NO: 14493 - protein, 248 aa, unidentified
LGSRFLEFEALGFLNEERWASRDISGGGVEGIGINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCSHHFHELFLRDGRKLIVPCRDQ

SEQ ID NO: 14494 - protein, 250 aa, unidentified; identical to SEQ ID NO: 11752

SEQ ID NO: 14495 - protein, 337 aa, unidentified; identical to SEQ ID NO: 8339

SEQ ID NO: 14496 - protein, 254 aa, unidentified
KPGEFGVAKGSRTIWYMWLGSRFLEFEALGFLNEERWASRDISGGGVEGIGINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCSHHFHELFLR

SEQ ID NO: 14497 - protein, 275 aa, unidentified; identical to SEQ ID NO: 11524

SEQ ID NO: 14498 - protein, 337 aa, unidentified; identical to SEQ ID NO: 8339

SEQ ID NO: 14499 - protein, 337 aa, unidentified; identical to SEQ ID NO: 8339

SEQ ID NO: 14500 - protein, 127 aa, unidentified; identical to SEQ ID NO: 8344

SEQ ID NO: 14501 - protein, 127 aa, unidentified; identical to SEQ ID NO: 8344

SEQ ID NO: 14502 - protein, 337 aa, unidentified; identical to SEQ ID NO: 8339

SEQ ID NO: 14503 - protein, 337 aa, unidentified; identical to SEQ ID NO: 8339

SEQ ID NO: 14504 - protein, 258 aa, unidentified; identical to SEQ ID NO: 8309

SEQ ID NO: 14505 - protein, 258 aa, unidentified; identical to SEQ ID NO: 8309

SEQ ID NO: 14506 - protein, 174 aa, unidentified; identical to SEQ ID NO: 8195

SEQ ID NO: 14507 - protein, 174 aa, unidentified; identical to SEQ ID NO: 8195

SEQ ID NO: 14508 - protein, 154 aa, unidentified; identical to SEQ ID NO: 8743

SEQ ID NO: 14509 - protein, 154 aa, unidentified; identical to SEQ ID NO: 8743

SEQ ID NO: 14510 - protein, 127 aa, unidentified; identical to SEQ ID NO: 8344

SEQ ID NO: 14511 - protein, 127 aa, unidentified; identical to SEQ ID NO: 8344

SEQ ID NO: 14512 - protein, 258 aa, unidentified; identical to SEQ ID NO: 8309

SEQ ID NO: 14513 - protein, 134 aa, unidentified
DTAGWDTRITEADLDDECILCDYMEDEHKQLALSLFELCYKNKVALCPRPGRHGGTVMDVIFRRDQRGSGQVVTYALNTLTNIKVQLIRLAESEGVLDEDFNDHGIETWLNHYGEERLSRLLISGDDCLVNAFD

SEQ ID NO: 14514 - protein, 248 aa, unidentified; identical to SEQ ID NO: 8593

SEQ ID NO: 14515 - protein, 337 aa, unidentified; identical to SEQ ID NO: 8339

SEQ ID NO: 14516 - protein, 258 aa, unidentified; identical to SEQ ID NO: 8309

SEQ ID NO: 14517 - protein, 337 aa, unidentified; identical to SEQ ID NO: 8339

SEQ ID NO: 14518 - protein, 337 aa, unidentified; identical to SEQ ID NO: 8339

SEQ ID NO: 14519 - protein, 246 aa, unidentified; identical to SEQ ID NO: 11888

SEQ ID NO: 14520 - protein, 245 aa, unidentified; identical to SEQ ID NO: 9193

SEQ ID NO: 14521 - protein, 173 aa, unidentified; identical to SEQ ID NO: 9679

SEQ ID NO: 14522 - protein, 337 aa, unidentified; identical to SEQ ID NO: 8339

SEQ ID NO: 14523 - protein, 337 aa, unidentified; identical to SEQ ID NO: 8339

SEQ ID NO: 14524 - protein, 337 aa, unidentified; identical to SEQ ID NO: 8339

SEQ ID NO: 14525 - protein, 337 aa, unidentified; identical to SEQ ID NO: 8339

SEQ ID NO: 14526 - protein, 258 aa, unidentified; identical to SEQ ID NO: 8309

SEQ ID NO: 14527 - protein, 337 aa, unidentified; identical to SEQ ID NO: 8339

SEQ ID NO: 14528 - protein, 174 aa, unidentified; identical to SEQ ID NO: 8195

SEQ ID NO: 14529 - protein, 337 aa, unidentified; identical to SEQ ID NO: 8339

SEQ ID NO: 14530 - protein, 337 aa, unidentified; identical to SEQ ID NO: 8339

SEQ ID NO: 14531 - protein, 258 aa, unidentified; identical to SEQ ID NO: 8309

SEQ ID NO: 14532 - protein, 337 aa, unidentified; identical to SEQ ID NO: 8339

SEQ ID NO: 14533 - protein, 258 aa, unidentified; identical to SEQ ID NO: 8309

SEQ ID NO: 14534 - protein, 258 aa, unidentified; identical to SEQ ID NO: 8309

SEQ ID NO: 14535 - protein, 258 aa, unidentified; identical to SEQ ID NO: 8309

SEQ ID NO: 14536 - protein, 248 aa, unidentified; identical to SEQ ID NO: 8593

SEQ ID NO: 14537 - protein, 214 aa, unidentified; identical to SEQ ID NO: 9674

SEQ ID NO: 14538 - protein, 174 aa, unidentified; identical to SEQ ID NO: 8195

SEQ ID NO: 14539 - protein, 258 aa, unidentified; identical to SEQ ID NO: 8309

SEQ ID NO: 14540 - protein, 258 aa, unidentified; identical to SEQ ID NO: 8309

SEQ ID NO: 14541 - protein, 335 aa, unidentified; identical to SEQ ID NO: 8722

SEQ ID NO: 14542 - protein, 335 aa, unidentified; identical to SEQ ID NO: 8722

SEQ ID NO: 14543 - protein, 335 aa, unidentified; identical to SEQ ID NO: 8722

SEQ ID NO: 14544 - protein, 297 aa, unidentified; identical to SEQ ID NO: 8720

SEQ ID NO: 14545 - protein, 127 aa, unidentified; identical to SEQ ID NO: 8344

SEQ ID NO: 14546 - protein, 300 aa, unidentified
KPGEFGVAKGSRTIWYMWLGSRFLEFEALGFLNEERWASRDISGGGVEGIGINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCSHHFHELFLRDGRKLIVPCRDQHELVGRSMVSQGGSSGVAGTACLAKAYAQMWLMS

SEQ ID NO: 14547 - protein, 335 aa, unidentified; identical to SEQ ID NO: 8722

SEQ ID NO: 14548 - protein, 335 aa, unidentified; identical to SEQ ID NO: 8722

SEQ ID NO: 14549 - protein, 335 aa, unidentified; identical to SEQ ID NO: 8722

SEQ ID NO: 14550 - protein, 337 aa, unidentified; identical to SEQ ID NO: 8339

SEQ ID NO: 14551 - protein, 238 aa, unidentified; identical to SEQ ID NO: 9388

SEQ ID NO: 14552 - protein, 333 aa, unidentified; identical to SEQ ID NO: 8351

SEQ ID NO: 14553 - protein, 337 aa, unidentified; identical to SEQ ID NO: 8339

SEQ ID NO: 14554 - protein, 258 aa, unidentified; identical to SEQ ID NO: 8309

SEQ ID NO: 14555 - protein, 333 aa, unidentified; identical to SEQ ID NO: 8351

SEQ ID NO: 14556 - protein, 337 aa, unidentified; identical to SEQ ID NO: 8339

SEQ ID NO: 14557 - protein, 337 aa, unidentified; identical to SEQ ID NO: 8339

SEQ ID NO: 14558 - protein, 337 aa, unidentified; identical to SEQ ID NO: 8339

SEQ ID NO: 14559 - protein, 317 aa, unidentified
SRFLEFEALGFLNEERWASRDISGGGVEGIGINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCSHHFHELFLRDGRKLIVPCRDQHELVGRSMVSQGGSSGVAGTACLAKAYAQMWLMSYFHRRDLRTLGFGIMSSVPKDWFPTGRTTWSVHANHE

SEQ ID NO: 14560 - protein, 337 aa, unidentified; identical to SEQ ID NO: 8339

SEQ ID NO: 14561 - protein, 337 aa, unidentified; identical to SEQ ID NO: 8339

SEQ ID NO: 14562 - protein, 337 aa, unidentified; identical to SEQ ID NO: 8339

SEQ ID NO: 14563 - protein, 337 aa, unidentified; identical to SEQ ID NO: 8339

SEQ ID NO: 14564 - protein, 262 aa, unidentified; identical to SEQ ID NO: 9207

SEQ ID NO: 14565 - protein, 337 aa, unidentified; identical to SEQ ID NO: 8339

SEQ ID NO: 14566 - protein, 337 aa, unidentified; identical to SEQ ID NO: 8339

SEQ ID NO: 14567 - protein, 290 aa, unidentified
EGIGINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCSHHFHELFLRDGRKLIVPCRDQHELVGRSMVSQGGSSGVAGTACLAKAYAQMWLMSYFHRRDLRTLGFGIMSSVPKDWFPTGRTTWSVHANHE

SEQ ID NO: 14568 - protein, 337 aa, unidentified; identical to SEQ ID NO: 8339

SEQ ID NO: 14569 - protein, 337 aa, unidentified; identical to SEQ ID NO: 8339

SEQ ID NO: 14570 - protein, 337 aa, unidentified; identical to SEQ ID NO: 8339

SEQ ID NO: 14571 - protein, 337 aa, unidentified; identical to SEQ ID NO: 8339

SEQ ID NO: 14572 - protein, 336 aa, unidentified; identical to SEQ ID NO: 11587

SEQ ID NO: 14573 - protein, 337 aa, unidentified; identical to SEQ ID NO: 8339

SEQ ID NO: 14574 - protein, 337 aa, unidentified; identical to SEQ ID NO: 8339

SEQ ID NO: 14575 - protein, 337 aa, unidentified; identical to SEQ ID NO: 8339

SEQ ID NO: 14576 - protein, 337 aa, unidentified; identical to SEQ ID NO: 8339

SEQ ID NO: 14577 - protein, 337 aa, unidentified; identical to SEQ ID NO: 8339

SEQ ID NO: 14578 - protein, 337 aa, unidentified; identical to SEQ ID NO: 8339

SEQ ID NO: 14579 - protein, 337 aa, unidentified; identical to SEQ ID NO: 8339

SEQ ID NO: 14580 - protein, 337 aa, unidentified; identical to SEQ ID NO: 8339

SEQ ID NO: 14581 - protein, 337 aa, unidentified; identical to SEQ ID NO: 8339

SEQ ID NO: 14582 - protein, 337 aa, unidentified; identical to SEQ ID NO: 8339

SEQ ID NO: 14583 - protein, 337 aa, unidentified; identical to SEQ ID NO: 8339

SEQ ID NO: 14584 - protein, 337 aa, unidentified; identical to SEQ ID NO: 8339

SEQ ID NO: 14585 - protein, 337 aa, unidentified; identical to SEQ ID NO: 8339

SEQ ID NO: 14586 - protein, 337 aa, unidentified; identical to SEQ ID NO: 8339

SEQ ID NO: 14587 - protein, 337 aa, unidentified; identical to SEQ ID NO: 8339

SEQ ID NO: 14588 - protein, 337 aa, unidentified; identical to SEQ ID NO: 8339

SEQ ID NO: 14589 - protein, 337 aa, unidentified; identical to SEQ ID NO: 8339

SEQ ID NO: 14590 - protein, 337 aa, unidentified; identical to SEQ ID NO: 8339

SEQ ID NO: 14591 - protein, 337 aa, unidentified; identical to SEQ ID NO: 8339

SEQ ID NO: 14592 - protein, 337 aa, unidentified; identical to SEQ ID NO: 8339

SEQ ID NO: 14593 - protein, 337 aa, unidentified; identical to SEQ ID NO: 8339

SEQ ID NO: 14594 - protein, 337 aa, unidentified; identical to SEQ ID NO: 8339

SEQ ID NO: 14595 - protein, 337 aa, unidentified; identical to SEQ ID NO: 8339

SEQ ID NO: 14596 - protein, 337 aa, unidentified; identical to SEQ ID NO: 8339

SEQ ID NO: 14597 - protein, 227 aa, unidentified; identical to SEQ ID NO: 9886

SEQ ID NO: 14598 - protein, 337 aa, unidentified; identical to SEQ ID NO: 8339

SEQ ID NO: 14599 - protein, 337 aa, unidentified; identical to SEQ ID NO: 8339

SEQ ID NO: 14600 - protein, 337 aa, unidentified; identical to SEQ ID NO: 8339

SEQ ID NO: 14601 - protein, 337 aa, unidentified; identical to SEQ ID NO: 8339

SEQ ID NO: 14602 - protein, 337 aa, unidentified; identical to SEQ ID NO: 8339

SEQ ID NO: 14603 - protein, 328 aa, unidentified; identical to SEQ ID NO: 11891

SEQ ID NO: 14604 - protein, 337 aa, unidentified; identical to SEQ ID NO: 8339

SEQ ID NO: 14605 - protein, 337 aa, unidentified; identical to SEQ ID NO: 8339

SEQ ID NO: 14606 - protein, 337 aa, unidentified; identical to SEQ ID NO: 8339

SEQ ID NO: 14607 - protein, 337 aa, unidentified; identical to SEQ ID NO: 8339

SEQ ID NO: 14608 - protein, 337 aa, unidentified; identical to SEQ ID NO: 8339

SEQ ID NO: 14609 - protein, 258 aa, unidentified; identical to SEQ ID NO: 8309

SEQ ID NO: 14610 - protein, 258 aa, unidentified; identical to SEQ ID NO: 8309

SEQ ID NO: 14611 - protein, 333 aa, unidentified; identical to SEQ ID NO: 8351

SEQ ID NO: 14612 - protein, 127 aa, unidentified; identical to SEQ ID NO: 8344

SEQ ID NO: 14613 - protein, 276 aa, unidentified; identical to SEQ ID NO: 12441

SEQ ID NO: 14614 - protein, 302 aa, unidentified; identical to SEQ ID NO: 10310

SEQ ID NO: 14615 - protein, 248 aa, unidentified; identical to SEQ ID NO: 8593

SEQ ID NO: 14616 - protein, 248 aa, unidentified; identical to SEQ ID NO: 8593

SEQ ID NO: 14617 - protein, 337 aa, unidentified; identical to SEQ ID NO: 8339

SEQ ID NO: 14618 - protein, 127 aa, unidentified; identical to SEQ ID NO: 8344

SEQ ID NO: 14619 - protein, 248 aa, unidentified; identical to SEQ ID NO: 8593

SEQ ID NO: 14620 - protein, 337 aa, unidentified; identical to SEQ ID NO: 8339

SEQ ID NO: 14621 - protein, 258 aa, unidentified; identical to SEQ ID NO: 8309

SEQ ID NO: 14622 - protein, 127 aa, unidentified; identical to SEQ ID NO: 8344

SEQ ID NO: 14623 - protein, 279 aa, unidentified; identical to SEQ ID NO: 9724

SEQ ID NO: 14624 - protein, 174 aa, unidentified; identical to SEQ ID NO: 8195

SEQ ID NO: 14625 - protein, 248 aa, unidentified; identical to SEQ ID NO: 8593

SEQ ID NO: 14626 - protein, 127 aa, unidentified; identical to SEQ ID NO: 8344

SEQ ID NO: 14627 - protein, 127 aa, unidentified; identical to SEQ ID NO: 8344

SEQ ID NO: 14628 - protein, 125 aa, unidentified
AGWDTRITEADLDDECILCDYMEDEHKQLALSLFELCYKNKVALCPRPGRHGGTVMDVIFRRDQRGSGQVVTYALNTLTNIKVQLIRLAESEGVLDEDFNDHGIETWLNHYGEERLSRLLISGDD

SEQ ID NO: 14629 - protein, 222 aa, unidentified; identical to SEQ ID NO: 10689

SEQ ID NO: 14630 - protein, 127 aa, unidentified; identical to SEQ ID NO: 8344

SEQ ID NO: 14631 - protein, 337 aa, unidentified; identical to SEQ ID NO: 8339

SEQ ID NO: 14632 - protein, 174 aa, unidentified; identical to SEQ ID NO: 8195

SEQ ID NO: 14633 - protein, 337 aa, unidentified; identical to SEQ ID NO: 8339

SEQ ID NO: 14634 - protein, 337 aa, unidentified; identical to SEQ ID NO: 8339

SEQ ID NO: 14635 - protein, 245 aa, unidentified; identical to SEQ ID NO: 9193

SEQ ID NO: 14636 - protein, 258 aa, unidentified; identical to SEQ ID NO: 8309

SEQ ID NO: 14637 - protein, 127 aa, unidentified; identical to SEQ ID NO: 8344

SEQ ID NO: 14638 - protein, 240 aa, unidentified; identical to SEQ ID NO: 11575

SEQ ID NO: 14639 - protein, 337 aa, unidentified; identical to SEQ ID NO: 8339

SEQ ID NO: 14640 - protein, 337 aa, unidentified; identical to SEQ ID NO: 8339

SEQ ID NO: 14641 - protein, 337 aa, unidentified; identical to SEQ ID NO: 8339

SEQ ID NO: 14642 - protein, 337 aa, unidentified; identical to SEQ ID NO: 8339

SEQ ID NO: 14643 - protein, 337 aa, unidentified; identical to SEQ ID NO: 8339

SEQ ID NO: 14644 - protein, 174 aa, unidentified; identical to SEQ ID NO: 8195

SEQ ID NO: 14645 - protein, 337 aa, unidentified; identical to SEQ ID NO: 8339

SEQ ID NO: 14646 - protein, 337 aa, unidentified; identical to SEQ ID NO: 8339

SEQ ID NO: 14647 - protein, 337 aa, unidentified; identical to SEQ ID NO: 8339

SEQ ID NO: 14648 - protein, 214 aa, unidentified; identical to SEQ ID NO: 9674

SEQ ID NO: 14649 - protein, 258 aa, unidentified; identical to SEQ ID NO: 8309

SEQ ID NO: 14650 - protein, 258 aa, unidentified; identical to SEQ ID NO: 8309

SEQ ID NO: 14651 - protein, 258 aa, unidentified; identical to SEQ ID NO: 8309

SEQ ID NO: 14652 - protein, 248 aa, unidentified; identical to SEQ ID NO: 8593

SEQ ID NO: 14653 - protein, 337 aa, unidentified; identical to SEQ ID NO: 8339

SEQ ID NO: 14654 - protein, 42 aa, unidentified; identical to SEQ ID NO: 8416

SEQ ID NO: 14655 - protein, 337 aa, unidentified; identical to SEQ ID NO: 8339

SEQ ID NO: 14656 - protein, 337 aa, unidentified; identical to SEQ ID NO: 8339

SEQ ID NO: 14657 - protein, 217 aa, unidentified; identical to SEQ ID NO: 10987

SEQ ID NO: 14658 - protein, 337 aa, unidentified; identical to SEQ ID NO: 8339

SEQ ID NO: 14659 - protein, 337 aa, unidentified; identical to SEQ ID NO: 8339

SEQ ID NO: 14660 - protein, 337 aa, unidentified; identical to SEQ ID NO: 8339

SEQ ID NO: 14661 - protein, 337 aa, unidentified; identical to SEQ ID NO: 8339

SEQ ID NO: 14662 - protein, 337 aa, unidentified; identical to SEQ ID NO: 8339

SEQ ID NO: 14663 - protein, 337 aa, unidentified; identical to SEQ ID NO: 8339

SEQ ID NO: 14664 - protein, 248 aa, unidentified; identical to SEQ ID NO: 8593

SEQ ID NO: 14665 - protein, 248 aa, unidentified; identical to SEQ ID NO: 8593

SEQ ID NO: 14666 - protein, 337 aa, unidentified; identical to SEQ ID NO: 8339

SEQ ID NO: 14667 - protein, 337 aa, unidentified; identical to SEQ ID NO: 8339

SEQ ID NO: 14668 - protein, 337 aa, unidentified; identical to SEQ ID NO: 8339

SEQ ID NO: 14669 - protein, 227 aa, unidentified; identical to SEQ ID NO: 9886

SEQ ID NO: 14670 - protein, 337 aa, unidentified; identical to SEQ ID NO: 8339

SEQ ID NO: 14671 - protein, 270 aa, unidentified
SIPLFYLGYHLREMAKKPGKLYADDTAGWDTRITEADLDDECILCDYMEDEHKQLALSLFELCYKNKVALCPRPGRHGGTVMDVIFRRDQRGSGQVVTYALNTLTNIKVQLIRLAESEGVLDEDFNDHGIETWLNHYGEERLSRLLISGDDCLVNAFDERFGKALTWLNTMEKIRKDIDLCAPSNGYENFEKVEFCSNHFHELMLKDGRQLVVPCRSQNELVGRASVNQGGSATVAGTACLAKAYAQMWNLLYFHRRDLRLLGFAIMSAT

SEQ ID NO: 14672 - protein, 337 aa, unidentified; identical to SEQ ID NO: 8339

SEQ ID NO: 14673 - protein, 337 aa, unidentified; identical to SEQ ID NO: 8339

SEQ ID NO: 14674 - protein, 337 aa, unidentified; identical to SEQ ID NO: 8339

SEQ ID NO: 14675 - protein, 337 aa, unidentified; identical to SEQ ID NO: 8339

SEQ ID NO: 14676 - protein, 337 aa, unidentified; identical to SEQ ID NO: 8339

SEQ ID NO: 14677 - protein, 337 aa, unidentified; identical to SEQ ID NO: 8339

SEQ ID NO: 14678 - protein, 337 aa, unidentified; identical to SEQ ID NO: 8339

SEQ ID NO: 14679 - protein, 337 aa, unidentified; identical to SEQ ID NO: 8339

SEQ ID NO: 14680 - protein, 337 aa, unidentified; identical to SEQ ID NO: 8339

SEQ ID NO: 14681 - protein, 337 aa, unidentified; identical to SEQ ID NO: 8339

SEQ ID NO: 14682 - protein, 337 aa, unidentified; identical to SEQ ID NO: 8339

SEQ ID NO: 14683 - protein, 337 aa, unidentified; identical to SEQ ID NO: 8339

SEQ ID NO: 14684 - protein, 337 aa, unidentified; identical to SEQ ID NO: 8339

SEQ ID NO: 14685 - protein, 337 aa, unidentified; identical to SEQ ID NO: 8339

SEQ ID NO: 14686 - protein, 337 aa, unidentified; identical to SEQ ID NO: 8339

SEQ ID NO: 14687 - protein, 337 aa, unidentified; identical to SEQ ID NO: 8339

SEQ ID NO: 14688 - protein, 337 aa, unidentified; identical to SEQ ID NO: 8339

SEQ ID NO: 14689 - protein, 337 aa, unidentified; identical to SEQ ID NO: 8339

SEQ ID NO: 14690 - protein, 337 aa, unidentified; identical to SEQ ID NO: 8339

SEQ ID NO: 14691 - protein, 337 aa, unidentified; identical to SEQ ID NO: 8339

SEQ ID NO: 14692 - protein, 337 aa, unidentified; identical to SEQ ID NO: 8339

SEQ ID NO: 14693 - protein, 158 aa, unidentified
GIGINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALD

SEQ ID NO: 14694 - protein, 337 aa, unidentified; identical to SEQ ID NO: 8339

SEQ ID NO: 14695 - protein, 337 aa, unidentified; identical to SEQ ID NO: 8339

SEQ ID NO: 14696 - protein, 337 aa, unidentified; identical to SEQ ID NO: 8339

SEQ ID NO: 14697 - protein, 271 aa, unidentified; identical to SEQ ID NO: 10816

SEQ ID NO: 14698 - protein, 337 aa, unidentified; identical to SEQ ID NO: 8339

SEQ ID NO: 14699 - protein, 337 aa, unidentified; identical to SEQ ID NO: 8339

SEQ ID NO: 14700 - protein, 337 aa, unidentified; identical to SEQ ID NO: 8339

SEQ ID NO: 14701 - protein, 337 aa, unidentified; identical to SEQ ID NO: 8339

SEQ ID NO: 14702 - protein, 337 aa, unidentified; identical to SEQ ID NO: 8339

SEQ ID NO: 14703 - protein, 337 aa, unidentified; identical to SEQ ID NO: 8339

SEQ ID NO: 14704 - protein, 337 aa, unidentified; identical to SEQ ID NO: 8339

SEQ ID NO: 14705 - protein, 337 aa, unidentified; identical to SEQ ID NO: 8339

SEQ ID NO: 14706 - protein, 337 aa, unidentified; identical to SEQ ID NO: 8339

SEQ ID NO: 14707 - protein, 337 aa, unidentified; identical to SEQ ID NO: 8339

SEQ ID NO: 14708 - protein, 337 aa, unidentified; identical to SEQ ID NO: 8339

SEQ ID NO: 14709 - protein, 337 aa, unidentified; identical to SEQ ID NO: 8339

SEQ ID NO: 14710 - protein, 337 aa, unidentified; identical to SEQ ID NO: 8339

SEQ ID NO: 14711 - protein, 337 aa, unidentified; identical to SEQ ID NO: 8339

SEQ ID NO: 14712 - protein, 337 aa, unidentified; identical to SEQ ID NO: 8339

SEQ ID NO: 14713 - protein, 238 aa, unidentified; identical to SEQ ID NO: 9388

SEQ ID NO: 14714 - protein, 250 aa, unidentified; identical to SEQ ID NO: 11752

SEQ ID NO: 14715 - protein, 337 aa, unidentified; identical to SEQ ID NO: 8339

SEQ ID NO: 14716 - protein, 337 aa, unidentified; identical to SEQ ID NO: 8339

SEQ ID NO: 14717 - protein, 337 aa, unidentified; identical to SEQ ID NO: 8339

SEQ ID NO: 14718 - protein, 337 aa, unidentified; identical to SEQ ID NO: 8339

SEQ ID NO: 14719 - protein, 337 aa, unidentified; identical to SEQ ID NO: 8339

SEQ ID NO: 14720 - protein, 337 aa, unidentified; identical to SEQ ID NO: 8339

SEQ ID NO: 14721 - protein, 278 aa, unidentified; identical to SEQ ID NO: 8332

SEQ ID NO: 14722 - protein, 319 aa, unidentified; identical to SEQ ID NO: 10694

SEQ ID NO: 14723 - protein, 337 aa, unidentified; identical to SEQ ID NO: 8339

SEQ ID NO: 14724 - protein, 337 aa, unidentified; identical to SEQ ID NO: 8339

SEQ ID NO: 14725 - protein, 337 aa, unidentified; identical to SEQ ID NO: 8339

SEQ ID NO: 14726 - protein, 69 aa, unidentified; identical to SEQ ID NO: 8367

SEQ ID NO: 14727 - protein, 325 aa, unidentified; identical to SEQ ID NO: 8411

SEQ ID NO: 14728 - protein, 301 aa, unidentified; identical to SEQ ID NO: 10123

SEQ ID NO: 14729 - protein, 337 aa, unidentified; identical to SEQ ID NO: 8339

SEQ ID NO: 14730 - protein, 337 aa, unidentified; identical to SEQ ID NO: 8339

SEQ ID NO: 14731 - protein, 248 aa, unidentified; identical to SEQ ID NO: 8593

SEQ ID NO: 14732 - protein, 337 aa, unidentified; identical to SEQ ID NO: 8339

SEQ ID NO: 14733 - protein, 209 aa, unidentified; identical to SEQ ID NO: 9505

SEQ ID NO: 14734 - protein, 229 aa, unidentified; identical to SEQ ID NO: 8171

SEQ ID NO: 14735 - protein, 337 aa, unidentified; identical to SEQ ID NO: 8339

SEQ ID NO: 14736 - protein, 337 aa, unidentified; identical to SEQ ID NO: 8339

SEQ ID NO: 14737 - protein, 214 aa, unidentified; identical to SEQ ID NO: 11482

SEQ ID NO: 14738 - protein, 337 aa, unidentified; identical to SEQ ID NO: 8339

SEQ ID NO: 14739 - protein, 337 aa, unidentified; identical to SEQ ID NO: 8339

SEQ ID NO: 14740 - protein, 337 aa, unidentified; identical to SEQ ID NO: 8339

SEQ ID NO: 14741 - protein, 337 aa, unidentified; identical to SEQ ID NO: 8339

SEQ ID NO: 14742 - protein, 229 aa, unidentified; identical to SEQ ID NO: 8171

SEQ ID NO: 14743 - protein, 337 aa, unidentified; identical to SEQ ID NO: 8339

SEQ ID NO: 14744 - protein, 337 aa, unidentified; identical to SEQ ID NO: 8339

SEQ ID NO: 14745 - protein, 229 aa, unidentified; identical to SEQ ID NO: 8171

SEQ ID NO: 14746 - protein, 229 aa, unidentified; identical to SEQ ID NO: 8171

SEQ ID NO: 14747 - protein, 229 aa, unidentified; identical to SEQ ID NO: 8171

SEQ ID NO: 14748 - protein, 229 aa, unidentified; identical to SEQ ID NO: 8171

SEQ ID NO: 14749 - protein, 258 aa, unidentified; identical to SEQ ID NO: 8309

SEQ ID NO: 14750 - protein, 229 aa, unidentified; identical to SEQ ID NO: 8171

SEQ ID NO: 14751 - protein, 337 aa, unidentified; identical to SEQ ID NO: 8339

SEQ ID NO: 14752 - protein, 169 aa, unidentified
GVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAY

SEQ ID NO: 14753 - protein, 337 aa, unidentified; identical to SEQ ID NO: 8339

SEQ ID NO: 14754 - protein, 337 aa, unidentified; identical to SEQ ID NO: 8339

SEQ ID NO: 14755 - protein, 337 aa, unidentified; identical to SEQ ID NO: 8339

SEQ ID NO: 14756 - protein, 337 aa, unidentified; identical to SEQ ID NO: 8339

SEQ ID NO: 14757 - protein, 337 aa, unidentified; identical to SEQ ID NO: 8339

SEQ ID NO: 14758 - protein, 337 aa, unidentified; identical to SEQ ID NO: 8339

SEQ ID NO: 14759 - protein, 337 aa, unidentified; identical to SEQ ID NO: 8339

SEQ ID NO: 14760 - protein, 333 aa, unidentified; identical to SEQ ID NO: 8351

SEQ ID NO: 14761 - protein, 337 aa, unidentified; identical to SEQ ID NO: 8339

SEQ ID NO: 14762 - protein, 169 aa, unidentified; identical to SEQ ID NO: 14752

SEQ ID NO: 14763 - protein, 292 aa, unidentified; identical to SEQ ID NO: 14010

SEQ ID NO: 14764 - protein, 337 aa, unidentified; identical to SEQ ID NO: 8339

SEQ ID NO: 14765 - protein, 333 aa, unidentified; identical to SEQ ID NO: 8351

SEQ ID NO: 14766 - protein, 337 aa, unidentified; identical to SEQ ID NO: 8339

SEQ ID NO: 14767 - protein, 333 aa, unidentified; identical to SEQ ID NO: 8351

SEQ ID NO: 14768 - protein, 232 aa, unidentified; identical to SEQ ID NO: 10022

SEQ ID NO: 14769 - protein, 337 aa, unidentified; identical to SEQ ID NO: 8339

SEQ ID NO: 14770 - protein, 337 aa, unidentified; identical to SEQ ID NO: 8339

SEQ ID NO: 14771 - protein, 337 aa, unidentified; identical to SEQ ID NO: 8339

SEQ ID NO: 14772 - protein, 337 aa, unidentified; identical to SEQ ID NO: 8339

SEQ ID NO: 14773 - protein, 337 aa, unidentified; identical to SEQ ID NO: 8339

SEQ ID NO: 14774 - protein, 337 aa, unidentified; identical to SEQ ID NO: 8339

SEQ ID NO: 14775 - protein, 337 aa, unidentified; identical to SEQ ID NO: 8339

SEQ ID NO: 14776 - protein, 209 aa, unidentified; identical to SEQ ID NO: 9505

SEQ ID NO: 14777 - protein, 45 aa, unidentified; identical to SEQ ID NO: 8980

SEQ ID NO: 14778 - protein, 308 aa, unidentified
KPGEFGVAKGSRTIWYMWLGSRFLEFEALGFLNEERWASRDISGGGVEGIGINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCSHHFHELFLRDGRKLIVPCRDQHELVGRSMVSQGGSSGVAGTACLAKAYAQMWLMSYFHRRDLR

SEQ ID NO: 14779 - protein, 227 aa, unidentified
GVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCSHHFHELFLRDGRKLIVPCRDQHELVGRSMVSQGGSSGVAGTACLAKAY

SEQ ID NO: 14780 - protein, 321 aa, unidentified; identical to SEQ ID NO: 9199

SEQ ID NO: 14781 - protein, 283 aa, unidentified
LGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCSHHFHELFLRDGRKLIVPCRDQHELVGRSMVSQGGSSGVAGTACLAKAYAQMWLMSYFHRRDLRTLGFGIMSSVPKDWFPTGRTTWSVHANHE

SEQ ID NO: 14782 - protein, 337 aa, unidentified; identical to SEQ ID NO: 8339

SEQ ID NO: 14783 - protein, 337 aa, unidentified; identical to SEQ ID NO: 8339

SEQ ID NO: 14784 - protein, 69 aa, unidentified; identical to SEQ ID NO: 8367

SEQ ID NO: 14785 - protein, 337 aa, unidentified; identical to SEQ ID NO: 8339

SEQ ID NO: 14786 - protein, 337 aa, unidentified; identical to SEQ ID NO: 8339

SEQ ID NO: 14787 - protein, 69 aa, unidentified; identical to SEQ ID NO: 8367

SEQ ID NO: 14788 - protein, 337 aa, unidentified; identical to SEQ ID NO: 8339

SEQ ID NO: 14789 - protein, 337 aa, unidentified; identical to SEQ ID NO: 8339

SEQ ID NO: 14790 - protein, 337 aa, unidentified; identical to SEQ ID NO: 8339

SEQ ID NO: 14791 - protein, 337 aa, unidentified; identical to SEQ ID NO: 8339

SEQ ID NO: 14792 - protein, 193 aa, unidentified
AKGSRTIWYMWLGSRFLEFESFGFLNEEHWASRELSGGGVESIPLFYLGYHLREMAKKPGKLYADDTAGWDTRITEADLDDECILCDYMEDEHKQLALSLFELCYKNKVALCPRPGRHGGTVMDVIFRRDQRGSGQVVTYALNTLTNIKVQLIRLAESEGVLDEDFNDHGIETWLNHYGEERLSRLLISGDDC

SEQ ID NO: 14793 - protein, 127 aa, unidentified; identical to SEQ ID NO: 8344

SEQ ID NO: 14794 - protein, 337 aa, unidentified; identical to SEQ ID NO: 8339

SEQ ID NO: 14795 - protein, 337 aa, unidentified; identical to SEQ ID NO: 8339

SEQ ID NO: 14796 - protein, 337 aa, unidentified; identical to SEQ ID NO: 8339

SEQ ID NO: 14797 - protein, 333 aa, unidentified; identical to SEQ ID NO: 8351

SEQ ID NO: 14798 - protein, 337 aa, unidentified; identical to SEQ ID NO: 8339

SEQ ID NO: 14799 - protein, 337 aa, unidentified; identical to SEQ ID NO: 8339

SEQ ID NO: 14800 - protein, 337 aa, unidentified; identical to SEQ ID NO: 8339

SEQ ID NO: 14801 - protein, 69 aa, unidentified; identical to SEQ ID NO: 8367

SEQ ID NO: 14802 - protein, 337 aa, unidentified; identical to SEQ ID NO: 8339

SEQ ID NO: 14803 - protein, 337 aa, unidentified; identical to SEQ ID NO: 8339

SEQ ID NO: 14804 - protein, 337 aa, unidentified; identical to SEQ ID NO: 8339

SEQ ID NO: 14805 - protein, 337 aa, unidentified; identical to SEQ ID NO: 8339

SEQ ID NO: 14806 - protein, 337 aa, unidentified; identical to SEQ ID NO: 8339

SEQ ID NO: 14807 - protein, 337 aa, unidentified; identical to SEQ ID NO: 8339

SEQ ID NO: 14808 - protein, 244 aa, unidentified; identical to SEQ ID NO: 12697

SEQ ID NO: 14809 - protein, 337 aa, unidentified; identical to SEQ ID NO: 8339

SEQ ID NO: 14810 - protein, 337 aa, unidentified; identical to SEQ ID NO: 8339

SEQ ID NO: 14811 - protein, 333 aa, unidentified; identical to SEQ ID NO: 8351

SEQ ID NO: 14812 - protein, 337 aa, unidentified; identical to SEQ ID NO: 8339

SEQ ID NO: 14813 - protein, 337 aa, unidentified; identical to SEQ ID NO: 8339

SEQ ID NO: 14814 - protein, 337 aa, unidentified; identical to SEQ ID NO: 8339

SEQ ID NO: 14815 - protein, 337 aa, unidentified; identical to SEQ ID NO: 8339

SEQ ID NO: 14816 - protein, 229 aa, unidentified; identical to SEQ ID NO: 8171

SEQ ID NO: 14817 - protein, 229 aa, unidentified; identical to SEQ ID NO: 8171

SEQ ID NO: 14818 - protein, 80 aa, unidentified
CLAWNEWLDEGNGLYQGFNGLMLDKGKILYPIRYLLDADWNPEMHVLRYVTYSPHPLLHEYARQVIDEGRNEVVKDGSKN

SEQ ID NO: 14819 - protein, 258 aa, unidentified; identical to SEQ ID NO: 8309

SEQ ID NO: 14820 - protein, 337 aa, unidentified; identical to SEQ ID NO: 8339

SEQ ID NO: 14821 - protein, 337 aa, unidentified; identical to SEQ ID NO: 8339

SEQ ID NO: 14822 - protein, 311 aa, unidentified; identical to SEQ ID NO: 9495

SEQ ID NO: 14823 - protein, 258 aa, unidentified; identical to SEQ ID NO: 8309

SEQ ID NO: 14824 - protein, 258 aa, unidentified; identical to SEQ ID NO: 8309

SEQ ID NO: 14825 - protein, 231 aa, unidentified; identical to SEQ ID NO: 9733

SEQ ID NO: 14826 - protein, 265 aa, unidentified
KPGEFGVAKGSRTIWYMWLGSRFLEFEALGFLNEERWASRDISGGGVEGIGINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCSHHFHELFLRDGRKLIVPCRD

SEQ ID NO: 14827 - protein, 337 aa, unidentified; identical to SEQ ID NO: 8339

SEQ ID NO: 14828 - protein, 335 aa, unidentified; identical to SEQ ID NO: 8722

SEQ ID NO: 14829 - protein, 225 aa, unidentified; identical to SEQ ID NO: 12748

SEQ ID NO: 14830 - protein, 337 aa, unidentified; identical to SEQ ID NO: 8339

SEQ ID NO: 14831 - protein, 232 aa, unidentified; identical to SEQ ID NO: 10022

SEQ ID NO: 14832 - protein, 328 aa, unidentified; identical to SEQ ID NO: 11891

SEQ ID NO: 14833 - protein, 235 aa, unidentified; identical to SEQ ID NO: 9303

SEQ ID NO: 14834 - protein, 337 aa, unidentified; identical to SEQ ID NO: 8339

SEQ ID NO: 14835 - protein, 337 aa, unidentified; identical to SEQ ID NO: 8339

SEQ ID NO: 14836 - protein, 337 aa, unidentified; identical to SEQ ID NO: 8339

SEQ ID NO: 14837 - protein, 337 aa, unidentified; identical to SEQ ID NO: 8339

SEQ ID NO: 14838 - protein, 337 aa, unidentified; identical to SEQ ID NO: 8339

SEQ ID NO: 14839 - protein, 337 aa, unidentified; identical to SEQ ID NO: 8339

SEQ ID NO: 14840 - protein, 333 aa, unidentified; identical to SEQ ID NO: 11893

SEQ ID NO: 14841 - protein, 105 aa, unidentified
DVVLRTASVISDIRHRFDSALELLLNLQCINTIQKLRQRQPITVSELAYLIPLNPGPGNVYQLTPQGLLVGQGLYVGSRRPLVDYIKLTQNYSKWHAVEDVLIGP

SEQ ID NO: 14842 - protein, 337 aa, unidentified; identical to SEQ ID NO: 8339

SEQ ID NO: 14843 - protein, 337 aa, unidentified; identical to SEQ ID NO: 8339

SEQ ID NO: 14844 - protein, 337 aa, unidentified; identical to SEQ ID NO: 8339

SEQ ID NO: 14845 - protein, 38 aa, unidentified
GVRRNKSRYHLPMIESGHPGVWSAFNGIHIMHNKTVIV

SEQ ID NO: 14846 - protein, 42 aa, unidentified
LNQIDVHGKICYKHQITSKCSENFWGKQDYTHAVDHLELSTS

SEQ ID NO: 14847 - protein, 328 aa, unidentified; identical to SEQ ID NO: 11891

SEQ ID NO: 14848 - protein, 278 aa, unidentified; identical to SEQ ID NO: 8332

SEQ ID NO: 14849 - protein, 143 aa, unidentified; identical to SEQ ID NO: 8341

SEQ ID NO: 14850 - protein, 328 aa, unidentified; identical to SEQ ID NO: 11891

SEQ ID NO: 14851 - protein, 227 aa, unidentified
VEGIGINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCSHHFHELFLRDGRKLIVPCRDQHELVGRS

SEQ ID NO: 14852 - protein, 328 aa, unidentified; identical to SEQ ID NO: 11891

SEQ ID NO: 14853 - protein, 305 aa, unidentified
KPGEFGVAKGSRTIWYMWLGSRFLEFEALGFLNEERWASRDISGGGVEGIGINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCSHHFHELFLRDGRKLIVPCRDQHELVGRSMVSQGGSSGVAGTACLAKAYAQMWLMSYFHRR

SEQ ID NO: 14854 - protein, 258 aa, unidentified; identical to SEQ ID NO: 8309

SEQ ID NO: 14855 - protein, 229 aa, unidentified; identical to SEQ ID NO: 8171

SEQ ID NO: 14856 - protein, 333 aa, unidentified; identical to SEQ ID NO: 8351

SEQ ID NO: 14857 - protein, 337 aa, unidentified; identical to SEQ ID NO: 8339

SEQ ID NO: 14858 - protein, 229 aa, unidentified; identical to SEQ ID NO: 8171

SEQ ID NO: 14859 - protein, 337 aa, unidentified; identical to SEQ ID NO: 8339

SEQ ID NO: 14860 - protein, 337 aa, unidentified; identical to SEQ ID NO: 8339

SEQ ID NO: 14861 - protein, 337 aa, unidentified; identical to SEQ ID NO: 8339

SEQ ID NO: 14862 - protein, 337 aa, unidentified; identical to SEQ ID NO: 8339

SEQ ID NO: 14863 - protein, 248 aa, unidentified; identical to SEQ ID NO: 8593

SEQ ID NO: 14864 - protein, 337 aa, unidentified; identical to SEQ ID NO: 8339

SEQ ID NO: 14865 - protein, 337 aa, unidentified; identical to SEQ ID NO: 8339

SEQ ID NO: 14866 - protein, 337 aa, unidentified; identical to SEQ ID NO: 8339

SEQ ID NO: 14867 - protein, 337 aa, unidentified; identical to SEQ ID NO: 8339

SEQ ID NO: 14868 - protein, 337 aa, unidentified; identical to SEQ ID NO: 8339

SEQ ID NO: 14869 - protein, 337 aa, unidentified; identical to SEQ ID NO: 8339

SEQ ID NO: 14870 - protein, 337 aa, unidentified; identical to SEQ ID NO: 8339

SEQ ID NO: 14871 - protein, 337 aa, unidentified; identical to SEQ ID NO: 8339

SEQ ID NO: 14872 - protein, 337 aa, unidentified; identical to SEQ ID NO: 8339

SEQ ID NO: 14873 - protein, 337 aa, unidentified; identical to SEQ ID NO: 8339

SEQ ID NO: 14874 - protein, 337 aa, unidentified; identical to SEQ ID NO: 8339

SEQ ID NO: 14875 - protein, 337 aa, unidentified; identical to SEQ ID NO: 8339

SEQ ID NO: 14876 - protein, 337 aa, unidentified; identical to SEQ ID NO: 8339

SEQ ID NO: 14877 - protein, 337 aa, unidentified; identical to SEQ ID NO: 8339

SEQ ID NO: 14878 - protein, 337 aa, unidentified; identical to SEQ ID NO: 8339

SEQ ID NO: 14879 - protein, 337 aa, unidentified; identical to SEQ ID NO: 8339

SEQ ID NO: 14880 - protein, 69 aa, unidentified; identical to SEQ ID NO: 8367

SEQ ID NO: 14881 - protein, 337 aa, unidentified; identical to SEQ ID NO: 8339

SEQ ID NO: 14882 - protein, 337 aa, unidentified; identical to SEQ ID NO: 8339

SEQ ID NO: 14883 - protein, 337 aa, unidentified; identical to SEQ ID NO: 8339

SEQ ID NO: 14884 - protein, 337 aa, unidentified; identical to SEQ ID NO: 8339

SEQ ID NO: 14885 - protein, 337 aa, unidentified; identical to SEQ ID NO: 8339

SEQ ID NO: 14886 - protein, 337 aa, unidentified; identical to SEQ ID NO: 8339

SEQ ID NO: 14887 - protein, 337 aa, unidentified; identical to SEQ ID NO: 8339

SEQ ID NO: 14888 - protein, 337 aa, unidentified; identical to SEQ ID NO: 8339

SEQ ID NO: 14889 - protein, 337 aa, unidentified; identical to SEQ ID NO: 8339

SEQ ID NO: 14890 - protein, 337 aa, unidentified; identical to SEQ ID NO: 8339

SEQ ID NO: 14891 - protein, 110 aa, unidentified; identical to SEQ ID NO: 8955

SEQ ID NO: 14892 - protein, 337 aa, unidentified; identical to SEQ ID NO: 8339

SEQ ID NO: 14893 - protein, 206 aa, unidentified; identical to SEQ ID NO: 10023

SEQ ID NO: 14894 - protein, 337 aa, unidentified; identical to SEQ ID NO: 8339

SEQ ID NO: 14895 - protein, 232 aa, unidentified; identical to SEQ ID NO: 10022

SEQ ID NO: 14896 - protein, 337 aa, unidentified; identical to SEQ ID NO: 8339

SEQ ID NO: 14897 - protein, 337 aa, unidentified; identical to SEQ ID NO: 8339

SEQ ID NO: 14898 - protein, 337 aa, unidentified; identical to SEQ ID NO: 8339

SEQ ID NO: 14899 - protein, 337 aa, unidentified; identical to SEQ ID NO: 8339

SEQ ID NO: 14900 - protein, 337 aa, unidentified; identical to SEQ ID NO: 8339

SEQ ID NO: 14901 - protein, 337 aa, unidentified; identical to SEQ ID NO: 8339

SEQ ID NO: 14902 - protein, 337 aa, unidentified; identical to SEQ ID NO: 8339

SEQ ID NO: 14903 - protein, 337 aa, unidentified; identical to SEQ ID NO: 8339

SEQ ID NO: 14904 - protein, 337 aa, unidentified; identical to SEQ ID NO: 8339

SEQ ID NO: 14905 - protein, 154 aa, unidentified; identical to SEQ ID NO: 8743

SEQ ID NO: 14906 - protein, 42 aa, unidentified; identical to SEQ ID NO: 8416

SEQ ID NO: 14907 - protein, 334 aa, unidentified; identical to SEQ ID NO: 11898

SEQ ID NO: 14908 - protein, 337 aa, unidentified; identical to SEQ ID NO: 8339

SEQ ID NO: 14909 - protein, 229 aa, unidentified; identical to SEQ ID NO: 8171

SEQ ID NO: 14910 - protein, 337 aa, unidentified; identical to SEQ ID NO: 8339

SEQ ID NO: 14911 - protein, 123 aa, unidentified; identical to SEQ ID NO: 9190

SEQ ID NO: 14912 - protein, 127 aa, unidentified; identical to SEQ ID NO: 8344

SEQ ID NO: 14913 - protein, 174 aa, unidentified; identical to SEQ ID NO: 8195

SEQ ID NO: 14914 - protein, 174 aa, unidentified; identical to SEQ ID NO: 8195

SEQ ID NO: 14915 - protein, 174 aa, unidentified; identical to SEQ ID NO: 8195

SEQ ID NO: 14916 - protein, 337 aa, unidentified; identical to SEQ ID NO: 8339

SEQ ID NO: 14917 - protein, 337 aa, unidentified; identical to SEQ ID NO: 8339

SEQ ID NO: 14918 - protein, 337 aa, unidentified; identical to SEQ ID NO: 8339

SEQ ID NO: 14919 - protein, 337 aa, unidentified; identical to SEQ ID NO: 8339

SEQ ID NO: 14920 - protein, 337 aa, unidentified; identical to SEQ ID NO: 8339

SEQ ID NO: 14921 - protein, 337 aa, unidentified; identical to SEQ ID NO: 8339

SEQ ID NO: 14922 - protein, 337 aa, unidentified; identical to SEQ ID NO: 8339

SEQ ID NO: 14923 - protein, 337 aa, unidentified; identical to SEQ ID NO: 8339

SEQ ID NO: 14924 - protein, 69 aa, unidentified; identical to SEQ ID NO: 8367

SEQ ID NO: 14925 - protein, 233 aa, unidentified; identical to SEQ ID NO: 12341

SEQ ID NO: 14926 - protein, 246 aa, unidentified; identical to SEQ ID NO: 11888

SEQ ID NO: 14927 - protein, 337 aa, unidentified; identical to SEQ ID NO: 8339

SEQ ID NO: 14928 - protein, 337 aa, unidentified; identical to SEQ ID NO: 8339

SEQ ID NO: 14929 - protein, 337 aa, unidentified; identical to SEQ ID NO: 8339

SEQ ID NO: 14930 - protein, 337 aa, unidentified; identical to SEQ ID NO: 8339

SEQ ID NO: 14931 - protein, 189 aa, unidentified
HLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCSH

SEQ ID NO: 14932 - protein, 337 aa, unidentified; identical to SEQ ID NO: 8339

SEQ ID NO: 14933 - protein, 337 aa, unidentified; identical to SEQ ID NO: 8339

SEQ ID NO: 14934 - protein, 306 aa, unidentified
KPGEFGVAKGSRTIWYMWLGSRFLEFEALGFLNEERWASRDISGGGVEGIGINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCSHHFHELFLRDGRKLIVPCRDQHELVGRSMVSQGGSSGVAGTACLAKAYAQMWLMSYFHRRD

SEQ ID NO: 14935 - protein, 337 aa, unidentified; identical to SEQ ID NO: 8339

SEQ ID NO: 14936 - protein, 337 aa, unidentified; identical to SEQ ID NO: 8339

SEQ ID NO: 14937 - protein, 337 aa, unidentified; identical to SEQ ID NO: 8339

SEQ ID NO: 14938 - protein, 214 aa, unidentified; identical to SEQ ID NO: 11482

SEQ ID NO: 14939 - protein, 337 aa, unidentified; identical to SEQ ID NO: 8339

SEQ ID NO: 14940 - protein, 337 aa, unidentified; identical to SEQ ID NO: 8339

SEQ ID NO: 14941 - protein, 337 aa, unidentified; identical to SEQ ID NO: 8339

SEQ ID NO: 14942 - protein, 337 aa, unidentified; identical to SEQ ID NO: 8339

SEQ ID NO: 14943 - protein, 337 aa, unidentified; identical to SEQ ID NO: 8339

SEQ ID NO: 14944 - protein, 337 aa, unidentified; identical to SEQ ID NO: 8339

SEQ ID NO: 14945 - protein, 337 aa, unidentified; identical to SEQ ID NO: 8339

SEQ ID NO: 14946 - protein, 337 aa, unidentified; identical to SEQ ID NO: 8339

SEQ ID NO: 14947 - protein, 337 aa, unidentified; identical to SEQ ID NO: 8339

SEQ ID NO: 14948 - protein, 337 aa, unidentified; identical to SEQ ID NO: 8339

SEQ ID NO: 14949 - protein, 292 aa, unidentified; identical to SEQ ID NO: 9890

SEQ ID NO: 14950 - protein, 69 aa, unidentified; identical to SEQ ID NO: 8367

SEQ ID NO: 14951 - protein, 337 aa, unidentified; identical to SEQ ID NO: 8339

SEQ ID NO: 14952 - protein, 337 aa, unidentified; identical to SEQ ID NO: 8339

SEQ ID NO: 14953 - protein, 337 aa, unidentified; identical to SEQ ID NO: 8339

SEQ ID NO: 14954 - protein, 337 aa, unidentified; identical to SEQ ID NO: 8339

SEQ ID NO: 14955 - protein, 337 aa, unidentified; identical to SEQ ID NO: 8339

SEQ ID NO: 14956 - protein, 337 aa, unidentified; identical to SEQ ID NO: 8339

SEQ ID NO: 14957 - protein, 337 aa, unidentified; identical to SEQ ID NO: 8339

SEQ ID NO: 14958 - protein, 337 aa, unidentified; identical to SEQ ID NO: 8339

SEQ ID NO: 14959 - protein, 337 aa, unidentified; identical to SEQ ID NO: 8339

SEQ ID NO: 14960 - protein, 337 aa, unidentified; identical to SEQ ID NO: 8339

SEQ ID NO: 14961 - protein, 337 aa, unidentified; identical to SEQ ID NO: 8339

SEQ ID NO: 14962 - protein, 252 aa, unidentified
KPGEFGVAKGSRTIWYMWLGSRFLEFEALGFLNEERWASRDISGGGVEGIGINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCSHHFHELF

SEQ ID NO: 14963 - protein, 337 aa, unidentified; identical to SEQ ID NO: 8339

SEQ ID NO: 14964 - protein, 337 aa, unidentified; identical to SEQ ID NO: 8339

SEQ ID NO: 14965 - protein, 337 aa, unidentified; identical to SEQ ID NO: 8339

SEQ ID NO: 14966 - protein, 337 aa, unidentified; identical to SEQ ID NO: 8339

SEQ ID NO: 14967 - protein, 337 aa, unidentified; identical to SEQ ID NO: 8339

SEQ ID NO: 14968 - protein, 337 aa, unidentified; identical to SEQ ID NO: 8339

SEQ ID NO: 14969 - protein, 337 aa, unidentified; identical to SEQ ID NO: 8339

SEQ ID NO: 14970 - protein, 337 aa, unidentified; identical to SEQ ID NO: 8339

SEQ ID NO: 14971 - protein, 337 aa, unidentified; identical to SEQ ID NO: 8339

SEQ ID NO: 14972 - protein, 337 aa, unidentified; identical to SEQ ID NO: 8339

SEQ ID NO: 14973 - protein, 337 aa, unidentified; identical to SEQ ID NO: 8339

SEQ ID NO: 14974 - protein, 109 aa, unidentified; identical to SEQ ID NO: 8875

SEQ ID NO: 14975 - protein, 229 aa, unidentified; identical to SEQ ID NO: 8171

SEQ ID NO: 14976 - protein, 229 aa, unidentified; identical to SEQ ID NO: 8171

SEQ ID NO: 14977 - protein, 337 aa, unidentified; identical to SEQ ID NO: 8339

SEQ ID NO: 14978 - protein, 337 aa, unidentified; identical to SEQ ID NO: 8339

SEQ ID NO: 14979 - protein, 337 aa, unidentified; identical to SEQ ID NO: 8339

SEQ ID NO: 14980 - protein, 337 aa, unidentified; identical to SEQ ID NO: 8339

SEQ ID NO: 14981 - protein, 337 aa, unidentified; identical to SEQ ID NO: 8339

SEQ ID NO: 14982 - protein, 229 aa, unidentified; identical to SEQ ID NO: 8171

SEQ ID NO: 14983 - protein, 229 aa, unidentified; identical to SEQ ID NO: 8171

SEQ ID NO: 14984 - protein, 229 aa, unidentified; identical to SEQ ID NO: 8171

SEQ ID NO: 14985 - protein, 229 aa, unidentified; identical to SEQ ID NO: 8171

SEQ ID NO: 14986 - protein, 337 aa, unidentified; identical to SEQ ID NO: 8339

SEQ ID NO: 14987 - protein, 231 aa, unidentified; identical to SEQ ID NO: 9315

SEQ ID NO: 14988 - protein, 337 aa, unidentified; identical to SEQ ID NO: 8339

SEQ ID NO: 14989 - protein, 233 aa, unidentified; identical to SEQ ID NO: 12341

SEQ ID NO: 14990 - protein, 337 aa, unidentified; identical to SEQ ID NO: 8339

SEQ ID NO: 14991 - protein, 337 aa, unidentified; identical to SEQ ID NO: 8339

SEQ ID NO: 14992 - protein, 337 aa, unidentified; identical to SEQ ID NO: 8339

SEQ ID NO: 14993 - protein, 337 aa, unidentified; identical to SEQ ID NO: 8339

SEQ ID NO: 14994 - protein, 337 aa, unidentified; identical to SEQ ID NO: 8339

SEQ ID NO: 14995 - protein, 252 aa, unidentified
GKLYADDTAGWDTRITEADLDDECILCDYMEDEHKQLALSLFELCYKNKVALCPRPGRHGGTVMDVIFRRDQRGSGQVVTYALNTLTNIKVQLIRLAESEGVLDEDFNDHGIETWLNHYGEERLSRLLISGDDCLVNAFDERFGKALTWLNTMEKIRKDIDLCAPSNGYENFEKVEFCSNHFHELMLKDGRQLVVPCRSQNELVGRASVNQGGSATVAGTACLAKAYAQMWNLLYFHRRDLRLLGFAIMSAT

SEQ ID NO: 14996 - protein, 337 aa, unidentified; identical to SEQ ID NO: 8339

SEQ ID NO: 14997 - protein, 45 aa, unidentified; identical to SEQ ID NO: 8980

SEQ ID NO: 14998 - protein, 258 aa, unidentified; identical to SEQ ID NO: 8309

SEQ ID NO: 14999 - protein, 333 aa, unidentified; identical to SEQ ID NO: 8351

SEQ ID NO: 15000 - protein, 337 aa, unidentified; identical to SEQ ID NO: 8339

SEQ ID NO: 15001 - protein, 337 aa, unidentified; identical to SEQ ID NO: 8339

SEQ ID NO: 15002 - protein, 333 aa, unidentified; identical to SEQ ID NO: 8351

SEQ ID NO: 15003 - protein, 337 aa, unidentified; identical to SEQ ID NO: 8339

SEQ ID NO: 15004 - protein, 337 aa, unidentified; identical to SEQ ID NO: 8339

SEQ ID NO: 15005 - protein, 337 aa, unidentified; identical to SEQ ID NO: 8339

SEQ ID NO: 15006 - protein, 337 aa, unidentified; identical to SEQ ID NO: 8339

SEQ ID NO: 15007 - protein, 335 aa, unidentified; identical to SEQ ID NO: 13281

SEQ ID NO: 15008 - protein, 337 aa, unidentified; identical to SEQ ID NO: 8339

SEQ ID NO: 15009 - protein, 105 aa, unidentified; identical to SEQ ID NO: 14841

SEQ ID NO: 15010 - protein, 333 aa, unidentified; identical to SEQ ID NO: 8351

SEQ ID NO: 15011 - protein, 337 aa, unidentified; identical to SEQ ID NO: 8339

SEQ ID NO: 15012 - protein, 333 aa, unidentified; identical to SEQ ID NO: 8351

SEQ ID NO: 15013 - protein, 337 aa, unidentified; identical to SEQ ID NO: 8339

SEQ ID NO: 15014 - protein, 267 aa, unidentified; identical to SEQ ID NO: 13030

SEQ ID NO: 15015 - protein, 337 aa, unidentified; identical to SEQ ID NO: 8339

SEQ ID NO: 15016 - protein, 337 aa, unidentified; identical to SEQ ID NO: 8339

SEQ ID NO: 15017 - protein, 279 aa, unidentified; identical to SEQ ID NO: 9724

SEQ ID NO: 15018 - protein, 273 aa, unidentified; identical to SEQ ID NO: 11142

SEQ ID NO: 15019 - protein, 335 aa, unidentified; identical to SEQ ID NO: 13281

SEQ ID NO: 15020 - protein, 294 aa, unidentified; identical to SEQ ID NO: 13488

SEQ ID NO: 15021 - protein, 337 aa, unidentified; identical to SEQ ID NO: 8339

SEQ ID NO: 15022 - protein, 337 aa, unidentified; identical to SEQ ID NO: 8339

SEQ ID NO: 15023 - protein, 337 aa, unidentified; identical to SEQ ID NO: 8339

SEQ ID NO: 15024 - protein, 337 aa, unidentified; identical to SEQ ID NO: 8339

SEQ ID NO: 15025 - protein, 337 aa, unidentified; identical to SEQ ID NO: 8339

SEQ ID NO: 15026 - protein, 337 aa, unidentified; identical to SEQ ID NO: 8339

SEQ ID NO: 15027 - protein, 87 aa, unidentified
VAVSLIAIIKGIVNLYKSGLFQFFVFLALAGRSCTEEAFKIGLHTEFQTVSFSMVGLFSNNPHDLPLLCTLNKSHLYIKGGNASFQI

SEQ ID NO: 15028 - protein, 337 aa, unidentified; identical to SEQ ID NO: 8339

SEQ ID NO: 15029 - protein, 337 aa, unidentified; identical to SEQ ID NO: 8339

SEQ ID NO: 15030 - protein, 337 aa, unidentified; identical to SEQ ID NO: 8339

SEQ ID NO: 15031 - protein, 328 aa, unidentified; identical to SEQ ID NO: 11891

SEQ ID NO: 15032 - protein, 258 aa, unidentified; identical to SEQ ID NO: 8309

SEQ ID NO: 15033 - protein, 258 aa, unidentified; identical to SEQ ID NO: 8309

SEQ ID NO: 15034 - protein, 231 aa, unidentified; identical to SEQ ID NO: 9315

SEQ ID NO: 15035 - protein, 333 aa, unidentified; identical to SEQ ID NO: 8351

SEQ ID NO: 15036 - protein, 337 aa, unidentified; identical to SEQ ID NO: 8339

SEQ ID NO: 15037 - protein, 337 aa, unidentified; identical to SEQ ID NO: 8339

SEQ ID NO: 15038 - protein, 337 aa, unidentified; identical to SEQ ID NO: 8339

SEQ ID NO: 15039 - protein, 115 aa, unidentified
PHHRALIAVTMRLAYQNIAAVFPRTQSKYGSGFVMDFLGRRDQRGSGQVVTFALNTITNGKVQVARVLESEGLLHADESVLDAWLEKHLEEALGNMVIAGEEVVVSTTNRDFSSA

SEQ ID NO: 15040 - protein, 337 aa, unidentified; identical to SEQ ID NO: 8339

SEQ ID NO: 15041 - protein, 337 aa, unidentified; identical to SEQ ID NO: 8339

SEQ ID NO: 15042 - protein, 127 aa, unidentified; identical to SEQ ID NO: 8344

SEQ ID NO: 15043 - protein, 337 aa, unidentified; identical to SEQ ID NO: 8339

SEQ ID NO: 15044 - protein, 337 aa, unidentified; identical to SEQ ID NO: 8339

SEQ ID NO: 15045 - protein, 337 aa, unidentified; identical to SEQ ID NO: 8339

SEQ ID NO: 15046 - protein, 337 aa, unidentified; identical to SEQ ID NO: 8339

SEQ ID NO: 15047 - protein, 214 aa, unidentified; identical to SEQ ID NO: 9674

SEQ ID NO: 15048 - protein, 337 aa, unidentified; identical to SEQ ID NO: 8339

SEQ ID NO: 15049 - protein, 337 aa, unidentified; identical to SEQ ID NO: 8339

SEQ ID NO: 15050 - protein, 337 aa, unidentified; identical to SEQ ID NO: 8339

SEQ ID NO: 15051 - protein, 337 aa, unidentified; identical to SEQ ID NO: 8339

SEQ ID NO: 15052 - protein, 337 aa, unidentified; identical to SEQ ID NO: 8339

SEQ ID NO: 15053 - protein, 337 aa, unidentified; identical to SEQ ID NO: 8339

SEQ ID NO: 15054 - protein, 337 aa, unidentified; identical to SEQ ID NO: 8339

SEQ ID NO: 15055 - protein, 337 aa, unidentified; identical to SEQ ID NO: 8339

SEQ ID NO: 15056 - protein, 337 aa, unidentified; identical to SEQ ID NO: 8339

SEQ ID NO: 15057 - protein, 337 aa, unidentified; identical to SEQ ID NO: 8339

SEQ ID NO: 15058 - protein, 337 aa, unidentified; identical to SEQ ID NO: 8339

SEQ ID NO: 15059 - protein, 337 aa, unidentified; identical to SEQ ID NO: 8339

SEQ ID NO: 15060 - protein, 69 aa, unidentified; identical to SEQ ID NO: 8367

SEQ ID NO: 15061 - protein, 281 aa, unidentified
KPGEFGVAKGSRTIWYMWLGSRFLEFEALGFLNEERWASRDISGGGVEGIGINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCSHHFHELFLRDGRKLIVPCRDQHELVGRSMVSQGGSS

SEQ ID NO: 15062 - protein, 127 aa, unidentified; identical to SEQ ID NO: 8594

SEQ ID NO: 15063 - protein, 337 aa, unidentified; identical to SEQ ID NO: 8339

SEQ ID NO: 15064 - protein, 69 aa, unidentified; identical to SEQ ID NO: 8367

SEQ ID NO: 15065 - protein, 337 aa, unidentified; identical to SEQ ID NO: 8339

SEQ ID NO: 15066 - protein, 212 aa, unidentified
KPGEFGVAKGSRTIWYMWLGSRFLEFEALGFLNEERWASRDISGGGVEGIGINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRA

SEQ ID NO: 15067 - protein, 337 aa, unidentified; identical to SEQ ID NO: 8339

SEQ ID NO: 15068 - protein, 337 aa, unidentified; identical to SEQ ID NO: 8339

SEQ ID NO: 15069 - protein, 337 aa, unidentified; identical to SEQ ID NO: 8339

SEQ ID NO: 15070 - protein, 234 aa, unidentified
KPGEFGVAKGSRTIWYMWLGSRFLEFEALGFLNEERWASRDISGGGVEGIGINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRA

SEQ ID NO: 15071 - protein, 337 aa, unidentified; identical to SEQ ID NO: 8339

SEQ ID NO: 15072 - protein, 337 aa, unidentified; identical to SEQ ID NO: 8339

SEQ ID NO: 15073 - protein, 337 aa, unidentified; identical to SEQ ID NO: 8339

SEQ ID NO: 15074 - protein, 337 aa, unidentified; identical to SEQ ID NO: 8339

SEQ ID NO: 15075 - protein, 337 aa, unidentified; identical to SEQ ID NO: 8339

SEQ ID NO: 15076 - protein, 337 aa, unidentified; identical to SEQ ID NO: 8339

SEQ ID NO: 15077 - protein, 262 aa, unidentified; identical to SEQ ID NO: 9207

SEQ ID NO: 15078 - protein, 337 aa, unidentified; identical to SEQ ID NO: 8339

SEQ ID NO: 15079 - protein, 337 aa, unidentified; identical to SEQ ID NO: 8339

SEQ ID NO: 15080 - protein, 337 aa, unidentified; identical to SEQ ID NO: 8339

SEQ ID NO: 15081 - protein, 337 aa, unidentified; identical to SEQ ID NO: 8339

SEQ ID NO: 15082 - protein, 337 aa, unidentified; identical to SEQ ID NO: 8339

SEQ ID NO: 15083 - protein, 337 aa, unidentified; identical to SEQ ID NO: 8339

SEQ ID NO: 15084 - protein, 337 aa, unidentified; identical to SEQ ID NO: 8339

SEQ ID NO: 15085 - protein, 217 aa, unidentified; identical to SEQ ID NO: 10987

SEQ ID NO: 15086 - protein, 116 aa, unidentified
DVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCSH

SEQ ID NO: 15087 - protein, 85 aa, unidentified
FNLENILEFTLCEGTKAKVNRQEALTSVDLSYLAPRVGGLGSIFRVRNGTLERGSTIYMKIDVESPIVPELEGFDPRTNQSRVFW

SEQ ID NO: 15088 - protein, 337 aa, unidentified; identical to SEQ ID NO: 8339

SEQ ID NO: 15089 - protein, 229 aa, unidentified; identical to SEQ ID NO: 8171

SEQ ID NO: 15090 - protein, 337 aa, unidentified; identical to SEQ ID NO: 8339

SEQ ID NO: 15091 - protein, 337 aa, unidentified; identical to SEQ ID NO: 8339

SEQ ID NO: 15092 - protein, 337 aa, unidentified; identical to SEQ ID NO: 8339

SEQ ID NO: 15093 - protein, 296 aa, unidentified
KPGEFGVAKGSRTIWYMWLGSRFLEFEALGFLNEERWASRDISGGGVEGIGINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCSHHFHELFLRDGRKLIVPCRDQHELVGRSMVSQGGSSGVAGTACLAKAYAQM

SEQ ID NO: 15094 - protein, 207 aa, unidentified
AGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCSHHFHELFLRDGRKLIVPCRDQHELVGRSMVSQGGSS

SEQ ID NO: 15095 - protein, 337 aa, unidentified; identical to SEQ ID NO: 8339

SEQ ID NO: 15096 - protein, 337 aa, unidentified; identical to SEQ ID NO: 8339

SEQ ID NO: 15097 - protein, 337 aa, unidentified; identical to SEQ ID NO: 8339

SEQ ID NO: 15098 - protein, 337 aa, unidentified; identical to SEQ ID NO: 8339

SEQ ID NO: 15099 - protein, 337 aa, unidentified; identical to SEQ ID NO: 8339

SEQ ID NO: 15100 - protein, 337 aa, unidentified; identical to SEQ ID NO: 8339

SEQ ID NO: 15101 - protein, 337 aa, unidentified; identical to SEQ ID NO: 8339

SEQ ID NO: 15102 - protein, 337 aa, unidentified; identical to SEQ ID NO: 8339

SEQ ID NO: 15103 - protein, 283 aa, unidentified; identical to SEQ ID NO: 14781

SEQ ID NO: 15104 - protein, 337 aa, unidentified; identical to SEQ ID NO: 8339

SEQ ID NO: 15105 - protein, 219 aa, unidentified; identical to SEQ ID NO: 9973

SEQ ID NO: 15106 - protein, 337 aa, unidentified; identical to SEQ ID NO: 8339

SEQ ID NO: 15107 - protein, 229 aa, unidentified; identical to SEQ ID NO: 8171

SEQ ID NO: 15108 - protein, 174 aa, unidentified; identical to SEQ ID NO: 8195

SEQ ID NO: 15109 - protein, 229 aa, unidentified; identical to SEQ ID NO: 8171

SEQ ID NO: 15110 - protein, 229 aa, unidentified; identical to SEQ ID NO: 8171

SEQ ID NO: 15111 - protein, 337 aa, unidentified; identical to SEQ ID NO: 8339

SEQ ID NO: 15112 - protein, 337 aa, unidentified; identical to SEQ ID NO: 8339

SEQ ID NO: 15113 - protein, 154 aa, unidentified; identical to SEQ ID NO: 8743

SEQ ID NO: 15114 - protein, 45 aa, unidentified; identical to SEQ ID NO: 8980

SEQ ID NO: 15115 - protein, 258 aa, unidentified; identical to SEQ ID NO: 8309

SEQ ID NO: 15116 - protein, 258 aa, unidentified; identical to SEQ ID NO: 8309

SEQ ID NO: 15117 - protein, 258 aa, unidentified; identical to SEQ ID NO: 8309

SEQ ID NO: 15118 - protein, 311 aa, unidentified; identical to SEQ ID NO: 12899

SEQ ID NO: 15119 - protein, 337 aa, unidentified; identical to SEQ ID NO: 8339

SEQ ID NO: 15120 - protein, 333 aa, unidentified; identical to SEQ ID NO: 8351

SEQ ID NO: 15121 - protein, 333 aa, unidentified; identical to SEQ ID NO: 8351

SEQ ID NO: 15122 - protein, 333 aa, unidentified; identical to SEQ ID NO: 8351

SEQ ID NO: 15123 - protein, 241 aa, unidentified; identical to SEQ ID NO: 12208

SEQ ID NO: 15124 - protein, 337 aa, unidentified; identical to SEQ ID NO: 8339

SEQ ID NO: 15125 - protein, 337 aa, unidentified; identical to SEQ ID NO: 8339

SEQ ID NO: 15126 - protein, 337 aa, unidentified; identical to SEQ ID NO: 8339

SEQ ID NO: 15127 - protein, 337 aa, unidentified; identical to SEQ ID NO: 8339

SEQ ID NO: 15128 - protein, 337 aa, unidentified; identical to SEQ ID NO: 8339

SEQ ID NO: 15129 - protein, 337 aa, unidentified; identical to SEQ ID NO: 8339

SEQ ID NO: 15130 - protein, 337 aa, unidentified; identical to SEQ ID NO: 8339

SEQ ID NO: 15131 - protein, 337 aa, unidentified; identical to SEQ ID NO: 8339

SEQ ID NO: 15132 - protein, 337 aa, unidentified; identical to SEQ ID NO: 8339

SEQ ID NO: 15133 - protein, 337 aa, unidentified; identical to SEQ ID NO: 8339

SEQ ID NO: 15134 - protein, 273 aa, unidentified; identical to SEQ ID NO: 11142

SEQ ID NO: 15135 - protein, 337 aa, unidentified; identical to SEQ ID NO: 8339

SEQ ID NO: 15136 - protein, 337 aa, unidentified; identical to SEQ ID NO: 8339

SEQ ID NO: 15137 - protein, 333 aa, unidentified; identical to SEQ ID NO: 8351

SEQ ID NO: 15138 - protein, 337 aa, unidentified; identical to SEQ ID NO: 8339

SEQ ID NO: 15139 - protein, 337 aa, unidentified; identical to SEQ ID NO: 8339

SEQ ID NO: 15140 - protein, 337 aa, unidentified; identical to SEQ ID NO: 8339

SEQ ID NO: 15141 - protein, 337 aa, unidentified; identical to SEQ ID NO: 8339

SEQ ID NO: 15142 - protein, 337 aa, unidentified; identical to SEQ ID NO: 8339

SEQ ID NO: 15143 - protein, 235 aa, unidentified; identical to SEQ ID NO: 9303

SEQ ID NO: 15144 - protein, 258 aa, unidentified; identical to SEQ ID NO: 8309

SEQ ID NO: 15145 - protein, 258 aa, unidentified; identical to SEQ ID NO: 8309

SEQ ID NO: 15146 - protein, 258 aa, unidentified; identical to SEQ ID NO: 8309

SEQ ID NO: 15147 - protein, 441 aa, unidentified
MDMALQQGNEYYISDDDSDGGPDLFIPISQVDTLREMGFLPVSYGHYSKIRKNFLNEFYMAWAMAGTYSAIVKTNPSLSALDILSDIEIEKVGSCIMSDEGIIGCILLDDPRAINTFKDLCSGRGLFEIVADHYSEVNMHEVSSMAPFCKDKNDAKSWTNWTSTSRSRPNSVKINFEPLESINSFTVIMEIRAKLDLVSGASFDLDILDKGKVCSPVDIRPKAKVSEVQEVPTTSYLPSAPSPSVTQPAVQNRQITNNDFQKEFVPTGHVTEVESFFNYIMEVRASPSTLGCGLMKYSPEFIWSFALSNCVQGHAPSWARNAPVLELISRLNDYCIHSIKDEGMYSREMLGTKTYVDSSTLSETMESLKSSQKRESKAILNVESMMKELLAHIKSGERSIPMAALPTVSAEDKPLFEAEGQRNPQVTKEPTGIVFIPPPPV

SEQ ID NO: 15148 - protein, 625 aa, unidentified
MDQARYYTGTGRNNELASASTKIRTIPYIHNNTVNRGFNFLLDVVAVIGVVLGVISIGLSTTSIIYHTRTQNVTTKADPYIKPIYDDVKQISQYYTEYIDPRLRNILDAVTFQIPKTLASITSTLGASELQEQQEAFNALLDGITTTLRSAVNSLNQLTSIILEQFDETKLIVREINNEILNTNKSFIPIEHPFTQYPRVHTTSMSSLPPLRCTRAVPTANPKRVPIFVSNVGGMLENSCTKEPVISMANGVFASTYLYLRDSCTDYQSSIRFFEMGIVKRLSDNDPYLSVIHTWDQASPFVLQPCSLAVAYDNGYALCAESVTGVDNDLVTGNTIRLVLFTFTLFGSLERKVIYYENFKRPREFVYIIPGAGQGVIIDNVMYSIGYYVSENTPQGNLKCPTTGCPNLQYSTCDQFSRTQVSNHRHKFLTLIQVNLTQYPLPVHNLLVIPRSYYSIISHGNLYYRNSNDSVLFQLYNVGWYHKPLVGSINLTTPLSLEFLNKDYDLLSSVTNCVPGFGCPSSCEISAYGAYTPLDYNFNDAVSLIPRTSGAYPSVSYGSGNTRIDFRIILNQQLALRESSLVCYLPTIQNTGHPYCVGLMTFEVTGQTAPQLYSVGWKQTYQCSK

SEQ ID NO: 15149 - protein, 1589 aa, unidentified
  VARIANT 802: note = Any amino acid
  VARIANT 803: note = Any amino acid
  VARIANT 804: note = Any amino acid
  VARIANT 805: note = Any amino acid
  VARIANT 806: note = Any amino acid
  VARIANT 807: note = Any amino acid
  VARIANT 881: note = Any amino acid
  VARIANT 882: note = Any amino acid
  VARIANT 883: note = Any amino acid
  VARIANT 884: note = Any amino acid
  VARIANT 885: note = Any amino acid
  VARIANT 886: note = Any amino acid
  VARIANT 887: note = Any amino acid
  VARIANT 888: note = Any amino acid
  VARIANT 889: note = Any amino acid
  VARIANT 890: note = Any amino acid
  VARIANT 972: note = Any amino acid
  VARIANT 973: note = Any amino acid
  VARIANT 974: note = Any amino acid
  VARIANT 975: note = Any amino acid
  VARIANT 976: note = Any amino acid
  VARIANT 977: note = Any amino acid
  VARIANT 978: note = Any amino acid
  VARIANT 979: note = Any amino acid
  VARIANT 980: note = Any amino acid
  VARIANT 981: note = Any amino acid
  VARIANT 982: note = Any amino acid
  VARIANT 983: note = Any amino acid
  VARIANT 984: note = Any amino acid
  VARIANT 985: note = Any amino acid
  VARIANT 986: note = Any amino acid
  VARIANT 987: note = Any amino acid
  VARIANT 988: note = Any amino acid
  VARIANT 989: note = Any amino acid
  VARIANT 990: note = Any amino acid
  VARIANT 991: note = Any amino acid
  VARIANT 992: note = Any amino acid
  VARIANT 993: note = Any amino acid
  VARIANT 994: note = Any amino acid
  VARIANT 995: note = Any amino acid
  VARIANT 996: note = Any amino acid
  VARIANT 997: note = Any amino acid
  VARIANT 998: note = Any amino acid
  VARIANT 999: note = Any amino acid
  VARIANT 1030: note = Any amino acid
  VARIANT 1031: note = Any amino acid
  VARIANT 1032: note = Any amino acid
  VARIANT 1033: note = Any amino acid
  VARIANT 1034: note = Any amino acid
  VARIANT 1035: note = Any amino acid
  VARIANT 1036: note = Any amino acid
  VARIANT 1037: note = Any amino acid
  VARIANT 1038: note = Any amino acid
  VARIANT 1039: note = Any amino acid
  VARIANT 1040: note = Any amino acid
  VARIANT 1041: note = Any amino acid
  VARIANT 1059: note = Any amino acid
  VARIANT 1060: note = Any amino acid
  VARIANT 1061: note = Any amino acid
  VARIANT 1062: note = Any amino acid
  VARIANT 1063: note = Any amino acid
  VARIANT 1064: note = Any amino acid
  VARIANT 1065: note = Any amino acid
  VARIANT 1066: note = Any amino acid
  VARIANT 1067: note = Any amino acid
  VARIANT 1068: note = Any amino acid
  VARIANT 1069: note = Any amino acid
  VARIANT 1070: note = Any amino acid
  VARIANT 1071: note = Any amino acid
  VARIANT 1072: note = Any amino acid
  VARIANT 1073: note = Any amino acid
  VARIANT 1074: note = Any amino acid
  VARIANT 1075: note = Any amino acid
  VARIANT 1076: note = Any amino acid
  VARIANT 1077: note = Any amino acid
  VARIANT 1078: note = Any amino acid
  VARIANT 1079: note = Any amino acid
  VARIANT 1090: note = Any amino acid
  VARIANT 1091: note = Any amino acid
  VARIANT 1092: note = Any amino acid
  VARIANT 1093: note = Any amino acid
  VARIANT 1105: note = Any amino acid
  VARIANT 1106: note = Any amino acid
  VARIANT 1107: note = Any amino acid
  VARIANT 1108: note = Any amino acid
  VARIANT 1109: note = Any amino acid
  VARIANT 1110: note = Any amino acid
  VARIANT 1111: note = Any amino acid
  VARIANT 1112: note = Any amino acid
  VARIANT 1113: note = Any amino acid
  VARIANT 1114: note = Any amino acid
  VARIANT 1115: note = Any amino acid
  VARIANT 1116: note = Any amino acid
  VARIANT 1117: note = Any amino acid
  VARIANT 1118: note = Any amino acid
  VARIANT 1119: note = Any amino acid
  VARIANT 1120: note = Any amino acid
  VARIANT 1121: note = Any amino acid
  VARIANT 1122: note = Any amino acid
  VARIANT 1123: note = Any amino acid
  VARIANT 1124: note = Any amino acid
  VARIANT 1125: note = Any amino acid
  VARIANT 1126: note = Any amino acid
  VARIANT 1127: note = Any amino acid
  VARIANT 1128: note = Any amino acid
  VARIANT 1129: note = Any amino acid
  VARIANT 1130: note = Any amino acid
  VARIANT 1131: note = Any amino acid
  VARIANT 1141: note = Any amino acid
  VARIANT 1142: note = Any amino acid
  VARIANT 1143: note = Any amino acid
  VARIANT 1144: note = Any amino acid
  VARIANT 1145: note = Any amino acid
  VARIANT 1146: note = Any amino acid
  VARIANT 1147: note = Any amino acid
  VARIANT 1148: note = Any amino acid
  VARIANT 1149: note = Any amino acid
  VARIANT 1150: note = Any amino acid
  VARIANT 1151: note = Any amino acid
  VARIANT 1152: note = Any amino acid
  VARIANT 1153: note = Any amino acid
  VARIANT 1154: note = Any amino acid
  VARIANT 1155: note = Any amino acid
  VARIANT 1156: note = Any amino acid
  VARIANT 1157: note = Any amino acid
  VARIANT 1158: note = Any amino acid
  VARIANT 1159: note = Any amino acid
  VARIANT 1160: note = Any amino acid
  VARIANT 1161: note = Any amino acid
  VARIANT 1162: note = Any amino acid
  VARIANT 1163: note = Any amino acid
  VARIANT 1164: note = Any amino acid
  VARIANT 1165: note = Any amino acid
  VARIANT 1166: note = Any amino acid
MNPLAVHTAAMSNFYGVNATQTTDARKENHIGGQDVFRYTSMIVGLLSLFTIIALNVTNIIYLTESGGTMESIKNSQQSLSGSMKETTGILIEDLKPKTDLINSMVGYNIPTQLSLIYSTIKNDVLKQCTPTFMFNNTICPVAEHPIHSSYFEEINLSSFAACALPNGRVVMNSEVTYTEYPSFIPGSTSPGSCVRLPSFSLSPTIFAYSHTIMGHGCSELDVGDHYFSLGRIADHGHENPVFETITEWFINDKVNRRSCTVAAGQYEGWMGCVIMTETFLDDLSSRDTGRVSITYLDVYGRKREWIYTRSEIRFDQNYASLYFSVGSGVVIGDNVHFLIWGNLYFPIEEPAFCTAPQCRTFNQQQCNQAQRPEAFGGHQMVNGILSFKTTTRGKPVLSVRTFSPKLIPLGTEGRLIHFQNINRTYIYLRSTGWHALPLTGRIIFTVPLNIEWIQQTAVSRPGRSPCGASSRCPQQCVTGVYTDLFPMGPNYEYSMTAFLDSETDRVNPTLAFINTGSIIYRKTLTQSNQKAGYTTTTCFIFKLRIWCLSIVELSPSTITEFEPVPFLYQLDVGCRMSPSGQIMPLSYGERSLSIGPYKPARKECYLEQVGDQYYLIISIPNSIQAYTIRDLDPEKIPHTGLYINDICPVLLNVYTTMSATARMMTAIMVGQWQFRPVNRPGGTRVNLPNKLANATRNEMYSPEDPGHSYYVDRLIDQYNYQTLPEGALVEICLKLNRGNNLTIIQDIQCRVYKYSRVKSNWSIGPTSSPTGITMRDMITQLNKFSTAFSPPLQCNHSFPCXXXXXXSSTIGTTKEPLTRLQHNNSTHTRTAGLNTSHNRLLSTTIKSAHVTNSSKRRDQDSATHSHTSPETPASQTEKHXXXXXXXXXXTKDQTGATGHPAANETSHHPTPRTTTNPDIHHTTPPPGNPQPGNTAPHPEAATKAPTTTPQPRTNHTADAAPQADPPQKLNXXXXXXXXXXXXXXXXXXXXXXXXXXXXNPENNDTPIHPHNDPTRDTTTSPANHNTLDXXXXXXXXXXXXSETTSRSKPAGDTKETEXXXXXXXXXXXXXXXXXXXXXDEGVDKTSTNXXXXAHPTPKQRSQTXXXXXXXXXXXXXXXXXXXXXXXXXXXPGADPGQPPXXXXXXXXXXXXXXXXXXXXXXXXXXTKPEDAKITPDKAESRETSKPNSSIPTKEEERPNSQPLLRGGESQTLRLSNIEDLHIDDTSPSHTSHSEVQPTPKPPSEENPSFELIDVSHNNPKPDESLTKPCYQIDRHCTDNYLSTIGPLIDCYNKTEEVLCRLQTQTIDYMEKNCPGGYLNTSMASILGVAYSEYGDCRRGESLKPGHNYICMINGTSYLADREFICRKPSYKVMTNLTTTKLFHSSQSPFDTVGHLIGKYPFSYQEFIEWAGHYYPRPTEYMCGLGEFCGYTFVFFLSPDFNAYFEPTIYYKSIEKLNRSPIQIYNLCGRVFEVADQLTEPYHNVIVTPLKNKVLILRSLSYNDFADLGGNKTSCDTILQRRAYFSVETSVAKEARKNKGKLEAVTKSPNEKITRMKRATNPSYGATPSYDTFGDLILSALESLWYKRR

SEQ ID NO: 15150 - protein, 499 aa, unidentified; identical to SEQ ID NO: 8808

SEQ ID NO: 15151 - protein, 473 aa, unidentified; identical to SEQ ID NO: 8967

SEQ ID NO: 15152 - protein, 542 aa, unidentified
MKHMMAHIEGTIIFLVVLLIHVSHLFSGTICFNIVPSVMCPHKDGVSLNDWRHLCLGACSPTDIEHGMHRYMILHNALVDYKAYGYRITAERKTLSSHVSFFGSCHISESISPMSAGDVPEGDINEILRHGGAGGVMDHVKTPSCDWIADNHVSGIKLTYQRVSVSVTDDDGKMVVEFPSQSLSGEGLSGRIYSDNTVYVWTLEDKLPKCKKRVVGSTFCKLEGDFILCRGEKSHTILKRIVDCGLNIIVTFGADYALYDDKKALSMDDDKVEKNSVMGKVLDMENIVCHHLCQEAENMMNHDEFLMATPIGDWLSIKAEDHFIFYKCSKTDASLVRPLVVCGAGPMIQLQSANKIYWWNVSSPYINPDSSCNPSSSSSVMRGNVIHTWVGDIFLNDSGVSFAHRFKDATFHPAFRPVKQLFGEGHLHLKDIAAGLKYASSVRVDKKNLEERRISMGESIKDRAVSAFNSAEEWIKSQWPDIKAWIIRIGIWILVISMLILLVWGLFKIMLAIVRRPRNIIRVESREAKGSDTSLVAWAKQK

SEQ ID NO: 15153 - protein, 115 aa, unidentified
YIMKHTKDQVDSLYQKISHDRCNSETRIVNSMMTLALISPLEFAYEYFQSPGYTATVRGEVIHVGKCQPVHVNYTSSIDKCYNELPVTYDGNLAFMLPRTRILSKIGTEVDCSGL

SEQ ID NO: 15154 - protein, 260 aa, unidentified
ALCILLCLSPASAACISTTTVAIPTTQCTLLNGNYTCQTSLNANINLLHLGDTACFRFTNQQGDTIGTLNVLYDLSLYVAPLSPIYYTSDWLGLSCSHKSCRNDHPCSLSDGCPSDSTLLNSVLTPQCVVYPGRTKCESSCGCAGCGCFFCSDACLISRAAFQPVGLPYQVKTIGSVSVYPRLTVEYNFNGTTVSSTSDLFNPLSTPDFTLNLVGSYQAATTSISLGAAAFSSDGASALYYSYSDYNNPQFGVIGDVQSS

SEQ ID NO: 15155 - protein, 372 aa, unidentified
PRMAAALCILLCLSPASAACISTTTVAIPTTQCTLLNGNYTCQTSLNANINLLHLGDTACFRFTNQQGDTIGTLNVLYDLSLYVAPLSPIYYTSDWLGLSCSHKSCRNDHPCSLSDGCPSDSTLLNSVLTPQCVVYPGRTKCESSCGCAGCGCFFCSDACLISRAAFQPVGLPYQVKTIGSVSVYPRLTVEYNFNGTTVSSTSDLFNPLSTPDFTLNLVGSYQAATTSISLGAAAFSSDGASALYYSYSDYNNPQFGVIGDVQSSLINGFSNPPYNFIFPDSSISQITSSSSVDYQFPQSGISRARQTPFPLLKDGIIYTADSERLYGLNPNAPAITVAMSSSHTSFSLVSETVCPKYVSHSISGCYNCPQG

SEQ ID NO: 15156 - protein, 381 aa, unidentified
RMAAALCILLCLSPASAACISTTTVAIPTTQCTLLNGNYTCQTSLNANINLLHLGDTACFRFTNQQGDTIGTLNVLYDLSLYVAPLSPIYYTSDWLGLSCSHKSCRNDHPCSLSDGCPSDSTLLNSVLTPQCVVYPGRTKCESSCGCAGCGCFFCSDACLISRAAFQPVGLPYQVKTIGSVSVYPRLTVEYNFNGTTVSSTSDLFNPLSTPDFTLNLVGSYQAATTSISLGAAAFSSDGASALYYSYSDYNNPQFGVIGDVQSSLINGFSNPPYNFIFPDSSISQITSSSSVDYQFPQSGISRARQTPFPLLKDGIIYTADSERLYGLNPNAPAITVAMSSSHTSFSLVSETVCPKYVSHSISGCYNCPQGFTITFNAFSA

SEQ ID NO: 15157 - protein, 401 aa, unidentified
LCILLCLSPASAACISTTTVAIPTTQCTLLNGNYTCQTSLNANINLLHLGDTACFRFTNQQGDTIGTLNVLYDLSLYVAPLSPIYYTSDWLGLSCSHKSCRNDHPCSLSDGCPSDSTLLNSVLTPQCVVYPGRTKCESSCGCAGCGCFFCSDACLISRAAFQPVGLPYQVKTIGSVSVYPRLTVEYNFNGTTVSSTSDLFNPLSTPDFTLNLVGSYQAATTSISLGAAAFSSDGASALYYSYSDYNNPQFGVIGDVQSSLINGFSNPPYNFIFPDSSISQITSSSSVDYQFPQSGISRARQTPFPLLKDGIIYTADSERLYGLNPNAPAITVAMSSSHTSFSLVSETVCPKYVSHSISGCYNCPQGFTITFNAFSACRPGSVSVVVEGNFLCTTSFVTLNT

SEQ ID NO: 15158 - protein, 455 aa, unidentified
ILLCLSPASAACISTTTVAIPTTQCTLLNGNYTCQTSLNANINLLHLGDTACFRFTNQQGDTIGTLNVLYDLSLYVAPLSPIYYTSDWLGLSCSHKSCRNDHPCSLSDGCPSDSTLLNSVLTPQCVVYPGRTKCESSCGCAGCGCFFCSDACLISRAAFQPVGLPYQVKTIGSVSVYPRLTVEYNFNGTTVSSTSDLFNPLSTPDFTLNLVGSYQAATTSISLGAAAFSSDGASALYYSYSDYNNPQFGVIGDVQSSLINGFSNPPYNFIFPDSSISQITSSSSVDYQFPQSGISRARQTPFPLLKDGIIYTADSERLYGLNPNAPAITVAMSSSHTSFSLVSETVCPKYVSHSISGCYNCPQGFTITFNAFSACRPGSVSVVVEGNFLCTTSFVTLNTTSLPSILYCISQQKQIEGTIKLLGDTEEHFPVLTVLNEAPPLSPNDFQRFYGNFTP

SEQ ID NO: 15159 - protein, 377 aa, unidentified
PDPRMAAALCILLCLSPASAACISTTTVAIPTTQCTLLNGNYTCQTSLNANINLLHLGDTACFRFTNQQGDTIGTLNVLYDLSLYVAPLSPIYYTSDWLGLSCSHKSCRNDHPCSLSDGCPSDSTLLNSVLTPQCVVYPGRTKCESSCGCAGCGCFFCSDACLISRAAFQPVGLPYQVKTIGSVSVYPRLTVEYNFNGTTVSSTSDLFNPLSTPDFTLNLVGSYQAATTSISLGAAAFSSDGASALYYSYSDYNNPQFGVIGDVQSSLINGFSNPPYNFIFPDSSISQITSSSSVDYQFPQSGISRARQTPFPLLKDGIIYTADSERLYGLNPNAPAITVAMSSSHTSFSLVSETVCPKYVSHSISGCYNCPQGFTI

SEQ ID NO: 15160 - protein, 110 aa, unidentified
RCDTVHHGALWISKDRNVKSCYHFQTHWGTLGVSKVRPTTLILHSPHMGFRLLDKACRILFCGQHGVRLSTGEFLLLNLKSSNISLPTFPECGTDAKVSEMNLLGQLDYT

SEQ ID NO: 15161 - protein, 512 aa, unidentified
MGQVIGFFQSIPEIINEAINIALICVSLIAILKGLVNIWRCGLLQLIGFLLLSGRSCAIDVGRNLVLQDVSLNFTHFFGEMPSSCTLNNTHHYFKGPNGTTWGIEMTLTNQSVLNSTSSRRIFTNQFLNVSNCAVNFPKEEMHILSWLLETMHLELMKPGISLHPGLCSNESGLLIQYNITKTKYNSHSIQKVILGLAKLLGSSKRLWYDTCEKADCQFDTLGGIHCNYSNCKVHTTYNYLILKNTTWENHCEYNHLNTIHLLMSSAGQSYISRKLMAFLSWTLSDSEGHDMPGGYCLEQWAVIWAGIKCFGNAAVAKCNQNHDSEFCDMLRLFDYNKNAIKTLRMEVKDKINLMSETINALISDNLLMKNKLRELMNIPYCNYTKFWFINHTRTGTHSLPRCWLVKNGSYLNETEFRNDWLLESDHLFSEILNKEYEERQGKTPLGLIDICFWSTVFYVTTLFMHLIGFPTHRHIVGQGCPLPHRITSSGVCSCGYYNIPNKPTVWSRDTN

SEQ ID NO: 15162 - protein, 478 aa, unidentified
MGALQSISETFVAVVQHMPLIVFLVVFVWFLLMCLRGRWWKVAYLLVLTPKCQSYTFCSGNEFNLCTTVQSTIESKYHIIRVQNQSVITKLLIDSYYFNILTLSNCSGNNDFELISRQIVNLNKSETMGCNGGWRDNNYYDTYNCRNSSTPVNLVYHGPFKSGNSTIGFWTSTKSVSKALETVQLTNLTFKWKHHDYSKHVFDLSQNLTKVECNQQKHNCSIRQSSSGSNYTKCQVLPMSVLKRTKRESSVSLTTTTSVFSLVALDTGYSDSSALWESIIRTQTALEKLELIVANISKNQAIIAGEINIDQTTIKDILIDMKNHGLKLNKAEKFLNNSHLCIMRNEEKDLTHYVRVNHTYTGGSHNHNCKNLILINDSLSGLIHMTHKAHLDAIQSLRMNLLRSYLLTFRWEYPTSIFLVFLGFFFLFFQKRAEMHRHYKKGEEWKCPYPHYPNKKGLCSCGKEFSQTKLIECPIEKH

SEQ ID NO: 15163 - protein, 474 aa, unidentified
MGALQSISEAFVAVVQHLPLIVFIIALTWFCLMGIRGRWYKVVFLIFFTPKCQAYSFCSNNEFNLCTTINSTIETNYHVVNPQNTTILLKFINDGFYFNVVTQSNCTSSSDFYLVKMQAVLLNSTDLPGCLGGWISNTYFDSVRCKNMSDNTNLRLLPGGFTITTREKPVDVERFPLYNLTFKWKHDDFTKNLVENVGNLSKVACTTQKLIESCRNKTSSSGTIRQTCDTSPLPVLTKLRRKRSSEFAVSSTTSVFSLISLDTGYADSSALWENIIRTQKYLNELEKIVANLTDNQMLLNNQVVLDQLTIKEMLDDLKQKGLRLDKAEKAFNNTHLCVMRNESNDLTHYLRIKHMHDNGEYYHDCKNLILVNDSLSGLIDLTKQAHYEAIQSLRMSLIRDYLLTLRWEYPCSLILIILGVILILVQKRAFQHRHYKKGDEWMCPFPHYPNSKGLCSCGKNYEFVKLMDCSIEKY

SEQ ID NO: 15164 - protein, 479 aa, unidentified
MGAFQSITATFVAVVQHLPFIIFLLVLTWFTLMCLRGRWWKVFLVLVMTRKCQAYTYCSDNEFGLCSTVQSTIETKYFVVNIANQTIITKLIDGEYYFNFLTMSNCTSSVDFELVSQNSIIVNADLVPGCKGGWKDNNYFDFFHCRNESQSISLKYHGPFNGIGFWVTTPKKTNATELRHYTNLTFKWRHHEFNKHNLDITQNFTKLFCNQKRNNCRTVETSYSSTTKCDVLPLSVLDSQNYTKRRKRNAEVALTTTTSFISIVALDTGYSDSSELWKNLIRTQESLNILEKIVANLSSNQMILSDQVTIDQSTIENILSDLTEHGLRLNEAEKSFNNSHLCIVRNETHDVNHLLRVTHTYNLTTFYHDCKKLILVNDSLSGVIALTKTVHEEALQGLRNSLLRNYLLTLRWEYPFTLALLLLGAFFIFNQNRANKHMHYKKGEDWKCPYPHYPDRKGHCSCGKIYENVKLMECSIEKY

SEQ ID NO: 15165 - protein, 476 aa, unidentified
MSLLLLFAVALQGIRLTGAFSALSCNQTAEYPSTFQCLQSCEGIKTGEHIGLDILQQNVESIIPVGKCTWVTEERAFTETWTFSRFASETTKSFSPASVHECRGMFNNNCKNRPGCVSGEVPITPLYSWARTEIRRSKYLHIETMNVTTYPYEGKGKILLENKPREVEDLSFSSGDYIYVWDKIDKKAECPWTNNTKTMSCHYQGDKKQHIICPGAGLVFWNITEIKTACKWTIMQDSSGVIFRVVNNASAEWYPAQIESGNEALKTLIEGVRYSLRLRDSVSCYQQCGQLGQGIVFFDGYYYTPNQHKCNVISGCSINRYTYSCNDDKYIWTRCHSKSVWINMETAEIIGNPTCDHDKRKRLSKEDALKMIDRYHNTTKLFSVMNVNIIKDVELKDEEFTEIARVLRTNASVTGFYREDSWIGSMNPMSAIRSFLGVINHEIKVAVFTLIGIYGGWKLYQHFPVRKHKGSLISVI

SEQ ID NO: 15166 - protein, 505 aa, unidentified
MMIVLFFFTTFTYAIGLWEPELGVYWVPTPITPWKAATHNNLICPPPATRISTSLSPSFNYTVPNPRNLMGHMQHDGWLCVSSLYATTCDTNFWGHQTITQSNLPVRMTSAACKKAVREHILGELAPPRYPDPYCYWMASHTQAITQIRVIEHPVTSDLYTETFVNSLFPGTHCAMNPCTTVHPDTMWETTTIIKKDCKILPNSNFTGYKDPRRPDREWVVIDNDSAIYLAGSCHMQYCGQKGLRTASGQWIPYEGPTKYPDCPESWLTRSTEHSNELKVNLEVQEVESRRACIEATQRIRDGAPISFHLLSYFQPRRTGYYHVYRIYKGILQYSKAWYEPLKDLNPSGKYTLGHFPNSSIYKIDPVRADKNGTLSAFNGVHVAPDGTIIVPEVELFKDTYSDTLLYQKARLIDHPATAIQANYTTLVPHYTSTTSFHRPDLTAWGASVWSAFWGKVMLISMAVASVLIIYVAIKCVPWAAITRRRAQPMPAVVTYTPSNSRVNW

SEQ ID NO: 15167 - protein, 506 aa, unidentified
MLTHFTLLLFIPHTFGWEPELGEYWAPIPVTPWRPATKSDFSCPSLRVDPIPPLQLVNNTRMAYLMEGKARKEHPGWLCVRKMYQTTCDTNFWGHQTITHEELALPADQTECRQAIAHYIKGTYEDPRHPDPVCTWMAAEKVYNPNTALLPHSTVVDPFSYTFMDSLFPGTHCKTAPCPTVHPDVLWHTVTPLTEDCPGHTIIPIKIYNDKSARKKTHEWLSVSDGPLIPLGGSCSLTYCGQLGLRTPGGHWYPYPGSKRYPECKDAWRATPTFEGEGMRLDIELQEILARRECINVLQQIQSGAAPTFHMLSHFQPRHAGYYRAYRMKNNVIEYSLALYDPIFNVSVPPQVNFGAWQNGTRYYLPLVESGYPGTLSAFNGIHVMHNKTVVVPELELYKEHYAETLFYYTAQIAEHPSQMRQDNETELTPPTRTTITVKRPSIGGWLSSMWGSVWGKVTSAIGLVLAIFVIGLLIKILPWGRLLRRPSTPAPRTVVYTPATGNVAW

SEQ ID NO: 15168 - protein, 644 aa, unidentified
  VARIANT 67: note = Any amino acid
  VARIANT 68: note = Any amino acid
  VARIANT 69: note = Any amino acid
  VARIANT 70: note = Any amino acid
  VARIANT 71: note = Any amino acid
  VARIANT 72: note = Any amino acid
  VARIANT 73: note = Any amino acid
MLSTCMSFPLLIKTQLPPIRIPQQITMSLVSNPMMTNLVLMILFSVSFSIDTGEFWPMGNTGPVIPXXXXXXXESSGYSPSQIPNPANKNAFNDPGLKAYSASHSDTMYDMVPVYSCNTTDEGFSVSEWYGICKAQCSYSSDTRQTSLSIFQYSQKIDFIPVMGVETFSIVKKSHVSLLGTCMVYVESSTPIVMNVSEFSPYLERILQLGEDTRKTAIEYQTVDDPDCNYWEDIEVSGYKFIIYPDAWGVSADLDGDYVVKNPYTGNYSYLNDSGVFYGSTWHLWNASSIILPSKCPLLLASVEDCRLNPLLGVYHCLDSGVLINTNGVKENVDTCVGKINVSSNGIFYMEGNKSLSLSITGRVYALLGSQSPSYTGITDLLTTISDTVGILEDTYCGTLCDLADRSFQQMIYEEDVVDTANGPWLPVQNGGIMRVVPCRVDTRHTFAIPLSYCANKNMFMIRNLDTGDTNWWNPVYSYFDKSDMCNISSVNPYKQTMDQNLPIKFNFWRGEAVLYPPYTGPLQWSPRVNPNSIRSSKWFPQIKNVSDNIGLTLSFLSDHIVYNVNKTSTQINQNIPYSTVTSSPIVLILVKVWTDIQIVASGIWSFFTGFTKWVYIIGFTFLAIYATKLFLSIFRRTSDPDWM

SEQ ID NO: 15169 - protein, 193 aa, unidentified
PPKTMIKEQTAVGMLSWYDHTVQGYLYKRELYTNYQYYGTALDANSYPMKRWQTFLPDTSELEEWIRTKKCQVGRNLCGESDFWGSWSQECLKSPRDLLTTNPQWVNDEVRHECSGGEWIKFPYHTCLISWSCFIREIDLPVRVLEDGKIYSSFSNGTMFELTKHIYTMEKGAQLYIPTLPLKHQSEVILDCL

SEQ ID NO: 15170 - protein, 542 aa, unidentified
MPNYTLLITLLLSYSYCSGYFPIYTIPDKIGPWSPIDIRDLSCPNNLLVEDEGCNTLSSFSYMELKIGYIKAIKVEGFTCTGVITEAETYTNLIGYVTTTFKRKHFRPTMSGCRDAYRWKITGDPRYEESLHNPYPDSSWLRTVTTSKESLLIISPSVADMDAYDKQLYAPIFPDGKCTNLLPGAFYCSTNHEYTIWMPKDPRLNLACDIFVNSKGKMAMKDGQVCGFIDERGLYKSLKGACKLKLCGISGIRLVDGSWVSIQRKNPPKPCSPGQLVNIHDFRTEEIEHLIVEDLVKKREECLDALETIMSTKTISFRKLSHFRKLVPGFGKAYTLINKTLMEADAHYRSIRNWTEVIPSKGCLRIGGYCHPHYDGIFFNGIILSPQGDVLIPEMQSALLQQHVELLESSVIPLRHPLADPSATLRESNEVEDFVEIHLPAVQKHVSDISLGLPEWKHYFYIIASLLAFLAFAILAAMFCRRFKRRKKPRPNSVELVRRTSVTSVSGRPVHSWESYKTGQQVAPEFVPPPHDTPNSPSRIHT

SEQ ID NO: 15171 - protein, 575 aa, unidentified
MIHSLEETPFKRWVPDLRSDLRKLSRPTINMGYFAIFALCFASLVSSGVHAGFNHSVGPIAVCKKDMLDSRAYVESCFQRCQRPERPSGHGILEIFSAPQNKKGPSVIHCTKVRLSQTFTETWSFSQFSGPLEKALLPLSVKECQDAIREKCPNWNCNVRSPGQLEEEYHYASETTVTKDYLNLVSVPSGLTFYDTEIKVIPMESSASFNLSAEVGTEKDSVYLWKSSEVTSCPYESAVSVGCDVYNGTVDSYVCRGSRISVEGISRVKQLKGLCSDVSRAPSGLLIKFTAKELTSDRADRKVFLTQSASETTIETSLRTQTGDALSVIDEDLCQLQCEILEMNSRLNLGRESLMRLGNRYVLQSKTGFIRECDPLVSCAVTTPHLYCGSPVRVSVSCDERHWMWNPMKSYVEESGVCHAVERHEKLHMLLGSHIYDVGDDLSIQINQSDNVGLPHDLLNIRASTVKMETFDPEALKRSWAYELNNPRVTSQYGNISRNINHWDVMNEMTTGFGRVMRTIGDVFHKTYLFAGIIITLVLVFWGYDTIVKRGWVRNYRRVARSPTRQEPTGEAIWM

SEQ ID NO: 15172 - protein, 661 aa, unidentified
MRTTTRMLTIIICMLFGLYMIMLGENMILAFGPVDGDDDSQENRPFTLHPAHGAIPVLPSSQPSQKVSPDDTNSLIRLTTSEQLWHNHPQDIGPKDVPADMYPIYSCPNLSNAYLLPIWYGSCLDACQITTPKHTVNVKLWTINSSVTDVDGYQIDVYYDTKFSHVGPFGGCSVSLSESVTKEPKQEDIMIWKSRLVSKPVNDVESWIMYDEPSCNYFSDEYSSGFRLVITRTKLKLMIDSVGNLYIADLRPGSYDTYKTGYAIHGSTAWIWDTDDSMNHGMCYFKQTDDTYCDYDNNTKYMFCKMSGVSFDTTVQQRITSSCAGDLNISTDGVIYQIGDSGDTASTQQRLSDILHQNVELGMQSLVSLINDVFINIESSYCTGVCDIMEVIVSNYPTATTVLETPIGPWLPITSDGHTIMTPCMADVNWIIQTPIVYCFSKEMIKVINKDTRKEAWWRIVNSYIILNETCSDTNSTALEILRDRMSKRRDIVYSFWRGDLIVSYPYNKSRWITYKDEKIQRSSKWFDKLVDLKYKHPITLDNITSQLVNHTADLYEWHMGDKNGTAGQTTFSDLLGRVEKAGTNVIKGCVKMTGNLLIWITSHIEMIGDMLIIIVCLIGGYYVLIIPYGFLRRGRGPGTVTEVQQSNSQFRSPLIPRTYL

SEQ ID NO: 15173 - protein, 519 aa, unidentified
MSGYAIVMMILLCSLKTRSEFSHHILPAPIICGEQFPTSEYNELSCMSSCSLENFAGEPFNITLYDQLHDTSIVMAYCKKVRMQQTFTKTWSFSTFASDLSVVPLSPTFDECKMAWDSKCKDSECLVKPDPIVPAYYYAASHEVVQEGIVIEAHKYNTVVKVKAEDQIMIDGEFRQYAKGSLYMQDKMTWVMWNPRAEEKCELAPTVSTQCIFTVKGMLNCDALGIVINASSAVSATVCGQTSGVLIDNLGIVFKFGHFGRNFKTPSFPITRMDSADAIEELIMAVQLSSQVLKSETCVRSCLSHDGTKVLEDSEFFGDRIVSNRSGVLKLCRYQPTCKLILPIRICFGTSLVRVKCGVASYWWSLDTLEADTTYYCASHVAEKERAQLIVNGRALELNSSGIFLSGDVSKSSFYDFVPKNSYTVVSNEGLKETLARKNSFSTSWEKSHSSSKTESYNVFVAAWNGITAFFQHITLILTVSATLIGLIFGYVLLRQIFPPRSATNYKYNQELQTFPIFA

SEQ ID NO: 15174 - protein, 602 aa, unidentified
MKKITFSLALGILLCMTSFNNLIFDILANLMGVQLIMSWVTGDLPSFLGFGITIFLAIQDWAKEVKNKIKRVRGITFSDSTKHLLLITYLIIQLLLLKQITGEEISLHMPKICNVPVASSHLTHASCFRSCDLDGISKNVRNITIYKQDSHQNMLMVECQIIRSSIKATETWTFSQFSNIQPDEVLDPDPAKCWATVRDVCMNSKCETKKPEIVPEYHYASDHIQYVDWAHIKYSMKTIPFSHLGKSYIRIEGNLVEYEKGFYISVTNPKLAYLWEVKTEIECYTEPLHTYQCNQVDKGGSISYLCGRSSLWLKEKGPVAEKFCNHDMSMVIDETGIMYSYTSMPQIVKDGLPIYQSSFNEALRVSTLSARVNNLIQEETECRSNCLNFRAPDEENPSYYGKIMIGRYLQGYYMCYEDPSCKISFPLRVCSNKNLVAIICKSEEMWWDPTKLLAYPMERCNGDVTTRDSVSFLSGGNYYRVNKTGVTEIGGIEIRPQDHHVYSHLGLAFIDTETIKQGLTLPFSPLTANELTKEEKTEVHRWNFGIKAFLSSIDHTVKKVIVLSIGTISILILLIMMINLLSRGSKKSTNKYHQVSYVSTVT

SEQ ID NO: 15175 - protein, 565 aa, unidentified
MGADEAPLKGTCRVLFRTTTLLLLCTLLALSVAVLYEVLITQQYLKNNSGSSNLPSGLSGITDSLANILSVVNQIVYNSAVAIPLQLDTMESTLLTAIKSLQTSDKLEPNCSWGAALINDNRYIHGINQFYFSPTEGQNLTLGPLLNIPSFIPTATTPEGCTRIPSFSLTKTHWCYTHNVILNGCLDHVSSNQFVSMGIIEPTSAGFPSFRTLKTLYLSDGVNRKSCSISTIPGGCMMYCFVSTQSEKDDYLSAAPPEQRIIMMHYNDSIVERIINPPGVLDVWATLTPGTGSGVYYLGWVLFPVYGGVIRGTNLWNSQNNKYFISKMASTLCKQDQATQIANAKNSYYSSWFGDRLIQAGILACPLQRDLTNECLVLPYSNDQVMMGAEGRLYIYGDSLYYYQRGTSWWPMTMLYKLTLTFSNNQPSAITAQNIPTQQVPRPGTGGCSADNRCPGVCLTGVYADAWLLTDPAAVNSFGSQIIFTGSYLNSATQRINPTMYIANNTKILNSQQFGANGQGASYGHTTCFRDTGSVNVYCIYIIEVSSSLLGQFQIVPFVRQINLN

SEQ ID NO: 15176 - protein, 662 aa, unidentified
  VARIANT 292: note = Any amino acid
  VARIANT 308: note = Any amino acid
  VARIANT 309: note = Any amino acid
  VARIANT 310: note = Any amino acid
  VARIANT 311: note = Any amino acid
  VARIANT 312: note = Any amino acid
  VARIANT 313: note = Any amino acid
  VARIANT 314: note = Any amino acid
  VARIANT 631: note = Any amino acid
  VARIANT 632: note = Any amino acid
  VARIANT 633: note = Any amino acid
  VARIANT 634: note = Any amino acid
  VARIANT 635: note = Any amino acid
  VARIANT 636: note = Any amino acid
  VARIANT 637: note = Any amino acid
  VARIANT 638: note = Any amino acid
  VARIANT 639: note = Any amino acid
  VARIANT 640: note = Any amino acid
  VARIANT 641: note = Any amino acid
  VARIANT 642: note = Any amino acid
  VARIANT 643: note = Any amino acid
  VARIANT 644: note = Any amino acid
  VARIANT 645: note = Any amino acid
  VARIANT 646: note = Any amino acid
MALAKKYLMRIFIISHYFLSYNYGFFLPIVKLDIQPENEIIKSPCNGVVKKTEDIHLMSLTLTGQKTASDPMAASKRWAFKEGVLPKTVAFTEGEEAKDCFNISIVDLQGRSLLLEAPSGIKDYPRCKSIHHIQGQNPHAKGNVLHLWGAFFLYDRIASTTMFKDKVFAEGNVAALVINKTVHHQIFKINKIPQNETIGSCNHTYWRSDAGDGFNTTLAVTNLAYVLSANESTKIFKQMQDDLRKRIENMTSSNLTTLSPEAISNSSDANSSATIAYGTSGASISATTRSAXSTLTITTDGQMSPPPXXXXXXXSLKPSTDDIKTPTVLSTTSSSTRSKRSVTVAKQSSANPTGKQRGRGRKGPSTGTLTEEQIERVRMLIQKNVGRVNYNNLPLIAGLTALKKKRQVLETFSGEIELEELIGDEKLDSRFRENLKMILETLRNESYSHFELDIPKTAALKSPEETDPRIHMEYLGSGEEPIQSNGQTDTDCDPSLRIWTPNEEKLAAGVSWIPYFGPGAEGLYTMGLMQNQNDVVCRLRRLANQTAKSLDLLLRVTTEERTYSIINRHAIDFLLARWGGTCRVLGPECCIGVEDLTKNITDQIQQMRRDEQDEYEGWGKGGNWFNSQFGXXXXXXXXXXXXXXXXIALSCVCRLFMNLTVY

SEQ ID NO: 15177 - protein, 589 aa, unidentified
MSSSLLFLLLLVGYASASPPLLLGRISDTIKGSGDDIGEADLYPLYECGKQDVGVPVTSWYGACRGACSMTHNTTDASLEVFFRNDSVGWIDVLSLQTTPITKSSHVTWYGECEKTTDVGSSMPAPADIIDRITPLLIEGLQTWPYGGAIHVHDTIGHPECKYTSDGAISGWRVLISKRTIELKSDIAGEGYIVDPDLGYVFPVADGKGRGRYWWVWAPSNIPHQGCYFKSAGEANCTLLMDTYTYSCPNLNVAFSARVGTHLSDTCVGDVNISTDGITYKILSHKHVGSISNQLIELWHQSQEALTQQLIIVINDALGKIETSYCESTCDLTEMIVSQNSERPMVIETPVGPWLPSSKNGGLSVVPCQSEPGLVVITPVETCLSPFLLKVKSMKSGDTFWWNPIDSHVSPETLCLGHDEDEIYLRSQTRKPLMFEFWKGAYIIDYPYNTTGHWLSNPGGHIHRSSKWFPSISSLIYTVPINLPMITKGVDHKVKQVMSTVGDLGNTTSSPWYGWLIPITKKTARLVGNVSMSILIWWRELESEVKNSIIFISLIILGLLISLPILRYLFSSRPSYTPVKNTISWSGPK

SEQ ID NO: 15178 - protein, 567 aa, unidentified
MAWYRYLLLSVCIMTLSATTTGRRGATESSIQTKKRSVGPVADCTGEIQDIGIALKNCYALCEGYEEPKQGVSVDIYTSDAKGPGVTSCSKIRLSQTYTKTWTFSTIDGEIRREVLPVTIDECKKEKETKCPLGNCDTRGPNRLEPEYHYASDTIVSATILELFTAESVIFFDNGKEMITPMGTTIKVESQAGVAQYDNKVFLWDKIETMTSCPYKSVGIYGCDQFDEGDEMFYACAGGGITVTPLKKREPIHKKLCPNTFVSEEGFLYGLNTDNPKGSKTGRLAINVVSDTAETADAAYLRHKIQLIATKLDSDLCYTQCEVMSLESRASNKTSHLMRIGHKNYLAYSNGSASECYPLHGCRLAQPSVFCGSPTRVGLVCNGISRLWNPLHPYLISGRVCPRPGEVENLTFSLGSTMYNVDNKLEIEVPKSELHGVYQSEFLRYHNSRSTLNVVELDTMGNEWRGSKEFRHEIKQATNRVINAPHVSVGSWVMSSFSSVGAVIHSIEAILGLGLVVIVLIATISMMMKIYNVMGGPKRAERRLRTLNAMEAPEYQLVEQPRMSWME

SEQ ID NO: 15179 - protein, 591 aa, unidentified
  VARIANT 492: note = Any amino acid
  VARIANT 493: note = Any amino acid
  VARIANT 494: note = Any amino acid
  VARIANT 495: note = Any amino acid
  VARIANT 496: note = Any amino acid
  VARIANT 497: note = Any amino acid
  VARIANT 498: note = Any amino acid
  VARIANT 499: note = Any amino acid
MISNMFFLFQLSLFLQFIAGDESLETITAPETPDPILLKGDTKYLFLVPSSVKNWKPADLNELTCPPLISKPDTSEMTYFSTDVMELQKHHELAPVEGYLCSGLRYKVICSEGFFGQKTIAKKIENIEPDSKQCLDDLSKFKNDDYLLPYFPSEDCNWMKETPTHKDFIVFQKHFVKYDPYNNGFYDPLLKKDYCDTQVCETEHDQTIWITEKSIENECIFNYPIKKHIFHTADFGKMIIDYELNQWTSVEDGCLINYCGREGIRLSNGMFFVGKFYKNLNNLQTCSAGTKVSYKPLTSKLEEIENEIILDQERLLCLDSIRQMTATKKLSFYSLSFLEPKSSSRHKVFRIHNKTLEYTETEWHPIMSFNFDEPNKIGIDKNGKSVYWNEWVPSGISGLLSGFNGVYKKENETKVTIARLETIKEDYDREMMIDHELVEVEHPKIVHLKRENITGSRVEIVNKEHSDVSGWLSSVLSSFWGKIMMTIISIIXXXXXXXXLINCCPIICKSCIKRYKTKEESRNRHRLDREDNGRLRRQHRVIFNNQSNDEENAIEMVEYTDTPRPLRPIPDATTSDTESRSPTTAHSFFNR

SEQ ID NO: 15180 - protein, 592 aa, unidentified
MATFNIIFVLISFWTTLGISDESPHITVTAPETPDPILLQGDKTYLFLVPSESKNWKPADLNELSCPPLISKPDTAEMEYMSTDVMELQKHHELAPVQGYLCSGLRYKVICSEGFFGQKTITKKIENLEPDQNKCVQDLEKFINDDYLLPYFPSEDCNWMKETPVHQDFIVYQKHQVKYDPYHNGFYDALFKKDFCQEKICETEHDQTIWITNQELKQECTFNYPVKKHVFYKRDYSKMIIDYEINQWTSVEDGCLIRYCGQEGIRLSNGMFFVGKFYKLISNLPICPEGTKISYKPIKAQLDEIENEIILNQERLLCLDSIRQMTASKKLSFYSLSFLEPKSMSRHKVYRIHNNTLEYTETEWEPIVAFNFNGKNQIGVNKEGKEVYWNEWVPSGKDGLLSGFNGVYKKVNSSKISISRLETIKEDYEREMMIDHELVTVEHPKIVHLKRENITGSRVEIVNTEHSDVSGWFSSVLKSFWGKLMMTVVSIIIIIIIGLLIINCGPIICKTCISSYKKKKSRRDRFRADRETETGLRRQHRVVFHNNETDDERAIEMMEYSDTPRTLRPIPDSLPEPQEETTRNMSHSFFNR

SEQ ID NO: 15181 - protein, 551 aa, unidentified
MAFFRICFLLSFLVILESLGNLSAAELEKSVGPVAICGGELRPASDIIKSCHQRCVMDPEPGDRATLKLYKVSDNLVGPSVIECAKVKQTQVFTLTWSWSYIKSPIMHEMLPVTKSECEDAIKVNCPDKHCNHREPDVLEEEYHYASDTIKTKTTVALLTTPSSLMLDADQTKISPLSSKRFVLAADGAMKEDGKIYLWDSDFKLTSCPYKPVNTYGCDTYQDPDKRNYYICSGGRFIITAPDTAETAFSGWCGGLRRSKEGFLYEKTRPSEDSHEFARLSISQQAGAAAGVDYLRHKVQQVATHLDAEICQNQCELFALEARVSGKTSTIARIGLNYYKLFQNNTVAECKTLHGCKMTSPRVYCGNPPRIGVTCTEANGLWDPTSVELGTGGVCLKPDEGEQLIVSLGSDHYVVDESLKIRINSTSHHGIYMTSFSDFHQSDMQWRVVDLDTLKPEWDRQKAAPSGLSRSTETNTTLNTPSFALGKSVLGIWNSVTEEISSVEHILGTVIISALCLCTALVFYRVFLRKSVPNYNAVAQRQQDSTGSSWI

SEQ ID NO: 15182 - protein, 415 aa, unidentified
YKLTTPYMARCSRCAVGSCHSPIAIESVRSDGHDGYVRLQTSSQYGLDSSGNLKGRTMRYYMHGKIEEIPLHEVTLRTSQPCHIVDGHGYFLLARCPPGDSVTMEFKKESVLHSCTVPYEVKFTPAGRELYSQPPEHGVEQPCHVYAHDAMVRGSYVEMHMPGSEVDSSLLSMSGSSVKVTPPAGMSVFVDCKCSSGQITETVNSEKTYSQCTQTGQCRAYRLQSTKWVYNSDKLPRAAGDTLKGKLHVPYLLTEAKCTVPLAPEPVVKYGFRSVSLKLHPKHPTYLTTRHLTGDPGYTHELISEPTVKNFTITEQGWEYVWGNHPPKRLWAQETAPGDPHGLPHELVTHYYHRYPLTTSIGVSICVSIVVISCAASTWLFCKSRNTCLTPYRLTPNAQLPLCVAVLCCARTARA

SEQ ID NO: 15183 - protein, 393 aa, unidentified
VQGYLYKRELYTNYQYYGTALDANSYPMKRWQTFLPDTSELEEWIRTKKCQVGRNLCGESDFWGSWSQECLKSPRDLLTTNPQWVNDEVRHECSGGEWIKFPYHTCLISWSCFIREIDLPVRVLEDGKIYSSFSNGTMFELTKHIYTMEKGAQLYIPTLPLKHQSEVILDCLGSENSGGLKCILRSGPKELIGGVYSGNSTYVANRHSNILVNLTSLNMTASERVIISDKSASLSDLYEVDSLVREVSLRSDLNDFELTKGLTELTGVVTRLIENLSQKDPLLLSKVLQGEELYRTVYTSGGLFTKCLIARPYKPVSEFCVPQGLTMQSGIPVPWDGKSVCLKPNAEVTPIVLLHEIHEIEGLEKGVSIEGASFQWSIYEFIELERLNMEESM

SEQ ID NO: 15184 - protein, 538 aa, unidentified
  VARIANT 491: note = Any amino acid
  VARIANT 492: note = Any amino acid
  VARIANT 493: note = Any amino acid
  VARIANT 494: note = Any amino acid
  VARIANT 495: note = Any amino acid
  VARIANT 496: note = Any amino acid
  VARIANT 497: note = Any amino acid
  VARIANT 498: note = Any amino acid
  VARIANT 499: note = Any amino acid
  VARIANT 500: note = Any amino acid
  VARIANT 501: note = Any amino acid
  VARIANT 502: note = Any amino acid
  VARIANT 503: note = Any amino acid
  VARIANT 504: note = Any amino acid
MSLSCALIYLSSLFIIRGITGMDIVPNTVCSHLGGIHHEEFQHLCLGACESSSSTPDMTKYLVMMSSTDGFKAYGYKITLKRRTVSSHTSFFGECQISASVVDAEPGVAGPSLIKEIIAHGGPGGSMDFTREPSCNYFMDHEVSGILVDYHRSLMEVKDSPKNGYDVTFLESGAQGSGLSGHLYSGNILFAWDITDQIPKCKFRVVGSTMCKITDDLVKCKGEEMKNVESLPVDCGIQIHKLNDGTYIGESPSRLETLPSSLETSIYGLYQRVNDIEGILCQHLCQEVEADGIMQHNEFLMTTPIGNWLSVKADDHRMMYQCVSIVSTITTPPVICGSGPLVQVMMGNKPVWWNVSSPYINPDTSCIPGLSTEMIVDGRIKTWLGEVKLGDNGYTFVGRYTDVHYHPAFRPSQGMSLVKRDDLTPLVHGLVAASKVTYVKHNLAEHSSSMGSSILRSVVGAFDAAVGWVQGLWPSLKAWVIKLILWTILIXXXXXXXXXXXXXXKLVIKRRLSPNPVIIHQATPNGENTSLMEWAKQK

SEQ ID NO: 15185 - protein, 616 aa, unidentified
QIATANEDIFAPFKNEIQASNPIYEAAKRTGYGSNSLQPYYICDNASSGGALPLNAWHYSCKQACVEQHQKIEVQIRRAHWHYVGKDVPTYKVSTNQVCYTSHENIWGYCSHTQTITPVATVPDDRSKIPKEYLTEESSMRGVTSIINSGHAGCEYLSDNTKCARDYVITYRPGKTSKRSMDDPYYLNIYGDGIRVDPTSGSLFQNEVAWFWNPKGIEETHACGWEYEDPTVCYITNTSEIMSCPDLGYQYNIKNLVSTKTCIGEVYDIDGPAPFIYNSQINIDNRTHLSDEASKGKGDADINMIKGVNFALDRIEEAYCSSSCDLFSRGHPQDDDHVLDTPIGNWRLAGADSYIPLLVPCQPTAVWRVKSPTSMCHGKNHILVEDAKTHHTCSWDATKDYITVGDMCMDNNEQANQDHKTMRKLMSENQNITIDFWTGDTMLMRPPYDKVEWMNKSRIISANPSWFSKVELNKGMLHNTADLSHILTTMAVDMKQEISYNKTADRTIRTLFFDELTSGIGGVVSKVGSWLSSILYSLPKVALMVIGVVAVLLLLKQSFTYYIIKRERDITRRSVHFLEPEEAAEFVHKHVDPSAPSRRHGSRSRRLAKSLIEMGI

SEQ ID NO: 15186 - protein, 891 aa, unidentified
VCTSVNAIRVKGVCYIPDMSTVSTDVVVGGYPWTEWSGIFTSSTKAIFELFSFYQNHPKVGSGQYLSAVSDSANIGHFSVNGKCSDMYYHSGKLMCMGSNVVNIKMVEYTTFHRPLMSPPSCSTYPNNSLVCHFSDPTEVTRCTHDPYLTRKQDNCSTTIIKKMDHTVDEAAGLTVKTPQVVFHLQRGFDGCKGTCFFASIIEVGYRCSWCLAIIVIAAGIGYIALIVHLLVILICFINGYTIGRLLRLLGLRSLFRCPLTTACSICGMYSYSANEAAKHKLFCSSTQCPYCITLDESNNLCILEFPTRANHREHMKLHKMVRINPYLGVIRMKRYRVATFFLVQLALAGLSGVNAQYFPAETGLRSNAVGLNISIPADSVECSDKGCKVIKDYNAHIPLVDGSSIIMRTKVDGKAFAKKITVENPNMDVTCDYLYTSSEVVVGPRRIVYTCSGKTECTEKTEIDLLTKPIANRGATDDFIPIDTENPLKSLYCPKATSCRSPIIDFMWIPAGCFTVNDGTAIGYEYYMPSIKKEMVHVFRCTVRNIKYKICEGALCKKIDGSSSDLEQGVLKFEHISSKLPIQFMVGAMSRQGDDKPSHIFHGVPDLRTDGSNTNFAYRMTMIPQGETCMEGTSYYGGKCDINTDGSSPALNCKSTLPKIDSDTLIKNYESLHEVYHCNFENSMLRWNTKVVPREITVNKKTTKDTQTVSWPSLNLTSINCNFGFTDINLLTFGHTTMEIVRYTGAITKVVCTGSYNRNGMTQLEFNIKEHSGMLELHCPMLFSETCLFDTVKTNKCNITTLLPFNSTCLYNGQSINIDCSKLELSSADPLSGNIVGWTGSQSKDTWISGFKIGLSNWWYITMIAVGTTSILIFMLWLVITIVNNCKTMK

SEQ ID NO: 15187 - protein, 285 aa, unidentified; identical to SEQ ID NO: 8156

SEQ ID NO: 15188 - protein, 293 aa, unidentified; identical to SEQ ID NO: 8158

SEQ ID NO: 15189 - protein, 406 aa, unidentified
SAACISTTTVAIPTTQCTLLNGNYTCQTSLNANINLLHLGDTACFRFTNQQGDTIGTLNVLYDLSLYVAPLSPIYYTSDWLGLSCSHKSCRNDHPCSLSDGCPSDSTLLNSVLTPQCVVYPGRTKCESSCGCAGCGCFFCSDACLISRAAFQPVGLPYQVKTIGSVSVYPRLTVEYNFNGTTVSSTSDLFNPLSTPDFTLNLVGSYQAATTSISLGAAAFSSDGASALYYSYSDYNNPQFGVIGDVQSSLINGFSNPPYNFIFPDSSISQITSSSSVDYQFPQSGISRARQTPFPLLKDGIIYTADSERLYGLNPNAPAITVAMSSSHTSFSLVSETVCPKYVSHSISGCYNCPQGFTITFNAFSACRPGSVSVVVEGNFLCTTSFVTLNTTSLPSILYCISQQKQ

SEQ ID NO: 15190 - protein, 386 aa, unidentified
AALCILLCLSPASAACISTTTVAIPTTQCTLLNGNYTCQTSLNANINLLHLGDTACFRFTNQQGDTIGTLNVLYDLSLYVAPLSPIYYTSDWLGLSCSHKSCRNDHPCSLSDGCPSDSTLLNSVLTPQCVVYPGRTKCESSCGCAGCGCFFCSDACLISRAAFQPVGLPYQVKTIGSVSVYPRLTVEYNFNGTTVSSTSDLFNPLSTPDFTLNLVGSYQAATTSISLGAAAFSSDGASALYYSYSDYNNPQFGVIGDVQSSLINGFSNPPYNFIFPDSSISQITSSSSVDYQFPQSGISRARQTPFPLLKDGIIYTADSERLYGLNPNAPAITVAMSSSHTSFSLVSETVCPKYVSHSISGCYNCPQGFTITFNAFSACRPGSVSV

SEQ ID NO: 15191 - protein, 337 aa, unidentified; identical to SEQ ID NO: 8339

SEQ ID NO: 15192 - protein, 609 aa, unidentified
FVLCVLVAIGGQTWGLVGYDCTSSVANITTISLFSVLPCELDQKPQSEYLSVIQVVQQRSVSRVHTFSCLVIRSSVIHHCGMHHHTSVGPMSIGEIMHTSNTQCADLHHFGKLAVGSGTLLTGFKVNETVQISITEHGYSDSEFKCRGTSFSHNGIAYHDAVMKSSYTVTLREEWASLDLDTGDLKMSTGYMHPFKTGQSFDASAGDVFWSTQDNQDCTPTSYLVLHEGAGIIYQGHRDTKTLVVNSSTHAMAVGILGPTLVCHQPALRTEHPKIFIVMKHPGSPSFFFKKSIVDPANVDMFLYINSKLVYLERHMGYQMSLVYEHFHKRTCNIKHQLLRHLIAIAVMNPEEFAWLYSKRPGVTAILRGELIYLMECQAVPVTIRKPSGRCYNELPVTFNNTPMFIKPRSRILVHYGSEIDCSPIVPAGFMIEGRWWALRPDSTQLPAPTTLSAEPEEGKWSYTSPHDLFKSGIYTLEELLAFQKRLLFSFEKPAISHTLSSAAARQPADLSGIDGAGLFHPGQLEEIQKNFMSKIWGWYWNVSVVLGGLVGIYMVFQLIKSVINSIITCTCLYRAYGCGVEILTCCFSSCAKYLLLKRHTDPDFRGGT

SEQ ID NO: 15193 - protein, 634 aa, unidentified
MYNFQFILFITVSVYTLHSVYGIIGYDCSAQETNITRISLTKIGVCDNARQNITSENKKIKLVQLRDIDSTEVFSCLVELIHHYNRCGPTLDTFYGIVLSTEIIRLTRKDCILLVRTGKVDFAPYGYKLGMEGLMSNYPNTQVSITRGSNQDGSCTEGDPLTVRGIYMDKPYVVTNFKVLYKTTNAFVDLTNGQMELRDGQICQFTSGECFSPTLGNCFWDTQVEGQICNKERPLSVLYTGKAVYTKEITDNEVIKMYTYTAGESEFAITVSGKKKFCNLITVVMSEHPRLLIIEEEEWDSLGTVTTMKDKEVDLSTFVNTKLIFMLNHIRKENNDFAEKVARDRCLDRAEGIRTSIGLAYGSPNHFAYNYYKGPGYTGKLAGDTIFMVKCKPVSVYHKGVQNKCYQELPVVYDNKTMFLQPRTKLLSHVGTETECNSLFPITWEIDGNWFAGGSESLIPIEEPQLLQPDVPERWHFTMPKGFLKAGTYSQDALSDFRRTLMMPDSTNAAMNNIARNSLTWDNNGRLVSSVANSFSEEDLSTLQNRMGNFLINAFRWLESFGSFCAGFWVIWCLFKMLVELFLNINIIRLTGRPKIDYLLSPWARVFDYVENRRVVKANRQNANTDAEMGDLCG

SEQ ID NO: 15194 - protein, 931 aa, unidentified
VYYAIRVYGPLLADIKFFGYVVDTIAFDNNVCTSVNAIRVKGVCYIPDMSTVSTDVVVGGYPWTEWSGIFTSSTKAIFELFSFYQNHPKVGSGQYLSAVSDSANIGHFSVNGKCSDMYYHSGKLMCMGSNVVNIKMVEYTTFHRPLMSPPSCSTYPNNSLVCHFSDPTEVTRCTHDPYLTRKQDNCSTTIIKKMDHTVDEAAGLTVKTPQVVFHLQRGFDGCKGTCFFASIIEVGYRCSWCLAIIVIAAGIGYIALIVHLLVILICFINGYTIGRLLRLLGLRSLFRCPLTTACSICGMYSYSANEAAKHKLFCSSTQCPYCITLDESNNLCILEFPTRANHREHMKLHKMVRINPYLGVIRMKRYRVATFFLVQLALAGLSGVNAQYFPAETGLRSNAVGLNISIPADSVECSDKGCKVIKDYNAHIPLVDGSSIIMRTKVDGKAFAKKITVENPNMDVTCDYLYTSSEVVVGPRRIVYTCSGKTECTEKTEIDLLTKPIANRGATDDFIPIDTENPLKSLYCPKATSCRSPIIDFMWIPAGCFTVNDGTAIGYEYYMPSIKKEMVHVFRCTVRNIKYKICEGALCKKIDGSSSDLEQGVLKFEHISSKLPIQFMVGAMSRQGDDKPSHIFHGVPDLRTDGSNTNFAYRMTMIPQGETCMEGTSYYGGKCDINTDGSSPALNCKSTLPKIDSDTLIKNYESLHEVYHCNFENSMLRWNTKVVPREITVNKKTTKDTQTVSWPSLNLTSINCNFGFTDINLLTFGHTTMEIVRYTGAITKVVCTGSYNRNGMTQLEFNIKEHSGMLELHCPMLFSETCLFDTVKTNKCNITTLLPFNSTCLYNGQSINIDCSKLELSSADPLSGNIVGWTGSQSKDTWISGFKIGLSNWWYITMIAVGTTSILIFMLWLVITIVNNCKTMKLAMTYSKVQE

SEQ ID NO: 15195 - protein, 904 aa, unidentified
FGYVVDTIAFDNNVCTSVNAIRVKGVCYIPDMSTVSTDVVVGGYPWTEWSGIFTSSTKAIFELFSFYQNHPKVGSGQYLSAVSDSANIGHFSVNGKCSDMYYHSGKLMCMGSNVVNIKMVEYTTFHRPLMSPPSCSTYPNNSLVCHFSDPTEVTRCTHDPYLTRKQDNCSTTIIKKMDHTVDEAAGLTVKTPQVVFHLQRGFDGCKGTCFFASIIEVGYRCSWCLAIIVIAAGIGYIALIVHLLVILICFINGYTIGRLLRLLGLRSLFRCPLTTACSICGMYSYSANEAAKHKLFCSSTQCPYCITLDESNNLCILEFPTRANHREHMKLHKMVRINPYLGVIRMKRYRVATFFLVQLALAGLSGVNAQYFPAETGLRSNAVGLNISIPADSVECSDKGCKVIKDYNAHIPLVDGSSIIMRTKVDGKAFAKKITVENPNMDVTCDYLYTSSEVVVGPRRIVYTCSGKTECTEKTEIDLLTKPIANRGATDDFIPIDTENPLKSLYCPKATSCRSPIIDFMWIPAGCFTVNDGTAIGYEYYMPSIKKEMVHVFRCTVRNIKYKICEGALCKKIDGSSSDLEQGVLKFEHISSKLPIQFMVGAMSRQGDDKPSHIFHGVPDLRTDGSNTNFAYRMTMIPQGETCMEGTSYYGGKCDINTDGSSPALNCKSTLPKIDSDTLIKNYESLHEVYHCNFENSMLRWNTKVVPREITVNKKTTKDTQTVSWPSLNLTSINCNFGFTDINLLTFGHTTMEIVRYTGAITKVVCTGSYNRNGMTQLEFNIKEHSGMLELHCPMLFSETCLFDTVKTNKCNITTLLPFNSTCLYNGQSINIDCSKLELSSADPLSGNIVGWTGSQSKDTWISGFKIGLSNWWYITMIAVGTTSILIFMLWLVITIVNNCKTMK

SEQ ID NO: 15196 - protein, 854 aa, unidentified
  VARIANT 635: note = Any amino acid
  VARIANT 636: note = Any amino acid
  VARIANT 637: note = Any amino acid
  VARIANT 638: note = Any amino acid
  VARIANT 639: note = Any amino acid
  VARIANT 640: note = Any amino acid
  VARIANT 660: note = Any amino acid
  VARIANT 661: note = Any amino acid
  VARIANT 662: note = Any amino acid
  VARIANT 663: note = Any amino acid
  VARIANT 664: note = Any amino acid
  VARIANT 665: note = Any amino acid
  VARIANT 666: note = Any amino acid
  VARIANT 667: note = Any amino acid
  VARIANT 668: note = Any amino acid
  VARIANT 669: note = Any amino acid
  VARIANT 670: note = Any amino acid
  VARIANT 671: note = Any amino acid
  VARIANT 672: note = Any amino acid
  VARIANT 673: note = Any amino acid
  VARIANT 674: note = Any amino acid
  VARIANT 675: note = Any amino acid
  VARIANT 676: note = Any amino acid
  VARIANT 677: note = Any amino acid
  VARIANT 678: note = Any amino acid
MADYYKTGGIITPVKKPTEEERNHKSNVLAYTSLILGILSVIVLILLNITNITMTIKKDSINGALNSKPIMTETQGNKISDLIESDLIPKTNLINNMVSYQIPTSLTQIYSLIKRDVLQACTPKFDHEGSQCPVNSNPFHSGSFSLINRNTFSRCPDPNNNLGMRESIKLMDYPSFIPGPTRPGGCSRDPSFDLGNKIFAYTHNVVPQGCGYTEMTMQYFNIGRVTDVNADMPFFEILTQWYLDDGLNRKSCTVVTSDEGAWILCIVTSESEEKDYADQGIGRVFIGYMDIYGRKKSWYLDEPEIQFDLPMAAMYFSGGSGVSDEGKIYVLIYGGLMTAVSGDVFCDAPGCDNPSQDMCKKASMPKSRSQRQMVNGLFIFDDNPLEAPKPIVKLIPPSQNWVGSRGRLYKSDYPKIFFLYISSDSWHSLPKIGIIAVGDQTYLHWVENVAVSRPGPENCMYGNRCPQECLGAPYTDIFPLDSNFEIGISVTLKSYQVNKNPVITLVTQNKIISETEVTNDHHGAQYTTTSCFKYARSLWCLSIVAFEPATVGERAPVPLLYKVPVYCKASGTRLTIPIPYFSNGSRPIVVLTNELYPPEVPKFQTQDDFNKLQLSPYHFERPGTTGPPSTTSKLXXXXXXHVDTSTQVIKQVTPTTLSEXXXXXXXXXXXXXXXXXXXLTTVKTIDENTTRITAQHHDTTQRSTITTLNKTAQTTEGTGQHQITTHNITRRDTTPNTDGHSISTARQPNIQSHTAKDENTPDIYNNVRRIGIQRETKTSRSRDRRPKKQKLDDYASKDQHNTFEDQGLWDKISSYLLPIQSDYYGIEDPELDSIDLFDYRHVTSSSHNRVMIYQ

SEQ ID NO: 15197 - protein, 810 aa, unidentified
  VARIANT 704: note = Any amino acid
  VARIANT 705: note = Any amino acid
  VARIANT 706: note = Any amino acid
  VARIANT 707: note = Any amino acid
  VARIANT 708: note = Any amino acid
  VARIANT 709: note = Any amino acid
  VARIANT 710: note = Any amino acid
  VARIANT 711: note = Any amino acid
  VARIANT 712: note = Any amino acid
  VARIANT 713: note = Any amino acid
  VARIANT 714: note = Any amino acid
  VARIANT 715: note = Any amino acid
  VARIANT 716: note = Any amino acid
  VARIANT 717: note = Any amino acid
  VARIANT 718: note = Any amino acid
  VARIANT 719: note = Any amino acid
  VARIANT 720: note = Any amino acid
  VARIANT 721: note = Any amino acid
  VARIANT 722: note = Any amino acid
  VARIANT 723: note = Any amino acid
  VARIANT 724: note = Any amino acid
  VARIANT 725: note = Any amino acid
  VARIANT 726: note = Any amino acid
  VARIANT 727: note = Any amino acid
  VARIANT 728: note = Any amino acid
  VARIANT 729: note = Any amino acid
  VARIANT 730: note = Any amino acid
  VARIANT 731: note = Any amino acid
  VARIANT 732: note = Any amino acid
  VARIANT 733: note = Any amino acid
  VARIANT 734: note = Any amino acid
  VARIANT 735: note = Any amino acid
  VARIANT 736: note = Any amino acid
  VARIANT 737: note = Any amino acid
  VARIANT 738: note = Any amino acid
  VARIANT 739: note = Any amino acid
  VARIANT 740: note = Any amino acid
  VARIANT 741: note = Any amino acid
  VARIANT 742: note = Any amino acid
  VARIANT 743: note = Any amino acid
  VARIANT 744: note = Any amino acid
  VARIANT 745: note = Any amino acid
  VARIANT 746: note = Any amino acid
  VARIANT 747: note = Any amino acid
  VARIANT 748: note = Any amino acid
  VARIANT 749: note = Any amino acid
  VARIANT 750: note = Any amino acid
  VARIANT 751: note = Any amino acid
  VARIANT 752: note = Any amino acid
  VARIANT 753: note = Any amino acid
  VARIANT 754: note = Any amino acid
  VARIANT 755: note = Any amino acid
  VARIANT 756: note = Any amino acid
  VARIANT 757: note = Any amino acid
  VARIANT 758: note = Any amino acid
  VARIANT 759: note = Any amino acid
  VARIANT 760: note = Any amino acid
  VARIANT 761: note = Any amino acid
  VARIANT 762: note = Any amino acid
  VARIANT 763: note = Any amino acid
  VARIANT 764: note = Any amino acid
  VARIANT 765: note = Any amino acid
  VARIANT 766: note = Any amino acid
  VARIANT 767: note = Any amino acid
  VARIANT 768: note = Any amino acid
MIMNPINTQMTNYYGVGGNKDREAIQTSSTNSTCHSALTYTSMIVGLLSLFTLIALNVTNITYLIGSGGSMNAIKEKQESLGALVRDSVSLTTEEIKPKVDLINNIVSYSIPSQLTQIQHTIKNEVLRQCGPSFVYNNTVCPVVENPSHSQHFKMINPYTISECANTGSFIQVKSHISFIDYPSFIPGSTRKGGCVRIPSFSLSDTIFAYAHNIIAQGCQDSSQSDQYLSIGRIEDHGTDIPVIETIAEWYLNDGLNRKSCSVASGDTYAIMGCTIVTSDERTDYLNPGIGRLSITYLDVFGRKKEWIFTQEEIELDREYLALYFSVGSGVIIDDEIYFLVYGDLAEPMPGNVFCHAPGCAAVNQDVCNAATKPNWFGRHQIVNGILSFTADFESRPRLRVRTIPPSKTWLGAEGRLMYSTVARKTYIYVRSTGWHALAQTGIIDLTGDLSIQWVDQLVLSRPGTSGCPAANRCPKECVTGVYTDAFPLGVNYDVSVSVVLATQSTRSNPRLMVVNGTNIIYVKTVTSASQKASYTTTTCFVFKMRIWCLSIIELSPGAVGEFVPVPFLYQLNLGCVDKDTGVTEQLSSYSGKDTYTLTPYETPKTECYLELSGDDMYFAVKVFGNHQSYRLTWKAQAKTTEDIATVSQLCHEVLKYMTDRGDVFNNNTVVDTEHVTLTPVTLSAGTRVTLTKTDSTPVANETXXXXXXXXXXXXXXXXXXXXXXXXXXXXXXXXXXXXXXXXXXXXXXXXXXXXXXXXXXXXXXXXXSVVTHGQLNNTLNATGSWRLRYSNLFERGYSEMMKWWGNNGD

SEQ ID NO: 15198 - protein, 533 aa, unidentified
MTRYLLSILTISFLPLIIGTGCTNILPSTLCDHKEGVSLNDWRHLCLGACSPTDIQPGTHRYMIMHNTLMDYRTYGYRISAEKRTLSSHVSFFGSCHISESTVPMDAGAVTGGDIQEVLAHGGAGGVMDHVRPPSCDWMADNHVSGIRLTYQRVAISITEDNGKIEVEFPSQSLQGEGISGRIYSDNTLYAWDLEGKLPTCRRRAVGSTFCRVSSEFIACRGEKPHPIIRNMTDCGIKMMVTYGADYALYDEEKAKSVEDVKEENSAVLGKVLDMENIVCHHLCQEAETVMNHDEFLMATPIGKWLSVKAEDHFIFYKCVDIDAALVRPVVVCGSGPMIQITTINGIYWWNVSSPYINPSATCNPATSSSIMRGNVIRTWVGDLILNGSDVSFAHRFRDAAFHPAFRPVPQLFSEHHLHMSEIAAGLKYASTIQVKKENTEERRISMGESIGDRAVGAVEAAEEWVKSKWPDIKAWIIRIGLWVAAIMAVLIVLWCLFKLIIAILTRPRNVIRVENRESKGSDTSLVAWAKQK

SEQ ID NO: 15199 - protein, 293 aa, unidentified; identical to SEQ ID NO: 8158

SEQ ID NO: 15200 - protein, 64 aa, unidentified
WYQEQANPNIIDKNPDHLSYYWYNGVMRREDKFTYPSRYILQTLKKIYTDTERESRISFFKFRL

SEQ ID NO: 15201 - protein, 728 aa, unidentified
MLLDFITHPILLILRSVLTAASGVLLMLLFGLLVWRSKGLPWLFLFLSLLGMSDCTLVTHISEVEQKLFDGSWLCGSMHVFKSEASGMFSIRHDGNIPQELTRGCNVTSADGMVSLECSERPKLFDMTSLVSLRCPKTGCVSGLSCELIHDCEKTNLTVSPELAPQFCGTSLDAYLIDGVWRGDSLRMCENETLLSIAAKYKRPFSAGTEKLTSGYIWRGVERDNCFCYELNERSFPKIASSAPSIFYKAMPVEGADCHHSSVFTIHKGKPLCIKNGDDLMTRLMVVGAVNLGEMDLCIGKYGIIAKLKESSVKELAFRVQVSDREPGSVTAKGKPTQIDFCSQFQHDGQGCVATSCGCIHPLKDRSRFGASTATVEGGAKSRRRSRREAECYFWGFYCTSDDVLFATSEEEKAFLRVSEQVDQNTADIALIKGKLDFMAKVMQAGFCSNGSRHFQGSVEVQIIEGVVFNVSDWCTEETFKEFCETQSVSEHNLSSQVRQSIMNARNNEKQSVFTTCLLLLALDLAIFCLLRKLWKIGDFEIKHSHIGIGLSGETICMGYHRFREEEYICRCGRISLGSMMSDVNERCNYRGESPAVDNNRVKIEDTDGTMNVIYMCKTILTIGRFDTFSDKESEIIQALTKTDNDPDLLKMLILMYPNESLLTALLGPQLDEIQEEEELIYEEVGLVALQTIPKKPPRRLNHMAQTQRCCSTYNLYSPTYPEAAAET

SEQ ID NO: 15202 - protein, 1786 aa, unidentified
MSTMGSLRELSKIALVIVTTVAIILYATGDGEVASTVAFAGYSGVLLLYTISKQEFASEQNKYLYNIMRHSKKVKRTVAGETVANKKIIEEDDETPIFYNESKKISKKSLKNISIGAAASLFFDNIDQASALKICCRPFKLMHFNSIIIDHAKGGMEHILITDDWFTPGPEKQTISINGTKYCEYNMYCMNAAYKFIIDSSWYIGFSMFLMAALKVALYSYKIFKTPTGSVTIEYHQDNCFATENIKNKTKKNNKRPKNDRIYTGSETDSAERGSLIKEPRYQEDLVKITRTTHTYCSGLRVVLVLLYIISFVSILSWGLSLMSTTGVSGFTISKEDTITIDGKKATIEEFIEIMKQEDDGVLVMANKKENIRMKRELTSVIDGIQPMEMNQTSTTEQSLTAGPDNKSPEDIYVNRLTCLYDQETYYLTGKLETHCVVNSSSLGIMMVPSENSLIKRVDSRCKSSLSISLARFGTPVCLKVCTMVDDCEIYYEPNQANKIKIPYSLKDVLKYNMNEMGNSNKIRTDTVEIKISRRAKRSITISKPVSDFGQGVHIVEGWRTQFENENGGVFLAEEGPLDDCMAGIPTNVNKYVRCTPLRRQVISCEPNLWAHYTIGSNMYECKVPTKEEFEKMPAWRKSGTTIPYTVPPNKHSGKIDRFIHKMEIGTESYLKVEMLWGEKYQDSVQQIGGLKYHIYSTVFKVTAHGLDSKTPFPKLWDSMITKANRWVDRKYTGYRMHSLETDLPNGLPEILIKVKHIEEPNTNNMWQDRAYVNFVFKSDIFASDGTKISPSDTDPACIPSDSSKDCVYLVPVYYAIRVYGPLLADIKFFGYVVDTIAFDNNVCTSVNAIRVKGVCYIPDMSTVSTDVVVGGYPWTEWSGIFTSSTKAIFELFSFYQNHPKVGSGQYLSAVSDSANIGHFSVNGKCSDMYYHSGKLMCMGSNVVNIKMVEYTTFHRPLMSPPSCSTYPNNSLVCHFSDPTEVTRCTHDPYLTRKQDNCSTTIIKKMDHTVDEAAGLTVKTPQVVFHLQRGFDGCKGTCFFASIIEVGYRCSWCLAIIVIAAGIGYIALIVHLLVILICFINGYTIGRLLRLLGLRSLFRCPLTTACSICGMYSYSANEAAKHKLFCSSTQCPYCITLDESNNLCILEFPTRANHREHMKLHKMVRINPYLGVIRMKRYRVATFFLVQLALAGLSGVNAQYFPAETGLRSNAVGLNISIPADSVECSDKGCKVIKDYNAHIPLVDGSSIIMRTKVDGKAFAKKITVENPNMDVTCDYLYTSSEVVVGPRRIVYTCSGKTECTEKTEIDLLTKPIANRGATDDFIPIDTENPLKSLYCPKATSCRSPIIDFMWIPAGCFTVNDGTAIGYEYYMPSIKKEMVHVFRCTVRNIKYKICEGALCKKIDGSSSDLEQGVLKFEHISSKLPIQFMVGAMSRQGDDKPSHIFHGVPDLRTDGSNTNFAYRMTMIPQGETCMEGTSYYGGKCDINTDGSSPALNCKSTLPKIDSDTLIKNYESLHEVYHCNFENSMLRWNTKVVPREITVNKKTTKDTQTVSWPSLNLTSINCNFGFTDINLLTFGHTTMEIVRYTGAITKVVCTGSYNRNGMTQLEFNIKEHSGMLELHCPMLFSETCLFDTVKTNKCNITTLLPFNSTCLYNGQSINIDCSKLELSSADPLSGNIVGWTGSQSKDTWISGFKIGLSNWWYITMIAVGTTSILIFMLWLVITIVNNCKTMKLAMTYSKVQEAGFEDTEDVIAGAGVSKMMQGARELKDSKLRRRTMKARNMSSG

SEQ ID NO: 15203 - protein, 362 aa, unidentified
  VARIANT 334: note = Any amino acid
  VARIANT 339: note = Any amino acid
  VARIANT 341: note = Any amino acid
NQFGTMPSLTIACMTKQGQSDINDVVQALTDLGLIYTAKYPNSSDLDQLVKDHPVLGIIDTEKSAINVSGYNFSLSAAVKAGACMLDGGNMLETIKVTPQNIDPILKKTLAVKKSVGMFVSDTPGDRNPYENFLYKICLSGNGWPYIASRTSILGRAWDNTVVDLSNNNPTTKPPNQQARDKVPGLQQTVGLTYSQVMCLKEIMTGMDPTSKTWIDIEGRAEDPVEIAIYQPAGGQYIHFYREPTDAKQFKQDSKYSHGIDIIDLFRVQPGLTSAVIESLPKGMVLTCQGSEDIRKLLDSQGRRDIKLIDVMMSKIDARKFENEVWDDLKTLCXMHTGXVXEKKKRGGKQEITPHCALLDCI

SEQ ID NO: 15204 - protein, 635 aa, unidentified
MFESIIDPILEWLFNLFSFILAVIFVMTLSLLIYRMRNLPFLFMMCGSAECWVSNIQMNGHTAEMRQYEGQWLCGKIKMIKLDDLYHIRYNMSDSAVHLVMSRCTNTKLDNGWESVCSERPALLKNISTGISMIAGFNCSGQQKCFVGDGCTPWVDARDICGRKLERKLDNHQMLDICRQPIVGWIDSDGVHGRMQPIDKSTSVKETDSTSSGGHWNIAGRCSCIAYHQGVALPPITLKRHNSFCAADEWFSTHPKVGTKVCISADSLAVNFLKWSMKVMNHKQDIIAVEKGGTVNYIFTKRAKKVFISAQMKGKSCIPGNKTGDYCQEKVNGCEKGCWNLPKSRTRQRRQSILFFWGLVEVKWGEGGEVYDDSVLKALASQVDLNTASVKKLQLKLDLLSKAIWNGFCTNGTHSVQANMTITFKDGDELVVLDWCNSNTLEAFIDSKSVQEHHLSDLVKVSIRMRIHQKRVTIATKLGCVLFGLIVCTAVLRALWRRKDFSLSHYHEEDLNGQTCYSHHRFEKRYSRACRCGNVVIGKNSFLKMAKCNNRSKLPDCLLMDDKPNECDVLDFRQGQQKEVISDVQVIEFEIHGDEPRNEGSGAQTHQDLSETPERYEIAPIVFHNPEYVTQFHPK

SEQ ID NO: 15205 - protein, 382 aa, unidentified
YTCQTSLNANINLLHLGDTACFRFTNQQGDTIGTLNVLYDLSLYVAPLSPIYYTSDWLGLSCSHKSCRNDHPCSLSDGCPSDSTLLNSVLTPQCVVYPGRTKCESSCGCAGCGCFFCSDACLISRAAFQPVGLPYQVKTIGSVSVYPRLTVEYNFNGTTVSSTSDLFNPLSTPDFTLNLVGSYQAATTSISLGAAAFSSDGASALYYSYSDYNNPQFGVIGDVQSSLINGFSNPPYNFIFPDSSISQITSSSSVDYQFPQSGISRARQTPFPLLKDGIIYTADSERLYGLNPNAPAITVAMSSSHTSFSLVSETVCPKYVSHSISGCYNCPQGFTITFNAFSACRPGSVSVVVEGNFLCTTSFVTLNTTSLPSILYCISQQK

SEQ ID NO: 15206 - protein, 331 aa, unidentified
GVAKGSRTIWYMWLGSRFLEFEALGFLNEERWASRDISGGGVEGIGINYLGYHLEKMARKVGVLYADDTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCSHHFHELFLRDGRKLIVPCRDQHELVGRSMVSQGGSSGVAGTACLAKAYAQMWLMSYFHRRDLRTLGFGIMSSVPKDWFPTGRTTWSVHANH

SEQ ID NO: 15207 - protein, 443 aa, unidentified
MITAFKAINFNELLCPEGKEIKVDESNFGLLNKYVAPEYEIDEESLNPYEIKGKDCYSAVFKTGCKFHYFGSNDIIQVIEKKTTDKKNCNQVSTDVLTFPEANCVSGLFDNSYHYKEIEYIVTKPRSYMYDPSTGEIVDYKNIFDKKVDNVYHYRDNKGYWTMDETQPATTCDTFKQHESSEIEVKVWKSRMNNKSLIDLGGKIYDVDELCYHDHCGVRIAVTKDHIYFKLPTNLDIKKCSLDYKRVYLQSEIIQEKSELKDCLEAKIDMAWMKSINYEDLRKFNPSSSGIHPVYKLNNNNTLMKALAKYSEVNTTELHKYLEWVRCGNKTKCSYNGAIKADLVEVYGKRLTEKDFAVHVDELKVGIKAYPRDTISHSDHTEEKIYLKSDNSFVSLFFIAAPWISEGILILIIFCILIKYIKPKNKRHRDILLRRNNQDFESW

SEQ ID NO: 15208 - protein, 337 aa, unidentified; identical to SEQ ID NO: 10217

SEQ ID NO: 15209 - protein, 429 aa, unidentified
DHTEPFMTMDGRVQTLIKTQVYPHGSVSIMTRAGLLDIRAGAFFVSEGQGVKSLLSDCHVNASYSTDCCPMGCDIDMDALNAVGRVCVERTLQRGWASGCLEFGMGAVATCIEVSCSRELRVSSFGEKNIKVNVTGSFHSETTNLTLIPAAVRTLSFGDLGYATISCGLGLSDALNMYIVAGEKHKVLLPKGTIDVWTGLFKVGAVIHGADTAVLWGKTTPTEVKVKAIIDPSVAWEEGINIEKGLSDGMFLKCDIVVDKLLVETTRNCDKVGELIFTQDQIGTSGRVQVTLSAPAGADCVVVLTCEGCSLPAASVFFAKGTQISSTSVVCDETSAKISAGKKVVYVKCKVSRMISAWNIVLNTADRYQRHGVEGIKHSFFDLTGGWGLHLFSGWWVQIAIVLIGLTLLVDKRVLVLLVLVGYIVYVKA

SEQ ID NO: 15210 - protein, 430 aa, unidentified; identical to SEQ ID NO: 8534

SEQ ID NO: 15211 - protein, 190 aa, unidentified
KTQIREQLAKGTLIWYDHSVKAYIYGRELYTNYQYYGTGIDSNSYPVKSWRNTFPHLDELSEWIKRGGCKVGRNICGPGDFWGTWSSECLKSSEVLLSTDSQWGGEKIEHECSGSEWIKFPYHTCQISWSCHLHEVSLPIRLDTEGRVYTSLPNGSRLELDKNIYTMGKSSQLYIPELPLRHQSEVLLDC

SEQ ID NO: 15212 - protein, 489 aa, unidentified
MGQLVSFFSEIPNIIHEAINIALITVSLIALLKGMVNLWKSGLFQLIVFLILAGKSCSFKIGRSTELQNITFNMLEVLKDHPTSCMVNQSFYYILENSNATWGLEVSVTDISLLMAEHDRPVMGNLSNCVHPSVRHGAKLTGLLEWVFRGLKYDFVNYPRPLCQKFNNTVNETRVQINMTDGVGSHGFKETIIQRLAVLFGSRLMFSNEQGNKVTKRYLLIRNVTWSGQCQGNHINSLHLMMANTGRAFGMRQLQGIFTWTITDAAGNDMPGGYCLERWMLVASDLRCFGNTALAKCNLNHDSEFCDMLKLFEFNKKAIETLNDNTKNKVNLLTHSINALISDNLLMKNRLKELLDTPYCNYTKFWYVNHTSTGTHSLPRCWMVKNNSYLNESEFRNDWILESDHLLSEMLNREYLERQGKTPITLVDLCFWSTLFFTTTLFLHLIGFPTHRHIRGESCPLPHRLNSRGGCRCGKYPDLKKPTTWHKRH

SEQ ID NO: 15213 - protein, 500 aa, unidentified
NCLGMGNRDFVEGVSGATWIDVVLEGDSCVTIMSKEKPTLDVRMMKMEASNMAIVREYCYEASVSDISTESRCPTMGEAHNQKRGSDKYVCKSGVVDRGWGNGCGLFGKGSYDTCAKFECKKKAQGRLLQQENIKFEVGIFVHGPTNVENHGNYFAHVASGTASRYTVSPQAPSFTAKMGEYGEVTVDCEPRSGVDLASYYVMSVGNKHWLVHREWFNDLSLPWTGASANTWRNSELLVEFEEAHATKQSVTVLGSQEGSLHQALAGAIPVDVSSETVTLTSGYLKCRLKMEKLALKGTTYGMCAQSFSFAKNPVDTGHGTVVLELTYSGSDGPCKIPITMVTSLNDLEPVGRIVTANPYVAGSTSNTKVLIELEPPFGDSYIVVGRGNKQINYHWHKDGSSLGKAFTTTLKGAQRLAALGDTAWDFGSVGGVFSSVGKAIHQVFGGAFRTLFGGMSWITQGLIGALLLWLGVNTRDRSIALTFLAVGGVLLFLAVNVHA

SEQ ID NO: 15214 - protein, 536 aa, unidentified
MMRISVFLLMLCWLPVSLTFFDKSHIPITTCDKNLMSPIPWRTYCIEECGIRNVIGDKLDLFIYNRSDSGKVQLADCRKYKIRQTFTKTWTFSTFKGAIETEELMPNYAECESTWRDLCNSGPCSTTTPVIPEEYHWASDTTKEVIYVSIDAYQKTVAFQDPSGDIQLLVHGVIIDGSQSGYVQPSKDLITMWDKVELQDECPWSTGNSLSCSTSDEGISYYCAGKGLVLTNISTVTDTRCDNNPHLMTSGHHVIFRVKKASDPNATLSRTAQIVLDRGSEEAEIVDSVNKALLDRDSIRCASSCLAFDYTISKPQMFGNQLALPYKGSFLPCNILPNCRVVFPVKYCSSPPMILVECTGTMTWWNITGDYTIRPTYCHMNQSATKIKTSISFMTTNGRVLVNESGAYPVSREIGNTFQVGHVIEPSSMIEVTDPLNVRIDDTLVTPESHTISNITSVGDSLLDTMVETVKGIGRFISHEVRIVVFGVLTLFILYLSFKYLFAKKKSRVPHPKVVYTKPTSEGPVIYDTEYTIESD

SEQ ID NO: 15215 - protein, 500 aa, unidentified; identical to SEQ ID NO: 15213

SEQ ID NO: 15216 - protein, 574 aa, unidentified
MSTADILSHIENYGQKNTWRSAFRITSLILLLLITGMTIAGLVIASNQSCATSEELADPITEKLITSIRDLLTVSNNQINDIFKIVALDIPLQVSSIQQDISSQFNKLMEGITSLIGYNNSAGVISTIDPSYSGGIGVPLFTTSGNSTLQIHPVSLIEHPSFIPNPTTNRGCTRIPTFHLSRTHWCYSHNVIAKGCADFGKSGMYISLGVIKTAELGTPVFLTTASQYVDDGVNRKSCSIAATRFGCDILCSIVTEKENDDYASDPPTEMVHGRLFFNGTFSDSNLDVKNLFRDFSANYPSVGSGEVIGDIVMFPFYGGVRQRTSLFDQLSQFGLFVHNNRYTCEQNWTMTTVKQSYLPPKISGRFWAQGIVKCRLVLQTLANCSISVFNSSKVMMGAEARLMLVGTTLYMYQRSSSWWPLGLTYILGPMHSYLVNEGLISQVTLIAHSKFPRPSNKAGYCARPSVCPAVCATGVYTDLWPITESSNASNIVWVGQYLDAITERKYPRIGVATQYDWIHQSNLFSSNTVSSYSTTTCFKNTRLNRSFCVIIAEFTDGLFGEYRIVPQLIELRVK

SEQ ID NO: 15217 - protein, 382 aa, unidentified
  VARIANT 143: note = Any amino acid
  VARIANT 144: note = Any amino acid
  VARIANT 145: note = Any amino acid
  VARIANT 146: note = Any amino acid
  VARIANT 147: note = Any amino acid
  VARIANT 148: note = Any amino acid
  VARIANT 149: note = Any amino acid
  VARIANT 150: note = Any amino acid
  VARIANT 151: note = Any amino acid
  VARIANT 152: note = Any amino acid
  VARIANT 153: note = Any amino acid
KNLKKSFPREELSLTAVPRAADSEHDAHPPEHTPGPDSNPTINDNTELVTEDPAHLVQLQRQGRKEILPTPTPQAIEREPPAAQHDNPRNSPTPPSPIESDITDSTQAEDLTHTDDPSTINSATEEPLPEVGGTTQVPRDPEXXXXXXXXXXXGQPEQPSDNTMTPGQIHSESAAPMGERSIDGPGLLTNTLTGVARLITGAGRAKRESPEIRGAKCNPNLHYWTTHEESAAAGLAWIPYFGPAAEGIYTEGLMQNQNELICGLRQLANETTQALQLFLRSTTELRTFSILNRKAIDFLLQRWGGTCRILGPDCCIEPHDWTKNITDRIDQIIHDFVDKPLPDQSNNDNWWTGWRQWIPAGIGVVGVIAAFIALICICKIIC

SEQ ID NO: 15218 - protein, 378 aa, unidentified
TPDPRMAAALCILLCLSPASAACISTTTVAIPTTQCTLLNGNYTCQTSLNANINLLHLGDTACFRFTNQQGDTIGTLNVLYDLSLYVAPLSPIYYTSDWLGLSCSHKSCRNDHPCSLSDGCPSDSTLLNSVLTPQCVVYPGRTKCESSCGCAGCGCFFCSDACLISRAAFQPVGLPYQVKTIGSVSVYPRLTVEYNFNGTTVSSTSDLFNPLSTPDFTLNLVGSYQAATTSISLGAAAFSSDGASALYYSYSDYNNPQFGVIGDVQSSLINGFSNPPYNFIFPDSSISQITSSSSVDYQFPQSGISRARQTPFPLLKDGIIYTADSERLYGLNPNAPAITVAMSSSHTSFSLVSETVCPKYVSHSISGCYNCPQGFTI

SEQ ID NO: 15219 - protein, 574 aa, unidentified
MYLFTVTLLLPAAAALVGYDCNKKGMGHPYAIGSMSECRKFDKGAISSSAWAGTILQVPKQTQTPHKTCKLLLRSYSMYCTYYNNPTMLEKYSDDVDLTPYIMDEQDCIDAWDKRVFYYQGTQISVNPGGVTKILIGADIDENGFCRTSKGTSTVVKGHIELVWAEVMEVTDLRGQPKRRELDGEGLRWSLTRKSSTTVTGVTVLTNSPPTAMCSWQSIYQGAGELLEYPGSETYVTIPKLSSGFKLITVVTVCGLRVSVTDDPSIFLVNTTAVDVTPANDEFSGRYSSYFKSGLLGLQLILQSGMTTTTRDLLKNQCILEQMIQQNVVHQASKHPGLAAYTLTGVRGWTIILSGAGVILKQCTEVAVVLRPQDECYTDIPITINSTSSPLFLDPTTHIIKISSHTIECDDDSNPIFQVRNQYYRMTPKLVPVRGLPNLPSVLSDLNTTLLSPGTGLYPNEVLNHLDEGMSHISRKEEVERQLLKLGSNDFKTIHDGTGVIGSLVNYVVESGPTRWLMIASITIGSLSITISILLGVVIYRSRLWLVLAKKSTIAEYQATLLGQELDRRNQQQV

SEQ ID NO: 15220 - protein, 572 aa, unidentified; identical to SEQ ID NO: 8527

SEQ ID NO: 15221 - protein, 582 aa, unidentified; identical to SEQ ID NO: 8729

SEQ ID NO: 15222 - protein, 492 aa, unidentified
MGQIVTLFQSLPHIIDEVINIVLITLSVIAILKSVYNLATCGILQLVCFLLLCGRSCSVMMDQFNLTSVELDMNVLNLTMPLSCSRNNSHHYIFVGNSSGLELTLTNTSLLNHKFCNLSDAHRRAEYDVALMSIVSTFHLSIPNFNQYEAMSCDFNGGKITVQYNLSHESALDAANHCGTVANGILETFHKFFWSNNIKDAYQLPNQGKLAHCYSTSYQFLIIQNTTWEDHCSFSRPTPLGYLSLLGNRVKQIYISRRLLGTFTWTLTDSSGSELPGGYCLSKWMLIAAEMKCFGNTAIAKCNEKHDSEFCDMLRLFDFNREAIKRLRIEANKSLNLITKAVNSLINDQLIMRNHLRDLMGIPYCNYTKFWYLNNTRTGQVSLPQCWLITNGSYLNKTEFTNDIEREANNLVTEMLQKEYTERQGKTPLGLVDIFIFSTSFYLITVFLHLVKIPTHRHLVGAPCPKPHRLNSMAICHCGLYKQPGKPTVWKR

SEQ ID NO: 15223 - protein, 493 aa, unidentified
MGQIVTFFQEVPHIVEEVMNIVLITLSILAILKGLYNTATCGIFGLIAFLCLCGRSCSLVYKDNYNFSYVELNLSHMNLTMPMSCSKNNSHHYVFINETGLELTLTNTSILSHKWCNLSEAHRQDLYDHALMGIVTTFHLSIPDFNQWEAMSCDFNGGNITIQYNLTHQTAVDAMNHCGTVANGVLDAFYRFQWGRNITHVYQLPNGDGKWTQCYQTSYKYLIIQNVSWGDHCQLSRPTPMGFISLLSQRIKRLYISRRLLGTFTWTLSDSAGNESPGGYCLTRWMILAADLKCFGNTAVAKCNLNHDEEFCDMLRLIDFNKQALHTFKGEVKAGLQLITKAVNGLINDQLLIKNHLRDIMGIPYCNYSKFWYLNDTRNGKTSLPKCWLISNGSYLNETHFSDQIEQEADNMITEMLRKEYERRQGTTPLGLVDLFVFSTSFYLISIFLHLIKIPTHRHIVGHPCPKPHRLNSKAICHCGAYKQPGLQTRWKR

SEQ ID NO: 15224 - protein, 483 aa, unidentified
MQKLSLVWIITLSVSVITGDGLSILSCNKTDEVPTVTQCFKSCSDTILGEQVKVSILSQEDPTSIVVGRCIWRIMKQSFTETWTFSRLISAKEITWEPATTQECNGAFHNLCKNKAGCVSEDLEIEPEFSWARTEIREVKHLSIETLTMSAYLHQGAGKVLIDGVAVPISKKTHNNGDFTYVWDDVPISEVCPWKHPISHLSCYKDKEDLDDIYCPSQGISLVNYTKVDTSCPEQIYTDVGGLVFKLGKVDFNDWYPYVIESSDVAVKETISSINMALKMRESVHCHQDCLEIRRRVTYVDGFYYDPLPPAKCRLIGNCSVDSGSVTCNNGTLVWATCGGRRVWIDLKSGRDVKNAVCEKGGRSRISKNQFEGVLNEFHLNNSKFGNILRANEIHSVILKDNEVMDFARVVKSASERSGNFSEGTLINVRQLFRPMINFLRGIEHEIKVVAFSVLALIVGYIIIRIRTVTVAKAKSLESIAMI

SEQ ID NO: 15225 - protein, 422 aa, unidentified; identical to SEQ ID NO: 9256

SEQ ID NO: 15226 - protein, 423 aa, unidentified
STEELFKEYKLTRPYMARCVRCAVGSCHSPIAIEAVKSDGHDGYVRLQTSSQYGLDPSGNLKSRTMRYNMYGTIEEIPLHQVSLHTSRPCHIVDGHGYFLLARCPAGDSITMEFKKDSVTHSCSVPYEVKFNPVGRELYTHPPEHGAEQACQVYAHDAQNRGAYVEMHLPGSEVDSSLVSLSSGLVSVTPPAGTSALVECECSGTTISKTINKTKQFSQCTKKEQCRAYRLQNDKWVYNSDKLPKAAGATLKGKLHVPFLLADGKCTVPLAPEPMITFGFRSVSLKLHPKYPTYLTTRELADEPHYTHELISEPSVRNFSVTAKGWEFVWGNHPPKRFWAQETAPGNPHGLPHEVIVHYYHRYPMSTITGLSICAAIVAVSIAASTWLLCRSRASCLTPYRLTPNAKMPLCLAVLCCARSARA

SEQ ID NO: 15227 - protein, 422 aa, unidentified; identical to SEQ ID NO: 8501

SEQ ID NO: 15228 - protein, 422 aa, unidentified
STDELFKEYKLTRPYMAKCIRCAVGSCHSPIAIEAVRSDGHDGYVRIQTSSQYGLDPSGSVKRRTMRYNMHGKIEEVPLHEVSLHTSRPCHIVDGHGYFLLARCPPGDSITMEFKKEHVTHLCSVPYEVRFTPVGRELYTHPPEHGAEHPCRVYAHDAQHHGAYVEMHLPGLEVDSTMLSLSGGAVQITPPTGKTAFVECKCGAQISETVSTVKKYTQCTKTTQCRAYHMQNDKWVYNSDKLPKAPGETLKGKLHVPYLLTDARCTVPLAPEPVVSFGFRSVSLRLHPRHPTYLTTRGLDGESGHTHELITEPVTRNFTVTEKGWEFVWGNHPPKRYWAQETAPGDPHGLPHEMVVHYYHRYPTPTIVGLTLCAAIIAISASASAWLLCKSRASCLTPYRLTPNVKLPVYLAILCCARTARA

SEQ ID NO: 15229 - protein, 423 aa, unidentified
STEELFKEYKLTTPYMARCSRCAVGSCHSPIAIESVRSDGHDGYVRLQTSSQYGLDSSGNLKGRTMRYYMHGKIEEIPLHEVTLRTSQPCHIVDGHGYFLLARCPPGDSVTMEFKKESVLHSCTVPYEVKFTPAGRELYSQPPEHGVEQPCHVYAHDAMVRGSYVEMHMPGSEVDSSLLSMSGSSVKVTPPAGMSVFVDCKCSSGQITETVNSEKTYSQCTQTGQCRAYRLQSTKWVYNSDKLPRAAGDTLKGKLHVPYLLTEAKCTVPLAPEPVVKYGFRSVSLKLHPKHPTYLTTRHLTGDPGYTHELISEPTVKNFTITEQGWEYVWGNHPPKRLWAQETAPGDPHGLPHELVTHYYHRYPLTTSIGVSICVSIVVISCAASTWLFCKSRNTCLTPYRLTPNAQLPLCVAVLCCARTARA

SEQ ID NO: 15230 - protein, 422 aa, unidentified
STEALFKEYKLTRPYMAKCVRCAVGSCHSPIAIEAVRSDGHDGYIRLQTSSQYGLDPAGNVKSRVMRYNLYGKIVEIPLHEVSLHTSRPCHIIDGHGYFLLARCPEGDSITMEFRKDSVTHSCSVPYEVKFTPVGRELYSHPPEHGAEHPCRVYAHDAQQKDAYVEMHLPGSEVDSSLLSMSGSAVRVTPPSGQNVLVECNCGSAVSETISTAKTYNQCTKTSQCRAYRLQNDKWVYNSDKLPKASGETLKGKLHVPYLLSDAKCTVPLAPEPIVTFGFRSISLKLHPRNPTYLTTRQLDGEPNYTHELISEPSIRNFTVTEHGWEYVWGNHPPQRYWAQETAPGNPHGLPHEVIIHYYHRYPMSTTLGLSICAAVVITAIAASTWLFCKSRVSCLTPYRLTPNAQLPVCLAFLCCARTARA

SEQ ID NO: 15231 - protein, 1125 aa, unidentified
CTPLRRQVISCEPNLWAHYTIGSNMYECKVPTKEEFEKMPAWRKSGTTIPYTVPPNKHSGKIDRFIHKMEIGTESYLKVEMLWGEKYQDSVQQIGGLKYHIYSTVFKVTAHGLDSKTPFPKLWDSMITKANRWVDRKYTGYRMHSLETDLPNGLPEILIKVKHIEEPNTNNMWQDRAYVNFVFKSDIFASDGTKISPSDTDPACIPSDSSKDCVYLVPVYYAIRVYGPLLADIKFFGYVVDTIAFDNNVCTSVNAIRVKGVCYIPDMSTVSTDVVVGGYPWTEWSGIFTSSTKAIFELFSFYQNHPKVGSGQYLSAVSDSANIGHFSVNGKCSDMYYHSGKLMCMGSNVVNIKMVEYTTFHRPLMSPPSCSTYPNNSLVCHFSDPTEVTRCTHDPYLTRKQDNCSTTIIKKMDHTVDEAAGLTVKTPQVVFHLQRGFDGCKGTCFFASIIEVGYRCSWCLAIIVIAAGIGYIALIVHLLVILICFINGYTIGRLLRLLGLRSLFRCPLTTACSICGMYSYSANEAAKHKLFCSSTQCPYCITLDESNNLCILEFPTRANHREHMKLHKMVRINPYLGVIRMKRYRVATFFLVQLALAGLSGVNAQYFPAETGLRSNAVGLNISIPADSVECSDKGCKVIKDYNAHIPLVDGSSIIMRTKVDGKAFAKKITVENPNMDVTCDYLYTSSEVVVGPRRIVYTCSGKTECTEKTEIDLLTKPIANRGATDDFIPIDTENPLKSLYCPKATSCRSPIIDFMWIPAGCFTVNDGTAIGYEYYMPSIKKEMVHVFRCTVRNIKYKICEGALCKKIDGSSSDLEQGVLKFEHISSKLPIQFMVGAMSRQGDDKPSHIFHGVPDLRTDGSNTNFAYRMTMIPQGETCMEGTSYYGGKCDINTDGSSPALNCKSTLPKIDSDTLIKNYESLHEVYHCNFENSMLRWNTKVVPREITVNKKTTKDTQTVSWPSLNLTSINCNFGFTDINLLTFGHTTMEIVRYTGAITKVVCTGSYNRNGMTQLEFNIKEHSGMLELHCPMLFSETCLFDTVKTNKCNITTLLPFNSTCLYNGQSINIDCSKLELSSADPLSGNIVGWTGSQSKDTWISGFKIGLSNWWYITMIAVGTTSILIFML

SEQ ID NO: 15232 - protein, 512 aa, unidentified
CTNILPSTLCDHKEGVSLNDWRHLCLGACSPTDIQPGTHRYMIMHNTLMDYRTYGYRISAEKRTLSSHVSFFGSCHISESTVPMDAGAVTGGDIQEVLAHGGAGGVMDHVRPPSCDWMADNHVSGIRLTYQRVAISITEDNGKIEVEFPSQSLQGEGISGRIYSDNTLYAWDLEGKLPTCRRRAVGSTFCRVSSEFIACRGEKPHPIIRNMTDCGIKMMVTYGADYALYDEEKAKSVEDVKEENSAVLGKVLDMENIVCHHLCQEAETVMNHDEFLMATPIGKWLSVKAEDHFIFYKCVDIDAALVRPVVVCGSGPMIQITTINGIYWWNVSSPYINPSATCNPATSSSIMRGNVIRTWVGDLILNGSDVSFAHRFRDAAFHPAFRPVPQLFSEHHLHMSEIAAGLKYASTIQVKKENTEERRISMGESIGDRAVGAVEAAEEWVKSKWPDIKAWIIRIGLWVAAIMAVLIVLWCLFKLIIAILTRPRNVIRVENRESKGSDTSLVAWAKQK

SEQ ID NO: 15233 - protein, 423 aa, unidentified; identical to SEQ ID NO: 15229

SEQ ID NO: 15234 - protein, 229 aa, unidentified; identical to SEQ ID NO: 8171

SEQ ID NO: 15235 - protein, 246 aa, unidentified; identical to SEQ ID NO: 10234

SEQ ID NO: 15236 - protein, 429 aa, unidentified
MAGHINRSVLLLFLLAVMPHFTTGTIGEMLSLAASSNSSICHGMQFTEPTQSFMGILPNETQPMFKFSLMHSEAVPRIGKVLRISHDMRLFGEEAINYTIFVNKIAFEPVSYYNISGTCRQQGFSACVRVYSDLTNNSRGFPSMKLGFTAIELNKIKNSDFHNMGFKICFSCRDYKGVRLVAYSKKNHTAQLMMCPEELIFSQDFTINSTSTGGGKEEVAVPLLNTTGYACIALHNKNMLTHHSLALSSGTKVDNTLEPGCDSNVGLFGHSTGTDYGWGVANFFSAGITNSLQISQLEHVTDAIACKIAKTSNYTTTALFLLNKEEGEIRDHVIEHEVALNYLLAHQGGLCNVVKGPMCCSDIDDFRKNVSDMIDKVHEEMKKFYHEPDPFGGLGTWGFYGTVLGHILQWIPIIIMVIIVCFVCSWVRR

SEQ ID NO: 15237 - protein, 426 aa, unidentified
MAGWIQLPILSILLFMVPQLTLGTIGEMLSLAASGNSSICHGMQFTEPTQSFMGILPNGSRPMFKFSIVHSETVPRVGKTLKISHDMKLFGEEALNYMIFVNKIVFEPSKFHNISGSCRQRGFKACVRVYSDLVNNSRGYPSTKLGFTADELNKTHRTNPNDMGFKICISCRDHNGVRLVVYSKINRTAQLMMCPSELIYSYDFTMNSSSTSTDEVVLPLLNVTGYSCVALHNKNMLTHHSLALSSGSKVDNTLEPGCDSNVGLFGHSTGTDYGWGLANFFSAGITNSLQISQLEHVTDAIACKIAKTSNYTTTALFLLNKEEGEIRDHVIEHEIALNYLLAHQGGLCNIVKGPMCCSDIDDFRRNVSDMIDKVHEEMKKFYHEPDPFGGLGTWGFYGTIFGHILQWIPIIIMVIIVCFVCSWVRR

SEQ ID NO: 15238 - protein, 498 aa, unidentified
MGQIVTMFEALPHIIDEAINIVIIVLIIMTTLKAVYNFATCGIFTLIAFLLLAGRSCALYGLSGPDIYKGVYQFKSVSFNMSVLNLTMPNACSVNNSHHYISMGTSGLELTFTNDSILSHNFCNLTDSFRKKTFDHVLMSIVTSLHLSVRGNNNYKAVSCDFNNGVTIQYNLSFSGAQESVNQCNTFRGRVLDMFRTAFGGKFMRSGYGWKDAQGKTTWCSQTSYQYLIIQNRTWENHCEYAGPFGLSRILFAQEKTKFLTRRLAGTFTWTLSDSSGTDDPGGYCLTRWMILAADLKCFGNTAVAKCNMNHDEEFCDMLRLIDYNKAALAKFKTDVESALHLFKTTVNSLISDQLLMRNHLRDLMGVPYCNYSKFWYLEHAKTGETSVPKCWLVTNGSYLNETHFSDQIEQEADNMITEMLRKDYFKRQGMTPLALMDILLFSTTAYLVSIFLHLLKIPTHRHIKGGTCPKPHRLNRMGICSCGAFKVPGVDTVWKRR

SEQ ID NO: 15239 - protein, 493 aa, unidentified
MGQIITFFQELPHFLEEVMNIVMVVLILLTLTKAIYNLWTCGLVGLVYFLMMAGRSCESGLGNEFQLSSFVLNTTIFNSSMPLSCSKDNSHHYIYMNNTGLEITLTNKKIINHTWCNLSDAHQKDLYDHALMSIVTSFHLNIRGFSDYKAMACDFNGGNITIQYNLTSKFNRSTFEYCHSMPSRILETFRQMFWSQNVTIGATETDTITTLYCPQTDYKYIIIQNVSWENHCEMMHPTPMKFIHLELNSRRTVYLSRRLRGTFTWTLSDNSGTENPGGYCLTRWFIIAADLKCFGNTAIAKCNEAHDEEFCDMLRLFDYNKEAIKRFKGETQAALHHFKEAINALISDQLLMRNHLRDLMGIPYCNYTKFWYLNHTKTNTTTLPKCWLVRNNTYLNETEFSNDIEQEQTKFITEMLKREYDHRQTSMPLGLVDLLLFTTSLFLVSVFLHLARIPTHRHLVGKPCPKPHRLTKMGICSCGLYKQSGVPVVWKRR

SEQ ID NO: 15240 - protein, 522 aa, unidentified
MISFNLILLILVPGQQKEGRSKLRSSRLVLLQFCQPLLPYILIYLVVPGMTLGCNISTTGLICNLTSTPTRIALNWTFPCDEANPDDQQPAECNITLMTHDPTPLHAKAEKCYVYVCTTSFGFWGVYSESREITRTLHRDECNFVEEIPEDPYQCDYWWCQYNVKTEKCLCITENVTVVGLPNGHLYCSFEDCSTLSSGTKLQHTPTLTKILILNNTSHENVTYLNQPATIINSTRVMIHSLHKEYTIYNGTINATDLSGVCSEKTQIKRRKRDAGQGYTVDSIGHLLYPGFEACRLLRTLLPAIALQPLLDHTPLIQAWFNNDSLAGKVVSDTALIWTCKKVSCDLQNLSTNSLYFPVSCNKHNFSLNPWTSVLYSDGPNVGPGRYLALKLSNGSHVIGVTGSGICPQVIKEPSMTTGIFSFTIPDLHEELIQSAHVLDPVFYALGMNKDFSTTLHSSSNHETNVSESLWHIGLPSFSFINPLGWIRDLTSWAAWLGGILYLATLIVFLVRTLTRKIKYGR

SEQ ID NO: 15241 - protein, 523 aa, unidentified
MISFNLTLLTLVLGPQRGDQSRPRSSHLARQLQSRLLLYLTFILICLTIPGTTSECNITTNGLHCNLTSTPTRISLNWTFPCDDFNQDNHQPARCNITLKTHDPTPLHAKAEKCYIYTCTTSFGFWGVYSESREVTRTLHRNGCEFLDEIPEDPYTCNYWWCKYNVKTERCLCLTENITVVALPNGHLYCSFEDCSMLSAQLKIQYTPTLTKVLILDNVTHTNATYANQPATIINGTRVMIHSLHKEYTIVNYTLNDTSIDGQCEAASSTRRRRDASQGYTIDSIGHLLYPGFEACRLLRTLLPAIALQPLLDHTLLLQAWFKNDSIAGRIVSDTALVWTCERVDCQLKNLSSTSLYFPVQCNDKNFSLNPWTNVLYSDGPDVGPGRYLALKIANGSHITGVTGSGICPQVIEEPSMTTGIFSFTIPDLHEDLIQSVHILDPVFYALGMRRDFSATLHSSTNHETNTSETLWHIGLPSFSFLNPLGWIRDLTSWAAWLGGILYLVTIVIFLIRTLTRRVKYGR

SEQ ID NO: 15242 - protein, 580 aa, unidentified
  VARIANT 36: note = Any amino acid
  VARIANT 37: note = Any amino acid
  VARIANT 38: note = Any amino acid
  VARIANT 39: note = Any amino acid
  VARIANT 40: note = Any amino acid
  VARIANT 41: note = Any amino acid
  VARIANT 42: note = Any amino acid
  VARIANT 43: note = Any amino acid
  VARIANT 44: note = Any amino acid
  VARIANT 45: note = Any amino acid
  VARIANT 46: note = Any amino acid
  VARIANT 47: note = Any amino acid
  VARIANT 48: note = Any amino acid
  VARIANT 49: note = Any amino acid
  VARIANT 50: note = Any amino acid
  VARIANT 51: note = Any amino acid
  VARIANT 52: note = Any amino acid
  VARIANT 53: note = Any amino acid
MEGSRTVIYQGDPNEKNTWRLVFRTLTLILNLAILXXXXXXXXXXXXXXXXXXTTLKTEGVEEVITPLMATLSDSVQQEKMIYKEVAISIPLVLDKIQTDVGTSVAQITDALRQIQGVNGTQAFALSNAPEYSGGIEVPLFQIDSFVNKSMSISGLLEHASFIPSPTTLHGCTRIPSFHLGPRHWCYTHNIIGSRCRDEGFSSMYISIGAITVNRDGNPLFITTASTILADDNNRKSCSIIASSYGCDLLCSIVTESENDDYANPNPTKMVHGRFLYNGSYVEQALPNSLFQDKWVAQYPGVGSGITTHGKVLFPIYGGIKKNTQLFYELSKYGFFAHNKELECKNMTEEQIRDIKAAYLPSKTSGNLFAQGIIYCNISKLGDCNVAVLNTSTTMMGAEGRLQMMGEYVYYYQRSSSWWPVGIVYKKSLAELMNGINMEVLSFEPIPLSKFPRPTWTAGLCQKPSICPDVCVTGVYTDLFSVTIGSTTDKDTYFGVYLDSATERKDPWVAAADQYEWRNRVRLFESTTEAAYTTSTCFKNTVNNRVFCVSIVELRENLLGDWKIVPLLFQIGVSQGPPPK

SEQ ID NO: 15243 - protein, 618 aa, unidentified
MERGISEVALANDRTEEKNTWRLIFRITVLVVSVITLGLTAASLVYSMNAAQPADFDGIIPAVQQVGTSLTNSIGGMQDVLDRTYKQVALESPLTLLNMESTIMNAITSLSYKINNGGNSSGCGAPIHDPEYIGGIGKELLIDDNVDVTSFYPSAFKEHLNFIPAPTTGAGCTRIPSFDLSATHYCYTHNVILSGCQDHSHSHQYIALGVLKLSDTGNVFFSTLRSINLDDTANRKSCSISATPLGCDILCSKVTETELEDYKSEEPTPMVHGRLSFDGTYSEKDLDVNNLFSDWTANYPSVGGGSYIGNRVWYAVYGGLKPGSNTDQSQRDKYVIYKRYNNTCPDPEDYQINKAKSSYTPSYFGSKRVQQAILSIAVSPTLGSDPVLTPLSNDVVLMGAEGRVMHIGGYTYLYQRGTSYYSPALLYPLNIQDKSATASSPYKFDAFTRPGSVPCQADARCPQSCVTGVYTDPYPLIFAKDHSIRGVYGMMLNDVTARLNPIAAVFSNISRSQITRVSSSSTKAAYTTSTCFKVIKTNRIYCMSIAEISNTLFGEFRIVPLLVEILSNGGNTARSAGGTPVKESPKGWSDAIAEPLFCTPTNVTRYNADIRRYAYSWP

SEQ ID NO: 15244 - protein, 599 aa, unidentified
MLRAEELPFHLDQVSHSYTTISAMPSIMTSASSQSREHLASRDDDDDSKCTWRLVFRVSAIALLLTILGLSIATFCKIPSKDFEPIIEEAVHEITSILTPLGAGITAILDYCQKIYRQSVLETPLQLSAMQTSILQSLSALSYQISLEANGSNCGAPIHDEAFAGGIETPLFSGKFTNGKQFRVSKYIEHLNFIPAPTTGRGCTRIPSFSLSTSHGCYTHNVILDGCADHGASHQYISIGTLRVSPSGRIYFSTLRSVNLDDGVNRKSCSIAATRYGCDLLCSVVTETERSDYASNPPTRMIHGRLDFGGSYSETDINSQVIFADWAANYPGVGSGVAVDDRILFPIYGGLRAGTPSYNKNYGSYAIYQRSGDVCPDNNATQVRNAKASYIVPLFSNRLIQQAILSIRLDPGLGKDTTLHISSNNVTLMGAEARLVAIDGQVYMYQRGSSWFPAAVLYPIHRKNGTFTFGRPYIYDNFTRPGTGFCSAASRCPNTCITGVYTDAYPIIFSADKKPIGVFGTYLNHRSDRQNPRSAVFFDVTMSNATNVSTPPVGAAYTTSTCFKMTSTGRRYCISIAEIRNTIFGEYRIVPLLVEIEQV

SEQ ID NO: 15245 - protein, 591 aa, unidentified
MQICPTFPHRSTMPSINTRQSSPSMEQLTYRYADTDGKNTWRNAYRALSIMMLTTVLGLAVAIFCKIPSEDPVSVVTTALMPLTLLVKGIQDKVVEVLEVESKIYRQSVLETPLQLSAMQTSIMQSLSALSYQISLETNGTNCGVPIHDQAFAGGINTPLFSGNFTSASQLYVGKYLEHLNFIPAPTTGRGCTRIPSFSLSASHWCYTHNVILAGCQDHSASHQYLSLGTLKISPSNRIYLSTLRSINLDDGINRKSCSIAATKYGCDMLCSIVTESEVQDYASPNPTEMIHGRLDFGGVYKEASVGASSVFKDWAANYPGVGSGVAYKGKVVFPVYGGVKSGTPTYKANEGKYAIYTRVGDPCPDSNQTQINNAKASYIIPYFSNRMVQQGILSIEERPELGMGPTLHVASNDVALMGAESRVLEIDGRLFLYQRGTSWFPAAVIYPVEDKNGTLSLKPPYIYNNFTRPGTGVCSSYSRCPNVCLSGVYTDAYPIVFSASKAPLGVFGTYLDHRFDRKGPKSAVFFRTGMSNVTNVSTPPVGAAYTTSTCFRLTSLGKHYCISIAEIRNTVFGEFRIVPLLLEVFTKPSK

SEQ ID NO: 15246 - protein, 587 aa, unidentified
MLSQSTDQLYRQDPGPPGRRTWRMIFRLTCLAMLVTILSLNAVLVVRTSGGYDFSTLETGLVGIGSTITSQDKTLKGIDEGVGKIYKQTVLDTPLALNSFETNVMQGLSSISYQIHIAQNGSNCDTPIHDTAFSGGINTQLYVGQGLTNTDFSLSKFLEHVNFIPAPTTGRGCTRIPSFHIGPTHWCYTHNVILNGCADHSTSHQYLAMGTIRLSQSRHVYFSTIRSVNLEDGVNRKSCSIVATKFGCDMLCSVVSERESADYNSPDPTPMVHGRLDFGGVYKEEYLPVNQLFQDWAANYPGVGSGEIYNGRIYFPVYGGVKQDSPTYRRNQDRYAIYGRYNNTCPDPLETQVRNAKASYTPAIFGRRMVQQAVISLDLDLPLGKNALLSVADNNITLMGAESRIINIKGKLYLYQRGTSWYPVCTMYPLAITNGTVKFSTPHTFDTFTRPGVNPCSAASRCPNSCVTGVYTDGFPLVFDNSGNVLAVYGMYLSDKTQRLGPKAGIFFRHSMTNVTNVSTPPHKAAYTTSTCFQDVNSRRTYCISIAEIGNSIFGEFRIVPLLVEVNFNKRSDKASSFTLNTTLPMD

SEQ ID NO: 15247 - protein, 500 aa, unidentified
MLHSMYFRIAFEILVLVLWARTYAIPALKCNTESTPSLVDLEIRRLCHNKTDNVVSCSVSYRNHTFTELNVTHISCYKYHCKTYWGFFGSYSTDKLISRFTGDLSKCLNESMEDPFVCNWYYCCSAIINDICRCDIATAIVSVKSFPPFMYCSFADCSTVNEKDLSNGNATLSDGSLLIFTPYNLTHDIVNGTFNGTIYCNGSAKVISFDVFRRSYGLKNCSYTDQSLNVTCENCSSHCPPQRRRRDLSETTYLAHKLRPMLADAWEDCEILQSLILGSFGNGMSGASQFLREWLNHTDIVGYIVNGIGVIWQCQQVNVSFLPWNESTYYPPVNLSGTRLYLNDESRLQTGSPEAIPGLKRVMWYGRMYLGTVNSGQRPKRVKYNRSSHDYHLTQFDWNFNFTPSITLATGHETNPINHAFGTQSNLLPYAKSSNLTSTDTGSGWVHIGLPSFAFLNPMGWLRDIMSWAAWLGGILYLVQLVMSLPVLIARKRRLGRWSE

SEQ ID NO: 15248 - protein, 613 aa, unidentified; identical to SEQ ID NO: 8307

SEQ ID NO: 15249 - protein, 577 aa, unidentified
MSNIASSLENIVEQDSRKTTWRAIFRWSVLLITTGCLALSIISIVQIGNLKIPSVGDLADEVVTPLKTTLSDTLRNPINQINDIFRIVALDIPLQVTNIQKDLASQFNMLIDSLNAIKLGNGTNLIIPTSDKEYAGGIGNPVFTVDAGGSIGFKQFSLIEHPSFIAGPTTTRGCTRIPTFHMSESHWCYSHNIIAAGCQDASASSMYISMGVLHVSSSGTPIFLTTASELIDDGVNRKSCSIVATRFGCDILCSIVTEKEGDDYWSDTPTPMRHGRFSFNGSFVEAELPVSSMFSSFSANYPAVGSGEIVKDRILFPIYGGIKQTSPEFTELVKYGLFVSTPTTVCQSSWTYDQVKAAYRPDYISGRFWAQVILSCALDAVDLSSCIVKIMNSSTVMMAAEGRIMKIGIDYFYYQRSSSWWPLAFVTKLDPQELADTNSIWLTNSIPIPQSKFPRPSYSENYCTKPAVCPATCVTGVYSDIWPLTSSSSLPSIIWIGQYLDAPVRRTYPRFGIANQSHWYLQEDILPTSTASAYSTTTCFKNTARNRVFCVTIAEFADGLFGEYRITPQLYELVRNN

SEQ ID NO: 15250 - protein, 595 aa, unidentified
  VARIANT 42: note = Any amino acid
  VARIANT 43: note = Any amino acid
  VARIANT 44: note = Any amino acid
  VARIANT 45: note = Any amino acid
  VARIANT 46: note = Any amino acid
  VARIANT 47: note = Any amino acid
  VARIANT 48: note = Any amino acid
  VARIANT 49: note = Any amino acid
  VARIANT 50: note = Any amino acid
  VARIANT 51: note = Any amino acid
  VARIANT 52: note = Any amino acid
  VARIANT 53: note = Any amino acid
  VARIANT 54: note = Any amino acid
MESNNIKYYKDSSRYFGKILDEHKTINSQLYSLSIKVITIIXXXXXXXXXXXXXINATSGRTTLNSNTDILLSQRDEIHNIQEMIFDRIYPLINAMSTELGLHIPTLLDELTKAIDQKIKIMHPPVDTVTSDLNWCIKPPNGIIIDPKSYCESMELSKTYELLLDQLDVSRKKSLIINRKNINQCQLVDNSKIIFATVNIQSTPRFLNFGHTVSNQRITFGQGTYSSTYVITIQEDGVTDVQYRVFEIGYISDQFGVFPSLIVSRVLPIRMLLGMESCTLTSDRLGGYFLCMNTLTRSIYDYVSIRDLKSLYITIPHYGKVNYTYFNFGKIRSPHEIDKIWLTSDRGQIISGYFAAFVTITIRNYNNYPYKCLNNPCFDNSENYCRGWYKNITGTDDVPILAYLLVEMYDEEGPLITLVAIPPYNYTAPSHNSLYYDDKINKLIMTTSHIGYIQINEVHEVIVGDNLKAILLNRLSDEHPNLTACRLNQGIKEQYKSDGTIISNSALIDIQERMYITVKAIPPAGNYNFTVELHSRSNTSYVSLPKQFNAKYDKLHLECFSWDKSWWCALIPQFSLSWNESLSVDTAIFNLISCK

SEQ ID NO: 15251 - protein, 595 aa, unidentified
MWNSIPQLVSDHDGAKGKFTDIPLQDDTDSQQPPGSKSTCRTLFRTVLIILSLIILVLGVTSTMFSAKYSGSCATNSQLLGVSNLINQIQKSIDSLISEVNQVSITTAVTLPVKIMDFGKSVTDQVTQMIRQCNTVCKGPGQKPGSQNVRIMPSNNLSTFQNINMSARGIAYQDVPLTFVRPIKNPKSCSRFPSYSVSFGVHCFANAVTDQTCELNQNTFYRVVLSVSKGNISDPSSLETKAETRTPKGTPVRTCSIISSVYGCYLLCSKATIPESEEMKTVGFSQMFILYLAMDSKRILYDNIVSSTSAIWSGLYPGEGAGIWHMGQLFFPLWGGIPFLTPLGQKILNSTLDIPEVGSKCKSALTTSPAKTKDMLFSPYYGENVMVFGFLTCYLLSNVPTNCHADYLNSTVLGFGSKAQFYDYRGIVYMYIQSAGWYPYTQIFRITLQLKQNRLQAKSIKRIEVTSTTRPGNLECSVLWNCPYICATGLFQAPWIVNSDAITPKEVDNMVFVQAWSADFTEFRKGILSLCSQVSCPINDLLSKDNSYMRDTTTYCFPQTVPNTLPCTSFVEWGGDSGNPINILEIHYEVIFVAS

SEQ ID NO: 15252 - protein, 595 aa, unidentified
MWSTQASKHPAMVNSATNLVDIPLDHPTSARFPINRKRTGRLIYRLFSILCNLILISILISLVVIWSRSSRDCAKSDGLSSVDNQLSSLSRSINSLITEVNQISVTTAINLPIKLSEFGKSVVDQVTQIIRQCNAACKGPGEKPGIQNVRINIPNNFSTYSELNRTANSLNFQSRTALFARPNPYPKTCSRFPSYSVYFGIHCFSHAVTDSSCELSDSTYYRLVIGVADKNLSDPADVKYIGETTTPVRVQTRGCSVVSSIYGCYLLCSKSNQDYQDDFREQGFHQMFILFLSRELKTTFFDDMVSSTTVTWNGLYPGEGSGIWHMGHLVFPLWGGIRFGTHASEGILNSTLELPPVGPSCKRSLADNGLINKDVLFSPYFGDSVMVFAYLSCYMLSNVPTHCQVETMNSSVLGFGSRAQFYDLKGIVYLYIQSAGWFSYTQLFRLSLQSKGYKLSVKQIKRIPISSTSRPGTEPCDIIHNCPYTCATGLFQAPWIVNGDSIRDRDVRNMAFVQAWSGAINTFQRPFMSICSQYSCPLSELLDSESSIMRSTTTYCFPSLTESILQCVSFIEWGGPVGNPISINEVYSSISFRPD

SEQ ID NO: 15253 - protein, 451 aa, unidentified
  VARIANT 418: note = Any amino acid
  VARIANT 419: note = Any amino acid
MFFTILPTLLLGNWTLVNITDITCPHYKDYTIHPEAINHKLSLYEVTDEDYNEYNNVLFGRDCSKLTLSTKCKAHLMASNEIEYEEIYESPDITDCNSLKMDNMIKYPESNCRWNLFDNGYISNNETTIKINDKSFLLDVHTGLIVNQDKIFNHCDEHMCEYKNNRGFWLRSKDINTEKELCTHLKNTTHLNKQEGYLSVYQNNKFLYIENNPVHYDDMCTIKRCNNLILTIKNFKKYVIKSSGLFQECKTDNIHYLNKEESFNEVEDHILCANKLVKVIKEKKLNYYDLKYFHPTRIGLHNIYRLNEDKKLEKNIAYYSKVDSDKDEVKVKSVACGTKVNCLYNGKHKINSEKEFNVDIKEYKIYKDEVEKGFIIEDSMYIPYEKTEIEFERNAITFDFDEIYKFGMGLLIIALILXXLVCVVTKCKSRNNIKSRKSLKRFEEKASFLNI

SEQ ID NO: 15254 - protein, 820 aa, unidentified
  VARIANT 717: note = Any amino acid
  VARIANT 718: note = Any amino acid
  VARIANT 719: note = Any amino acid
  VARIANT 720: note = Any amino acid
  VARIANT 721: note = Any amino acid
MDLVRFSIALSVFLCYGTPPSQGQAIVSIKDSCEAKSAPWIPCEKFDYVKNATGSGIKCWIFCSRSGFYSKTGRFIRCIQGDPEAKYIKSCRRQIEKRGKEKMREGTRGKRKTSEPKEEGVRAKTDFTPDESRRLNNLTKVFRKVEDKDLNDFKKFILEKGLETKIKLANDGKISFRDPDCGENKDYPCHRIHQIIEGVNENIDYINEILSLKKMKEELRLRERESEEGEFPGLLNTTNRRGFLLHYPVELGNWSRLEDPSQIKCPSHHKDMLSNPRRLGKYNLDIIVRRPRIGTFETVVPGYICQGMQWTSTCNEMWYFVTYHDRAVHYITPNKLKCLQNIRAHKRGEHIKPYYPLEECNWNSETTKTVDYFMITPYSPEVDPFTLEFKSEIFPDRTSCRPGDEICVTDDDSKVWFPDEDDKLIARGHCPDETWDESHLTIHPEEMPENWEDPQSPWVSDYILKGVLFGEKRVKKSCLLEFCGTSGLLFEDGEWWELNVFSREKGRESLTKIFIEQEEIRRCNGTETRVGVAGKETDEKALLNAVLSKNAYERCKSARYRLIENKYLRLDDLSYINPRESVTWWAYRVRAGDDERTFKLEKTTGEYRYLQVPPSLEQHVTDCDGQENCSVSIGYYRGELINSSDWTRTGHDDVYVGVNGLLRKDTGNKTIVLYPPLMKEYQEIFSDSGESDDEAFIYKPDIHEKKGKPKEAEDEKXXXXXKNKTPIDDIKDWWSNIKGEWHLIKGILIGLFTFALLIGVVKLGVFIKSSFRKRRDDSIPEGKDEEIGIKMQSRRSRQNIYEEINEVSPTMTRRGRNIFN

SEQ ID NO: 15255 - protein, 495 aa, unidentified; identical to SEQ ID NO: 8710

SEQ ID NO: 15256 - protein, 496 aa, unidentified; identical to SEQ ID NO: 8708

SEQ ID NO: 15257 - protein, 571 aa, unidentified; identical to SEQ ID NO: 8536

SEQ ID NO: 15258 - protein, 526 aa, unidentified
VLLLLVYPVNSIDNTLIAPIGVASANEWQLAAYTTSLSGTIAVRFLPVLPDNMTTCLRETITTYNNTVNNILGPLKSNLDALLSSETYPQTRLIGAVIGSIALGVATSAQITAAVALKQAQDNARNILALKEALSKTNEAVKELSSGLQQTAIALGKIQSFVNEEILPSINQLSCEVTANKLGVYLSLYLTELTTIFGAQLTNPALTSLSYQALYNLCGGNMAMLTQKIGIKQQDVNSLYEAGLITGQVIGYDSQYQLLVIQVNYPSISEVTGVRATELVTVSVTTDKGEGKAIVPQFVAESRVTIEELDVASCKFSSTTLYCRQVNTRALPPLVASCLRGNYDDCQYTTEIGALSSRYITLDGGVLVNCKSIVCRCLNPSKIISQNTNAAVTYVDATICKTIQLDDIQLQLEGSLSSVYARNISIEISQVTTSGSLDISSEIGNINNTVNRVEDLIHQSEEWLAKVNPHIVNNTTLIVLCVLSALAVIWLAVLTAIIIYLRTKLKTISALAVTNTIQSNPYVNQT

SEQ ID NO: 15259 - protein, 248 aa, unidentified; identical to SEQ ID NO: 8593

SEQ ID NO: 15260 - protein, 294 aa, unidentified
FYESCAEWKIFYEGVVFSPYMRQACTGTNGEWSRMKEQFYTKFYEMATRFQCFKFVRVPYIRPAESTQEVAPGCGAGGTINGVEYITDPRNGTIITSVVTDLKITGEYLMPFCYFVYRSRDIWLAENRGYDSDPFLKVYNEQGETLFDWNQLTDGYGEPKAEKMIKCSFIIVEKTSKITIQSWSASQFITRAAYYFNETIPRRPIQVIESKWAQSRMSDPITQESACRRLGDYCIYFRIGTYLGIFDDELGDLQVRDILSGQKGGGPNFCGGRSYPGGCPASCNPSPFCTDYIS

SEQ ID NO: 15261 - protein, 594 aa, unidentified
MATSFLLLLSLSSILAISATSAPALTSGRIPRDEEPSSDKGDSDLYPLYECGKEGTGVPITSWYGACRGACSMASNSTEVVAEIYYRNDSVGYIDVLSVRTTEIKKTSHVTWYGACDEETIVGANSLAPEYIIEQSIEFLHSGLDSWQYGADIHVHDTIGFPDCDYLDDKNNEGWRFIITKRAIELKSDIAGEGYIVDPDLGYVFPVSDGIGRGKFWYIWKSSSVPSGGCYFKSAGTGNCTLLMDTFTYSCPELNVAFSAKVNTKLEGTCVGDLNISSDGVSYALRSQQSTGSVSSALINLWHQSQEAVTQQLILVINDALGKIESSYCEASCDLTEALFYRVTDNPAVVETPVGPWLPSLSKGKVSIIPCQSEQQLIIILPIEICYEPFMLKVKSLKTGETFWWLPSHSHVTSSTSCRSIATEEVEFQGELKKPLTFEFWRGMYLLPYPYNGSGTWIDNPGTHIHRSSKWFPSINQLSYSVPIKLPLITKEIRKHVQQTVVSIGGFSNITSHPITEGIWTALSTAGLIIGKTAARVVMWWSELEETVKGYVTLAGGVIISLLVGYLMLKTILLTRRPSYSSVPREVNWITPAK

SEQ ID NO: 15262 - protein, 504 aa, unidentified; identical to SEQ ID NO: 8334

SEQ ID NO: 15263 - protein, 442 aa, unidentified
  VARIANT 415: note = Any amino acid
  VARIANT 416: note = Any amino acid
  VARIANT 417: note = Any amino acid
  VARIANT 418: note = Any amino acid
  VARIANT 419: note = Any amino acid
  VARIANT 420: note = Any amino acid
  VARIANT 421: note = Any amino acid
  VARIANT 422: note = Any amino acid
  VARIANT 423: note = Any amino acid
  VARIANT 424: note = Any amino acid
  VARIANT 425: note = Any amino acid
  VARIANT 426: note = Any amino acid
  VARIANT 427: note = Any amino acid
  VARIANT 428: note = Any amino acid
  VARIANT 429: note = Any amino acid
  VARIANT 430: note = Any amino acid
  VARIANT 431: note = Any amino acid
  VARIANT 432: note = Any amino acid
MHVILPVVLLTSFKLINFHELICPPDNVIDHDLEGLNMLHEYKTKEYVLKEGALDVFSLSGYDCTKVRMKTGCKFHFFAKNDIINEMEMIPIDNRTCQNLSNKVLKYPEPECISGIFNNDYHYVSREESLSQSRTYLFNPTTNEVINYHDIFESKVDNVYKYKNNRGYWIAQNNEKKMECDHYEEHGSSDLKIKIYEKEKDKFISVNGKIYSVDNVCKINFCGLSLATTKDRIFFKLPPKVDIKTCIDEVSTPSKSDMVKVDNFYKECEENRMELISAKRFNYQQLMKFMPQTMGIHHVYRINSNKTLEMAIGRYGMVNLDTLNGTEHWIECGLETKCTYNGIMRPLTNKTSIEIDFNQLIKHHEEIKNGIYVYDNVYNQYYDETTTIYKTQNTLLTGLYMMLPWIAESVIILLXXXXXXXXXXXXXXXXXXRESDIKMGTW

SEQ ID NO: 15264 - protein, 447 aa, unidentified
MSYYIFPVILLSAFRPAGLEDVTCPSLNHDHKVDMSEYREYDWGMVDNSILNNDLYSVSGYDCHYVKLTTSCQANLLSKNVITYTKKIINAPIDQCQSLKEDKLAEYPLPQCEWNMFGSSITENSMQYMVTKERTYRLNPVTGNIVNEHIIFDSCSELHCVYKNSKGYFVKKPRSSKIDCSNHNIITVSNMKAATGKVNNHPAIQVMNRTMMIDDVCMIDRCGVKLVYLSDFQIFKVPHELKFKNCEEDHVQIKPEIALFTDLRDSIDCSILVERLLVRKEVKYADIKALHPTSIGINNVYRYKNGTLEVALAYYSRIDKVELMKHSNRWIDCGPKANCSYNGWIEPKERLDSKMLDVKDYEEFVSTIASTITTKLAGSFDQMVEEEISKKVIDSTITGFIQRNWIWAGEIISIIIICVIVFKFIIKSIKKKEDKILYLPSTRSNYY

SEQ ID NO: 15265 - protein, 246 aa, unidentified
DTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCSHHFHELFLRDGRKLIVPCRDQHELVGRSMVSQGGSSGVAGTACLAKAYAQMWLMSYFHRRDLRTLGFGIMSSV

SEQ ID NO: 15266 - protein, 337 aa, unidentified; identical to SEQ ID NO: 8339

SEQ ID NO: 15267 - protein, 337 aa, unidentified; identical to SEQ ID NO: 8339

SEQ ID NO: 15268 - protein, 638 aa, unidentified; identical to SEQ ID NO: 8641

SEQ ID NO: 15269 - protein, 579 aa, unidentified
MNSSYSQDNLYTNQTAAQPRGTWRVLYRAVSLIFQILIFSLVLTNVIQYSNLHSPSVSEISAATTTETIDGLKPHLETPLNQINDIFRLTALDLPIQMNTMTREITSQLNILTSGINELVTSNNSGRLLQTTDPAYTGGIGVFVLNNYLDYPPNLQNMSLLEQPNFVPGSTTTGGCTRIPTFHLSSTHWCYSHNIIEKGCHDAGHSSMYISIGVVQVSSRGVPVFLTTQSVIVDDETNRKSCSIVSTEYGCDILCSIVTERESDDYKSDPPTRMLHGRLLFNGSYVEAAVKFTNDINKFSANYPGVGSGILLGNKILFPLYGGIKQSTDLFNYLHNRTAQVSNNKTVCSTGYDKKKLEAAYRPPLIGGRFWAIGIVICKFSINSLGDCRYKIYDSSVVMMGSENRLMKVGNQVFLYQRSSSWWPIGLTYILNSTDLLNTDSDIVSSIIPIYHTKFPRPTYDRNACTRPNVCPATCIEGVYADIWPLNNPAEPSKIIWVSHYLNSEVGREFPAIGVANQYEWVKEFRPLPPTTGAAYATTSCFKNTISNRIFCVSVAEFKDNLFGQFRIVPLLYEIKVIN

SEQ ID NO: 15270 - protein, 260 aa, unidentified; identical to SEQ ID NO: 8254

SEQ ID NO: 15271 - protein, 758 aa, unidentified
  VARIANT 655: note = Any amino acid
  VARIANT 656: note = Any amino acid
  VARIANT 657: note = Any amino acid
  VARIANT 658: note = Any amino acid
  VARIANT 659: note = Any amino acid
  VARIANT 660: note = Any amino acid
  VARIANT 661: note = Any amino acid
  VARIANT 662: note = Any amino acid
MKKTMELIKVIPVACLLYIFLSRHILVGQCKDKIQTGKNTSPPKSRNFKGSPPDSDSVLAKTNLTQEESKRLSNISQVLEKIEDRDLAEFKRIILDKNLEKSLSEDKDGKIHLNAPKCGENDSYRCHRVNKILENVNDNIDHLNDLLRKSSGSNLREKLRELDDSSEGGGKGSKSDGHGSFLLHYPITVGNWSELEDPTLIKCPSHHRNQIGHSGSDRRLDLDIIARRPRTSTFQTSVPGYICHGMRWTSSCNEMWYFVTYHDRAVTSITPNKLKCIQNIQAWKRGEHVKPYYPLEECNWNAETTKTVDYHMIIPYSLRVDPLSLQFEGEIFLDSQSCKPGDSLCFTDDNSKIWFPDDDDKLVATGHCPDESWDESSLTIHPEKMPNDWSNENTSWSQDYILKGILFGEKRVRRSCLLEFCGAMGLLFEDGEWWEISVYSADSKRESLTKLFLKEEGINRCNGTEERIGVAGKETDEKALLDAVLRKTGYEKCKAARYRLTENKHLRLDDLSYINPRDSVMWPAYRVRRQSEGSEKYFSLETAMSEYGMVQVTRSLQMLGQKCYGVENCSMIVGYNLGKEIRSDDWTPSGHPGVYVGINGLIRKDDENTSRIYYPPLSKEYESVFSDSGEMEDEAYIYKPEIKHKGNVNPKKDDXXXXXXXXKNKTPLDDLSDWWKKLKGEWKLIKGIIVSFLVFLGLYLIIKCCLKLRSVIKEKKIKKVVDEEKSLELKERRAEPNIYEEINETSRPRVRRGRNYFN

SEQ ID NO: 15272 - protein, 784 aa, unidentified
MKDLHTLVLLVVLIKLYKGGSSVHTPMTRCTVYAPQQRIQCNRFDKVFRIRGGGVGIILCRRSQKFDPNLCTCFRDTNPGALSCYKLMTSKGSFPSEKESRGDEKPQESGTLADYLNVTFLEKTGKLGAKKGEDPDESRLLDAAIKSGGLGVDFNGHLKILNEESLTSNLNETDVNRIKGLLTSWNKDRLGGQPGEYDPNKWKKDAKEMTEEDENSERHRVNSTRLRMIFHPEGPYNWTAVTDPQRIRCPRPRLYSKSVDHNFRGVAKRPRVTETSLVRGYICEAHRWVSECEEMWYFSKYYTREIQTTVPEVLACIKAIKDLKSGEPEIPTFPLSLCNWNSKTSQGVIFHTATPVDILLDPFSMTYKSTLFPEKWPCNAHALYCLTSKPWRKWFPDEELTRLSPQLCKTTSWEAFPFFGDVIDLPSKPRDPSSLWTPHVLVENEIFGQKNLNDGCLMDFCGETGVKFPDGEWWLFSVLHGPRGGLKNLTSALSRCKNSSSLHQIAEVFPNLEDSGRRLELTSRERYERCLDVKDKLTAGYFMNPTDLGYIGQHQEGPGTAYRLKRLGTNKTGQLILMESPAVYRVLIHKEDYDEEGFRVWENSNSSWNESGKLSVQFGITSKGLKFEAEWTSLKSEGRWVGVNGILLLKGEKPGTWVISVPDSRQDLEDILSWEHLEGERVVYDERVILTSSDIELDDLGNTLDTEVETKNIFSGIIKWFDSVYSSVSSYIYIIGVLVAVGLGIWILTKAKRFIVRDRSPGNQTSEITIPMNRNRREDQRSYI

SEQ ID NO: 15273 - protein, 818 aa, unidentified
  VARIANT 755: note = Any amino acid
  VARIANT 756: note = Any amino acid
  VARIANT 757: note = Any amino acid
  VARIANT 758: note = Any amino acid
  VARIANT 759: note = Any amino acid
  VARIANT 760: note = Any amino acid
  VARIANT 761: note = Any amino acid
  VARIANT 762: note = Any amino acid
  VARIANT 763: note = Any amino acid
  VARIANT 764: note = Any amino acid
  VARIANT 765: note = Any amino acid
  VARIANT 766: note = Any amino acid
  VARIANT 767: note = Any amino acid
  VARIANT 768: note = Any amino acid
  VARIANT 769: note = Any amino acid
  VARIANT 770: note = Any amino acid
  VARIANT 771: note = Any amino acid
  VARIANT 772: note = Any amino acid
  VARIANT 773: note = Any amino acid
  VARIANT 774: note = Any amino acid
MKKTMETIKNFILILSVAVQLDTGHGMEFALIRNTCDTRSMKQVPCQHLISVRESTGPKGKCLIFCAKEKRRWAEGVESQCLQGDPTSPQVVKCKERIEKGLERLTVLTSSKRKRMREPFRARGNQTKEEGGRLIRISDVLKRIDHKDLEQFKKDVLEKNVETFLYVNSSNLIDMHKNYSCSPPDGFECYSIKRAIDDSNEKVLYVQKAQKEKDKSTWSKDLLSDAYRREEGTIETATERGFLIHYPIESRDWSNLTDPSQIKCPSHQGDRLRKSGTLRNVDLEIIVRRPRPGNFKTAVPGYICQGMQWTSTCNEMWYFVTYHDRAVKTITPNEVKCLQNIQSHKRGEDVRPYYPLEECNWNAETTKTVDYHMITPYSPLVDPFTLEFKSEIFLESSSCSPGDKFCLTDDTSRIWFPDQDDPLIALGHCQDTTWDESFLTVHPEEIPRNWSDPNSTWTNDLILKGILFGEKRVSKSCILEFCGELGLLFEDGEWWEINVFSKEQHRSRLTKQFLEEEKLERCTGTESRIGVVGKETDEKALLDAALRRSGYEKCKAARYRLIENRNLRLDDLSYINPRDSVNWWSYRVRAEDSDRLFRLEKAISLYRLVQVTPKLLKGGQVCEDKRNCSLIIGYHKGKEIKSSDWEETGHDGVYIGVNGLIRRDTRNVSYIYYPPLIKEYEEMFSDSGEIEDEAFIFQPEIHSKKTKPKSDDQDSSTDSKKNKTPIDDLEDWWKKLKSEWGAIKGTLIGVTLIVXXXXXXXXXXXXXXXXXXXXGKKSEAGKEEKEKEMVRFRATPNIYEEIDERSPTRPRGRRTIFT

SEQ ID NO: 15274 - protein, 503 aa, unidentified
MSGCCLFLCFFIIWLLSTSIFVKITFGFSTLSCNDYPGTPSVVSCLQTCHNFSYNKPLAISILPQTIKQSLILVKCEKVTISKAFTETWTLSRIEGEGVEKTEATTIQACLKEWETKCDKKECRTKDPQISEHYSWATTEVSSLEFIRVYAERVAVIEVISEDPKINIEGRSVSVNDRGYRTLGHTYAWEVSPIDTKCPWDAPSHTTVCYDLGGRMACPSQGISISKAVELKTNCKFTVFRDKTGIVFSPVGALNHEYYPVPTLTIDTGLKQTIEGVRLALSIRDMQDCRYRCISMSSGYLKIDDYYYIQQNKKWLECSLLPNCTVGSESLSCNDGELVQAFCLGKPTWVNMTSAIGMRTPNCTKPNSKPVGREDIIALLNKYHASHSLFNLLSSDDIADITMTYLDKLKDLKLYTLNISQSTHSVDRHIEFLSPLQWIRNTLSRLSHKIKKVFVSIFFGLLSLIMLYATIGAFLNCMKKRRRPSISYSIVPRGIPPVVMKSF

SEQ ID NO: 15275 - protein, 500 aa, unidentified; identical to SEQ ID NO: 15213

SEQ ID NO: 15276 - protein, 560 aa, unidentified
MSDMSKANNRSCSPIIMLFFCLMNCCYSTMVEKSIGPVASCHGDFVSTGSVIKSCYHRCMMDPEPVDRANLELYKVKTNLDGPEVIECAKIKQRQTFTQTWSFSTIKSPVSHEFLRVTKEECDKAIADNCPDKHCNHRERDELEEEYHYASDTVKEATTISLITMPSSIQVSGSTINISPMSAKNYYSSQDGMAKEDGKMYIWDSGFVVSGCPYEPVTTYGCDMYQDSDHRRYYMCSGGRFSITAPDLDESDMSNKCPGMKRAIEGFIYKRVEKTAASHDHSRLAITQTADMKADVDYLRHKVQQIATHLDSEICQLQCEVLSVESRLTRKDSAIVRIGMNYYKMYDNGTMAGCLTLHGCRMTKPSIYCGNPPRIGVTCTENNGLWDPTTIELKRGGVCMKPDRNEKLSISLGSEHYVVDDSLKVHLNSSNMHGVYMTSFSDLHQSSVQWTISDLDTLKPEWDIQKSGKGGLSRSVEKHTTLLTPAISVGSSLVSACRSLSNGFASVEHIVGSISIALASLVFMWFILRVLNTFKRAKKSVRTERYDPVNVASSDQGTWA

SEQ ID NO: 15277 - protein, 431 aa, unidentified
EFVEPFLVLKHDHNTMLTTRLYPGEIAHVATPTGLLDIRVGNAGIFGSQLFRELLRDCKVNASYSTDICPGGSQLDMEAIQGPGRVCFTAPYNRGWGTGCFKWGIGAVATCVELNCSSSMGVHLLTNSAIVANVSVGFHSTNDTKMLVPDAPTTLKFGKLGTVTMNCRLGNDRIATSYYHVTDGLSTGLFLKAQIDAWSGPFRMAGLTGGFDKIVKWGQVTPNEIKVKRISEMELDWDNAITTHDGFVNTYFWCQIAVNKLVVGTFASCKSEAQTVFSQSPWGFEGIAEITLKEAQKSICSLPLSCVGCSLLSTKVVFLETTTKAAVHVGCGNGTSVLTVGTTPVSIDCVVTPLSQVWRLVSHVTGRYTKLGFGGVGGVFHDLLQACGWVFTWDSWKVILILGGLVVLFIVFDRKIVLVVMIASAVVYVKA

SEQ ID NO: 15278 - protein, 310 aa, unidentified; identical to SEQ ID NO: 9321

SEQ ID NO: 15279 - protein, 337 aa, unidentified; identical to SEQ ID NO: 8339

SEQ ID NO: 15280 - protein, 484 aa, unidentified
TQCVNIQKRDIIRGASDVSWFDVLLEKGACVTISAQDKPSVDLWLDDVIQESLIEGRHYCTKASITDLKADARCPTQGEATMREEHLDGYVCKRSFSDRGWGNGCGLFGKGSIVGCAKATCGANDIIKSYSYDSPKVKYVIGAEVHQGKLLTNNSTDRIVKTTLTAESEKHTITIADYGSMDFTCRVVASAELSNIRMIELDGHMFNVHEDWLSDLPLPSKISGGSWHGMDRLVVFKEPHAVKMEIQECGDQRPAVFKSLVKAEEVTKTSNSYHLTGGHVDCRVSTLNLRMKGLTYQMCSSSFVWHKRPVATQHGTVAMEVKYKGSDAPCRIPVSVEKEGYNGKNFGNLITANPFAANNEAVVFLELEAPLGVSTIKVGGAVFQWKQEGSSIGKAVTLMKRNIEKTLITSSAYWSSSEPFTSAGIMRILRMPFDMIFGGVGFLGKLMISGVLIWLCVNVQNSTLSVVSGVIGFMLLGFTTGVMG

SEQ ID NO: 15281 - protein, 429 aa, unidentified
VKGEFVEPLYTLKAEQMTMLQTIVRPEEGYVVATPNGLLEFKTGPAEIYGGQWLRELLADCHVNASYSTDVCPGGSQLNMADIMAKERVCSTQPYNRGWGTGCFKWGIGFVGTCVELHCDRGFNVSSIARSAIVMNVTASFHSVSDTQQMVGDIPLTFRFAKLGNAAMTCRLESEQLLLDYYHVTGSSHEGLFLRSQIDSWPGVHSTASGRHGMEKVVVWGDARSNEILVKNVIEPSLSWEDAIATHDGFRDISFVCQIMLDKLVSGAFRDCPGPKTSTFSQDGFGYSGVVITTLTASSNETCSLSLTCHGCLLQSTKMIFLAGKTTSRAFVKCGNHTSTLLVGSTSVSIECALNPISQGWRLARHVVDRYRRFGVSGVAGVWQDLVGKFSVGAFFSNTTLLVIFVLAALIDKRIAFLLVLGGYFYYVR

SEQ ID NO: 15282 - protein, 501 aa, unidentified; identical to SEQ ID NO: 8222

SEQ ID NO: 15283 - protein, 337 aa, unidentified; identical to SEQ ID NO: 8339

SEQ ID NO: 15284 - protein, 430 aa, unidentified; identical to SEQ ID NO: 8534

SEQ ID NO: 15285 - protein, 334 aa, unidentified; identical to SEQ ID NO: 11116

SEQ ID NO: 15286 - protein, 337 aa, unidentified; identical to SEQ ID NO: 8339

SEQ ID NO: 15287 - protein, 337 aa, unidentified; identical to SEQ ID NO: 8339

SEQ ID NO: 15288 - protein, 499 aa, unidentified
CLGMGNRDFVEGVSGATWIDVVLEGDSCVTIMSKEKPTLDVRMMKMEASNMAIVREYCYEASVSDISTESRCPTMGEAHNQKRGSDKYVCKSGVVDRGWGNGCGLFGKGSYDTCAKFECKKKAQGRLLQQENIKFEVGIFVHGPTNVENHGNYFAHVASGTASRYTVSPQAPSFTAKMGEYGEVTVDCEPRSGVDLASYYVMSVGNKHWLVHREWFNDLSLPWTGASANTWRNSELLVEFEEAHATKQSVTVLGSQEGSLHQALAGAIPVDVSSETVTLTSGYLKCRLKMEKLALKGTTYGMCAQSFSFAKNPVDTGHGTVVLELTYSGSDGPCKIPITMVTSLNDLEPVGRIVTANPYVAGSTSNTKVLIELEPPFGDSYIVVGRGNKQINYHWHKDGSSLGKAFTTTLKGAQRLAALGDTAWDFGSVGGVFSSVGKAIHQVFGGAFRTLFGGMSWITQGLIGALLLWLGVNTRDRSIALTFLAVGGVLLFLAVNVHA

SEQ ID NO: 15289 - protein, 496 aa, unidentified; identical to SEQ ID NO: 8708

SEQ ID NO: 15290 - protein, 496 aa, unidentified; identical to SEQ ID NO: 8708

SEQ ID NO: 15291 - protein, 496 aa, unidentified; identical to SEQ ID NO: 8708

SEQ ID NO: 15292 - protein, 502 aa, unidentified; identical to SEQ ID NO: 8762

SEQ ID NO: 15293 - protein, 496 aa, unidentified; identical to SEQ ID NO: 8708

SEQ ID NO: 15294 - protein, 315 aa, unidentified
LGDTACFRFTNQQGDTIGTLNVLYDLSLYVAPLSPIYYTSDWLGLSCSHKSCRNDHPCSLSDGCPSDSTLLNSVLTPQCVVYPGRTKCESSCGCAGCGCFFCSDACLISRAAFQPVGLPYQVKTIGSVSVYPRLTVEYNFNGTTVSSTSDLFNPLSTPDFTLNLVGSYQAATTSISLGAAAFSSDGASALYYSYSDYNNPQFGVIGDVQSSLINGFSNPPYNFIFPDSSISQITSSSSVDYQFPQSGISRARQTPFPLLKDGIIYTADSERLYGLNPNAPAITVAMSSSHTSFSLVSETVCPKYVSHSISGCYNC

SEQ ID NO: 15295 - protein, 383 aa, unidentified; identical to SEQ ID NO: 8737

SEQ ID NO: 15296 - protein, 608 aa, unidentified
MTLFILLVLIPLTACERIDFPDHSPIFYYERELPPLSLGFPVRDPCLANNLKPETFKRDNITVLTPDTSLLTLKGLSISKVFTKTSCIFYFFGSKEHTILSQYHLPLLPSDKEFLEQALTNDSKWTPPSEELYDCAWTGETIKETQAYEVKPITITVKGNLKILTPSGFDTCEIHGRKFCYSQEDRLLIHWTGSISLGDGFCPGLKVAISHPGHIYKEPNKGTIVEIPDLSLRFYIKKEAEEICSGVLMDENGYFLSSTKFTAIHNTTPLKDTSILGMRKVFHKKQTCLKSCKEKFACSSCLSQANTNWESEFDTERFLSTHGFSPRLTLSESELDYVSEHISQLTSLRLGQLAIEVCKTRNYQWIQALVTSDANQLARLISGESLALGVLKDGVLYVVLPKQAKAVVLLQKLPNDSHFHVEYLTVNGSQQSGCLQPNTGLILECDQILTTGLKSFLAPWGPNMIKDLISGQVFATPTLIQSSSPNHYTFSHEVLTTLGDIWMAIQSQGQWTNQRITEGHLVNILNGKTSNPDLSKVLYPFEWIASMARGGFSTLIGALIGVLALILLVVIILKCGKGICEKQPGSRLSLKHFKQDGEKEVYTLKAIS

SEQ ID NO: 15297 - protein, 589 aa, unidentified
MEFLVAAAGLISLPPSTPLFYPLSSYRDYPIPIPERCLVSSSQASETFPSKVSLLVPDVSVHLLTATIWSVIETRTSCTVYFFGAQEQMILTRRNADPRDAEHLVDRLLVEDPASIEEDLDKEDMYSCSWTGTYEKTSYRLVSQNISLSLSSSGKVLSPASLSSCDFSTSRKCISPTKNSVYIGSRLFKPLETSVLCEGLKIAFVQPMRVGYDNGIHRVWSETETLEFYVRSNSTGPCDDLFVSEEGYLLHFNPSLLSLPLTNSSLDHPDTEMFYEDVQCQNACLTPSDCAQCGVRRHSSSQKKKTWDEWKLLHNFQSRLTLTEAEVQAAHSVNEAQTQSDVSQLQSALCNLRHLLWSSFQSTRSGTLAAQYITGTPYHLGTFTGRYIRVWDSARAKNVRIDPSVVKGSTVKAIYVTEAGEEQIGGLTLGGFIISGLSGRQNSIPAGFVPFGNDSYIEIIGRTVRKTPGLFNIATPSHLSFPDQNLYTPGELTNGSEGILEALADIQIGDSLVRLSSGQGVLGNHRASNLLAPLKSFETWVNTTWMNWVVGFFTVILGIFFCTCGIRCIQVCWRMGKAPAPVERMSHRV

SEQ ID NO: 15298 - protein, 500 aa, unidentified
VAIGGQTWGLVGYDCTSSVANITTISLFSVLPCELDQKPQSEYLSVIQVVQQRSVSRVHTFSCLVIRSSVIHHCGMHHHTSVGPMSIGEIMHTSNTQCADLHHFGKLAVGSGTLLTGFKVNETVQISITEHGYSDSEFKCRGTSFSHNGIAYHDAVMKSSYTVTLREEWASLDLDTGDLKMSTGYMHPFKTGQSFDASAGDVFWSTQDNQDCTPTSYLVLHEGAGIIYQGHRDTKTLVVNSSTHAMAVGILGPTLVCHQPALRTEHPKIFIVMKHPGSPSFFFKKSIVDPANVDMFLYINSKLVYLERHMGYQMSLVYEHFHKRTCNIKHQLLRHLIAIAVMNPEEFAWLYSKRPGVTAILRGELIYLMECQAVPVTIRKPSGRCYNELPVTFNNTPMFIKPRSRILVHYGSEIDCSPIVPAGFMIEGRWWALRPDSTQLPAPTTLSAEPEEGKWSYTSPHDLFKSGIYTLEELLAFQKRLLFSFEKPAISHTLSSAAAR

SEQ ID NO: 15299 - protein, 533 aa, unidentified; identical to SEQ ID NO: 8735

SEQ ID NO: 15300 - protein, 603 aa, unidentified
MIALYTVLLFVSMSYEAAGLTPGNSLVIEELGLLLEPEGLLVGSYEDRYVHLVYDYNHIPFQKNASCGRSNNPAVHGEERVKSLENLLKLIFRKPEEDSGKIPCISGSSNCTSAQPGLGNRKKRFLGTLLVGLTSLFGVGTSLSNTITLREQEAAISFLKTQESIVERSIAVLQSTSQKTIQALDNLYILSKNEFQKYDKYFRYMECELISEHYEILYHEMLRVLESRIKDLIGALLTGDVNPGMIPIELLRSILSTPQGLDSNYLSDNPSIIYQVGRVYPISLNVDKKRIHFLLQIPIIKSSDVTHLYHILNFGFSLDSKSNKHGILKIQEQIGLLHHNDILWPLSIRQDSCAKHNNILFCRFHPIHKTIKQDFMKDLINYNISTNRTVNIHDIAEDVHVVDRGSSYLGVSTWADKTNIIHTRSGISILNCKTYSLIKKIRTHVSVSSEHTCRHYLTFVAYTSFETLVVHGTVIQSPLITNIVEHLSYNIDGLEDLSIPPTLDIQAWEKLSVVLNKTKELSTQQSHYQAMEQHLSNPWVNLVLIIISFSLMVLIIGIGYITFRRLTLHKRKITNTQELSLAMSSLLKKQHQEMLLPYQVEKM

SEQ ID NO: 15301 - protein, 601 aa, unidentified
VLCVLVAIGGQTWGLVGYDCTSSVANITTISLFSVLPCELDQKPQSEYLSVIQVVQQRSVSRVHTFSCLVIRSSVIHHCGMHHHTSVGPMSIGEIMHTSNTQCADLHHFGKLAVGSGTLLTGFKVNETVQISITEHGYSDSEFKCRGTSFSHNGIAYHDAVMKSSYTVTLREEWASLDLDTGDLKMSTGYMHPFKTGQSFDASAGDVFWSTQDNQDCTPTSYLVLHEGAGIIYQGHRDTKTLVVNSSTHAMAVGILGPTLVCHQPALRTEHPKIFIVMKHPGSPSFFFKKSIVDPANVDMFLYINSKLVYLERHMGYQMSLVYEHFHKRTCNIKHQLLRHLIAIAVMNPEEFAWLYSKRPGVTAILRGELIYLMECQAVPVTIRKPSGRCYNELPVTFNNTPMFIKPRSRILVHYGSEIDCSPIVPAGFMIEGRWWALRPDSTQLPAPTTLSAEPEEGKWSYTSPHDLFKSGIYTLEELLAFQKRLLFSFEKPAISHTLSSAAARQPADLSGIDGAGLFHPGQLEEIQKNFMSKIWGWYWNVSVVLGGLVGIYMVFQLIKSVINSIITCTCLYRAYGCGVEILTCCFSSCAKYLLLKRHTD

SEQ ID NO: 15302 - protein, 595 aa, unidentified
VLCVLVAIGGQTWGLVGYDCTSSVANITTISLFSVLPCELDQKPQSEYLSVIQVVQQRSVSRVHTFSCLVIRSSVIHHCGMHHHTSVGPMSIGEIMHTSNTQCADLHHFGKLAVGSGTLLTGFKVNETVQISITEHGYSDSEFKCRGTSFSHNGIAYHDAVMKSSYTVTLREEWASLDLDTGDLKMSTGYMHPFKTGQSFDASAGDVFWSTQDNQDCTPTSYLVLHEGAGIIYQGHRDTKTLVVNSSTHAMAVGILGPTLVCHQPALRTEHPKIFIVMKHPGSPSFFFKKSIVDPANVDMFLYINSKLVYLERHMGYQMSLVYEHFHKRTCNIKHQLLRHLIAIAVMNPEEFAWLYSKRPGVTAILRGELIYLMECQAVPVTIRKPSGRCYNELPVTFNNTPMFIKPRSRILVHYGSEIDCSPIVPAGFMIEGRWWALRPDSTQLPAPTTLSAEPEEGKWSYTSPHDLFKSGIYTLEELLAFQKRLLFSFEKPAISHTLSSAAARQPADLSGIDGAGLFHPGQLEEIQKNFMSKIWGWYWNVSVVLGGLVGIYMVFQLIKSVINSIITCTCLYRAYGCGVEILTCCFSSCAKYLL

SEQ ID NO: 15303 - protein, 587 aa, unidentified
MYNIKEIVFISFICITYGHIGDIMTDNLIGYDCSLSTKHTEISLSPIVDCSIPKRNVTFSDVKIQIVQPKIVTELEYIQCSAIYRYEIVYCGKFGGRNTPLDRQVHVEKVNKYDCVEAHKTHIISPGFHRELTVTIENNVGRYSGVIIGNTDDKSCDGSVFHSPGGVRYNRVVVFLDYEIILKTGVGTVEPSNYNAKVVLSSGNTCLYEDTTCFDGINGRTYWIDKLSRSCETSGYEAIYEGVVSRIIDDDKQSPVISYLTKKADKQRFFIKQTSPVTICGMPGYRTQHPNVFVIERGNYDFNIKYNPSSLSPRSINLDTHLGMKLSYLQYDTGSQIDQLYLLLKGEICEINAKTVRNSLSLAKLDPKDFGYLYYGKPGFLGLVRGEVIYLKECVPQIVNIRLSENCYQDLPILYNNESYFLTPRSKLIVKEGHEIECSNLMPEKYFVEGTWYRKNRHGLDAAPSPTEISVRLNGNWSFQQDHEISSKGIYTREEIEKYQKMISEPISTMAKQISLIKSIDGDRDIWEGADVTNAIKPEDFENFRKKAYPTVWSRLRAGFLDFGGFSGAILGIYVAFKFFYSNSGRT

SEQ ID NO: 15304 - protein, 659 aa, unidentified; identical to SEQ ID NO: 8739

SEQ ID NO: 15305 - protein, 574 aa, unidentified
SRLIQVSAIIGFDCTDPSSNVTAVSLTQIGDCVVRNRNVTTTTTNIRVYQSLDFTMTTVYSCLIEMSHIISRCGKSIDQFHSGGFYSEIPSITRATCLDMIDTGKINLHGNSMEGIEVGVPYSVALMTYGTIDQDGSCTTPGDLIVNGRVFTRAIRNTNIKILVTKYQANVDIDQSELKLSTGIVCPFLKRECFSAQTGYNYWNSFLENIVCEGTRPLVQLYEGPATKAIESINSHPIQTYMFKRDKSDFAIGANNPGQFCGYNDIIQTDHPNLYIVEEKNWNLVKLKTRKLMTTDIDITAYMNSKMLYIVNHVTNQVNNLYDAYLKDRCKTEESVLRQTLTLAYMSPNDFAYDFMKGPGYTATVSGEVIYIIKCQAKSVNYRPVSETCYKELPVLIDNKPGFVMPKTHLITMIGTEIPCNPLLPPVFLLGEYWYSPSHQLIRSTPPLVLKPSEPHVWQFEQISNLISSGIYSAEDLHLYRKAFLAPDGEKAFIGTFAKKTIRWNGDDYTGNVVNSFNEHDIDLLNERLGNWFHNMYRKLGNFGSFMVSIFIIGRFLLWIINLFLNCVKLRMEG

SEQ ID NO: 15306 - protein, 611 aa, unidentified; identical to SEQ ID NO: 8738

SEQ ID NO: 15307 - protein, 623 aa, unidentified; identical to SEQ ID NO: 8740
  VARIANT 575: note = Any amino acid
  VARIANT 576: note = Any amino acid
  VARIANT 577: note = Any amino acid
  VARIANT 578: note = Any amino acid
  VARIANT 579: note = Any amino acid
  VARIANT 580: note = Any amino acid
  VARIANT 581: note = Any amino acid
  VARIANT 582: note = Any amino acid
  VARIANT 583: note = Any amino acid
  VARIANT 584: note = Any amino acid

SEQ ID NO: 15308 - protein, 539 aa, unidentified
LVGYDCTSSVANITTISLFSVLPCELDQKPQSEYLSVIQVVQQRSVSRVHTFSCLVIRSSVIHHCGMHHHTSVGPMSIGEIMHTSNTQCADLHHFGKLAVGSGTLLTGFKVNETVQISITEHGYSDSEFKCRGTSFSHNGIAYHDAVMKSSYTVTLREEWASLDLDTGDLKMSTGYMHPFKTGQSFDASAGDVFWSTQDNQDCTPTSYLVLHEGAGIIYQGHRDTKTLVVNSSTHAMAVGILGPTLVCHQPALRTEHPKIFIVMKHPGSPSFFFKKSIVDPANVDMFLYINSKLVYLERHMGYQMSLVYEHFHKRTCNIKHQLLRHLIAIAVMNPEEFAWLYSKRPGVTAILRGELIYLMECQAVPVTIRKPSGRCYNELPVTFNNTPMFIKPRSRILVHYGSEIDCSPIVPAGFMIEGRWWALRPDSTQLPAPTTLSAEPEEGKWSYTSPHDLFKSGIYTLEELLAFQKRLLFSFEKPAISHTLSSAAARQPADLSGIDGAGLFHPGQLEEIQKNFMSKIWGWYWNVSVVLGGLVGIY

SEQ ID NO: 15309 - protein, 505 aa, unidentified
VIHHCGMHHHTSVGPMSIGEIMHTSNTQCADLHHFGKLAVGSGTLLTGFKVNETVQISITEHGYSDSEFKCRGTSFSHNGIAYHDAVMKSSYTVTLREEWASLDLDTGDLKMSTGYMHPFKTGQSFDASAGDVFWSTQDNQDCTPTSYLVLHEGAGIIYQGHRDTKTLVVNSSTHAMAVGILGPTLVCHQPALRTEHPKIFIVMKHPGSPSFFFKKSIVDPANVDMFLYINSKLVYLERHMGYQMSLVYEHFHKRTCNIKHQLLRHLIAIAVMNPEEFAWLYSKRPGVTAILRGELIYLMECQAVPVTIRKPSGRCYNELPVTFNNTPMFIKPRSRILVHYGSEIDCSPIVPAGFMIEGRWWALRPDSTQLPAPTTLSAEPEEGKWSYTSPHDLFKSGIYTLEELLAFQKRLLFSFEKPAISHTLSSAAARQPADLSGIDGAGLFHPGQLEEIQKNFMSKIWGWYWNVSVVLGGLVGIYMVFQLIKSVINSIITCTCLYRAYGCG

SEQ ID NO: 15310 - protein, 588 aa, unidentified
VGYDCTSSVANITTISLFSVLPCELDQKPQSEYLSVIQVVQQRSVSRVHTFSCLVIRSSVIHHCGMHHHTSVGPMSIGEIMHTSNTQCADLHHFGKLAVGSGTLLTGFKVNETVQISITEHGYSDSEFKCRGTSFSHNGIAYHDAVMKSSYTVTLREEWASLDLDTGDLKMSTGYMHPFKTGQSFDASAGDVFWSTQDNQDCTPTSYLVLHEGAGIIYQGHRDTKTLVVNSSTHAMAVGILGPTLVCHQPALRTEHPKIFIVMKHPGSPSFFFKKSIVDPANVDMFLYINSKLVYLERHMGYQMSLVYEHFHKRTCNIKHQLLRHLIAIAVMNPEEFAWLYSKRPGVTAILRGELIYLMECQAVPVTIRKPSGRCYNELPVTFNNTPMFIKPRSRILVHYGSEIDCSPIVPAGFMIEGRWWALRPDSTQLPAPTTLSAEPEEGKWSYTSPHDLFKSGIYTLEELLAFQKRLLFSFEKPAISHTLSSAAARQPADLSGIDGAGLFHPGQLEEIQKNFMSKIWGWYWNVSVVLGGLVGIYMVFQLIKSVINSIITCTCLYRAYGCGVEILTCCFSSCAKYLLLKRHTDPD

SEQ ID NO: 15311 - protein, 420 aa, unidentified; identical to SEQ ID NO: 8396

SEQ ID NO: 15312 - protein, 469 aa, unidentified; identical to SEQ ID NO: 8734
  VARIANT 205: note = Any amino acid
  VARIANT 206: note = Any amino acid
  VARIANT 207: note = Any amino acid
  VARIANT 208: note = Any amino acid
  VARIANT 209: note = Any amino acid

SEQ ID NO: 15313 - protein, 569 aa, unidentified; identical to SEQ ID NO: 8733

SEQ ID NO: 15314 - protein, 578 aa, unidentified; identical to SEQ ID NO: 8698

SEQ ID NO: 15315 - protein, 43 aa, unidentified
PKGCLTGVYSDAYPLSPDYTTVATMILHDSTTRKSPVMVYATP

SEQ ID NO: 15316 - protein, 370 aa, unidentified
ALCILLCLSPASAACISTTTVAIPTTQCTLLNGNYTCQTSLNANINLLHLGDTACFRFTNQQGDTIGTLNVLYDLSLYVAPLSPIYYTSDWLGLSCSHKSCRNDHPCSLSDGCPSDSTLLNSVLTPQCVVYPGRTKCESSCGCAGCGCFFCSDACLISRAAFQPVGLPYQVKTIGSVSVYPRLTVEYNFNGTTVSSTSDLFNPLSTPDFTLNLVGSYQAATTSISLGAAAFSSDGASALYYSYSDYNNPQFGVIGDVQSSLINGFSNPPYNFIFPDSSISQITSSSSVDYQFPQSGISRARQTPFPLLKDGIIYTADSERLYGLNPNAPAITVAMSSSHTSFSLVSETVCPKYVSHSISGCYNCPQGFTI

SEQ ID NO: 15317 - protein, 420 aa, unidentified
CLSPASAACISTTTVAIPTTQCTLLNGNYTCQTSLNANINLLHLGDTACFRFTNQQGDTIGTLNVLYDLSLYVAPLSPIYYTSDWLGLSCSHKSCRNDHPCSLSDGCPSDSTLLNSVLTPQCVVYPGRTKCESSCGCAGCGCFFCSDACLISRAAFQPVGLPYQVKTIGSVSVYPRLTVEYNFNGTTVSSTSDLFNPLSTPDFTLNLVGSYQAATTSISLGAAAFSSDGASALYYSYSDYNNPQFGVIGDVQSSLINGFSNPPYNFIFPDSSISQITSSSSVDYQFPQSGISRARQTPFPLLKDGIIYTADSERLYGLNPNAPAITVAMSSSHTSFSLVSETVCPKYVSHSISGCYNCPQGFTITFNAFSACRPGSVSVVVEGNFLCTTSFVTLNTTSLPSILYCISQQKQIEGTIKLLG

SEQ ID NO: 15318 - protein, 499 aa, unidentified; identical to SEQ ID NO: 15288

SEQ ID NO: 15319 - protein, 526 aa, unidentified
MVHKAFLLILLLVSPPCLGKFPIYTIPDKLGPWSPIDIHHLSCPNNLIVEDEGCTSLSGFSYMELKVGYITTIKVSGFTCTGVVTEAETYTNFVGYVTTTFKRKHFRPTPDGCRNAYNWKTAGDPRYEESLHNPYPDYHWLRTVTTTKESLLIISPSVVDMDPYDKSLHSKVFPTGRCSGISVSSTSCSTNHDYTLWLPEDPKPGSSCDIFTTSKGKKASKGGKICGFVDERGLYKSLKGSCKLKLCGISGLRLMDGSWVSIQNPEDTKWCSSDQLVSIHDFHSDEIEHLVVEELVKKREECLDALESIVTTKSVSFRRLSHLRKLVPGFGKAYTIVNKTLMEADAHYKSVRAWNEIIPSKGCLKVGERCYPPFNGVFFNGIILGPDGHVLIPEMQSSLLQQHMELLESSMIPLMHPLADPSTVFRGDDEAEDFVEVHLPDVQKQISGVDLGLSEWERYLLIGVAALGLFAFAIILAVCCRRGRRRKRTPSDPMEMIRKVSVTSQSGKMVPSWESYKNGNGSRLGV

SEQ ID NO: 15320 - protein, 866 aa, unidentified
KRIWKFLTMAIDMLAPQQYADPITWRSDEPVWVDQWPLTSEKLTAAQQLVQEQLAAGHVIESNSPWNTPIFVIKKKSGKWRLLQDLRAVNATMILMGALQPGLPSPVAIPHNFLKIIIDLKDCFFTIPLHPNDQKRFAFSLPSINFKEPMKRYQWKVLPQGMANSPTLCQKYVAAAISNVRNAWPQMYIVHYMDDILIAGSEGQQVLQCFSQLKEHLTMAGLHIAPEKIQLQDPYTYLGFHMNGPKITNQKAVIRKDNLQTLNDFQKLLGDINWLRPYLKLTTGDLKPLFDILKGDSNPNSPRSLSKEAQMALNTVETAIAEQFVTYIDYSQPLIFLIFNTTLTPTGLFWQNNPIMWVHLPASPKKVLLPYYEAVADLILLGRDNSKKYFGIEPFTIIQPYSASQINWLMQNTETWPIACASYAGNLDNHYPPNKLIQFCKLHTFIFPQIVSQSPLNDALLIFTDGSSTGIAAYTFSGTTVKFHTTLTSAQLVELQALIAVLSAFPDQPLNIYTDSAYLAHSIPLLETVTQITHISTTAQLFLQCQQLIHARSIPFYIGHVRAHSGLPGPIAEGNKLADLATKTIALNLQTNLKSAQASHALHHLNAQTLKQMFNIPREQARHIVKNCPTCVTYLPVPHLGVNPRGLFPNMLWQMDVTHYSEFGKLKYIHVSIDTFSGFILATLQTGEAAKQVIAHLLHCFSIIGPPKHLKTDNGPGYTSKTFQDFCSTLQIKHTTGIPYNPQGQGIVERAHLSLKTTIEKIKKGEWYPTKGTPRNILNHALFILNFLNLDDQGKSAADRFWHNDPAKQTAMVKWRDPLDNKWHGPDPVLIWGRGSVCIFSQTHDAARWLPERLVRQINNDNQSRE

SEQ ID NO: 15321 - protein, 337 aa, unidentified; identical to SEQ ID NO: 8339

SEQ ID NO: 15322 - protein, 165 aa, unidentified
KVTPDPRMAAALCILLCLSPASAACISTTTVAIPTTQCTLLNGNYTCQTSLNANINLLHLGDTACFRFTNQQGDTIGTLNVLYDLSLYVAPLSPIYYTSDWLGLSCSHKSCRNDHPCSLSDGCPSDSTLLNSVLTPQCVVYPGRTKCESSCGCAGCGCFFCSDAC

SEQ ID NO: 15323 - protein, 377 aa, unidentified
RMAAALCILLCLSPASAACISTTTVAIPTTQCTLLNGNYTCQTSLNANINLLHLGDTACFRFTNQQGDTIGTLNVLYDLSLYVAPLSPIYYTSDWLGLSCSHKSCRNDHPCSLSDGCPSDSTLLNSVLTPQCVVYPGRTKCESSCGCAGCGCFFCSDACLISRAAFQPVGLPYQVKTIGSVSVYPRLTVEYNFNGTTVSSTSDLFNPLSTPDFTLNLVGSYQAATTSISLGAAAFSSDGASALYYSYSDYNNPQFGVIGDVQSSLINGFSNPPYNFIFPDSSISQITSSSSVDYQFPQSGISRARQTPFPLLKDGIIYTADSERLYGLNPNAPAITVAMSSSHTSFSLVSETVCPKYVSHSISGCYNCPQGFTITFN

SEQ ID NO: 15324 - protein, 571 aa, unidentified
MITISNQLSNLSSSVLMTMTTSSLIIRFCLFYLLISLSLCDEQSVKMLHKISPVALCDPYKSVNVYERLDECVHRCSNAIDYAGRAQLTLIHDFSKIKGPLIATCSKVQISQTFTETWTFSHIKSSPLRKNLPVGESECTEYIKKHCPDYDCDVAAPSELKEQYAYASDIDRKEEYIELRSHYGTILEIKGILKVSLGVSGEEFNASTGKGSDKNRWHFWDSNMSPGNCPLSDGLVMGCDIISNNNLQYYMCGGSRLAIQKTDSSQLTGSCKDIWRSPSGVLYKVNEASDSSSYKGQKIGMANYKKVDENMDSIRILSQHAIYHVDADLCALQCEVAGIEIKGARRAYTLIRSGAEYILVSPKGHGFQCNPVVQCRLQKPLKMCGSPPRFSVVCNGLSRYWNPALNYILDSDNCPAPSTEEKLRIHIGNKLYDVDDQMYLNLSSDDPYVHKSRSIHLSHDALFEDQDMSEIRSSWMAHKSKNRTSIALNSKDIVNQKSIGLSGISTWVSSSLSNITKMIKHTELAFLLTVIAIVVGYVMYKILTSPRYGYKRTRTNGNDNELNQVSRAQWF

SEQ ID NO: 15325 - protein, 550 aa, unidentified
MSVLVLIVLYSCFLTDVSAEQFFNATVGPYSVCGSKSANIESKLKECYSRCRKPPQPAGGYTVTIYEADVKNGGPNVVECRKVTIEQTFTKSWLFSTTTSEPRIVSQAASESECRDAISKNCPSYDCNLREPSRLDAEFNYAADTVVRKSFITAQSMPSSILTHGGDIIIMPLSSEKQFKITDEKGQTAIGMYIWKTISKYETCPFSARGKYGCDYYDHDGPDKHFLCARGGFTLTLHDKVNKAIPSCPDIFISGEGILFTMDQESDLNLYSQRISLTGSQYKQEDTESFRNKMNHVLANLDSDLCVLQCEVLSLEARIKRDQPKLLKIGSDMVLLEPNGTGVGCSPAYGCSLIKPHILCGNPPRVGISCTGKIGYWDPTSPYVQLGGICSRPMINEKINFTAGHHVYVLDDDLTIQVPSGFMHGRSADVFSSDHMSGLDFTKTDIEELRASWAQSKSSVSQKSSEFDANKNVTATHLDGNVLMWPGLVAHMLAHKLKEAIIFVVIILAIIVSAYVGIKWIASPKPVFIQYPSVSYNQNPQEESGRPRWI

SEQ ID NO: 15326 - protein, 565 aa, unidentified
MAASLILLLLFMISLLSLQEHSLVSGSDYIKKSIGPLADCTGSAEPLAKFVKTCHNKCMRDSEPKRSVKAKLHQSNAVGPNMIECIKIRRQQTFTETWTFSTIRGPVKSKLLPITREECHAAIADNCPDFDCNHRETDELKPEYHYGSDTTVTEVVVSLITMPSIIMYKANDIYLTPLSSDKQFPLRDQFGHDGYKNYLWKQWGPSNKCPFEFVKEYGCDEYRDDGTYYMCAGGGFSITPTDDVAINTPTCAGLKVSKEGFVYSLWSVDPIEETAGRLGITEEKKLEADDDFLRHKIQQITSHLDAEICANQCEILSLEMRLSNRESSLMRIGNEHLLVFSNGTGVACRALSGCRLPDKKLFCGNPPRIGVVCTTMSGLWNPEMSYIDQGDPCYKPDELEFLFVSFGSERYLVDYDLMVSVPLNYSHGVYPTGYASLHMSGVQLDVKTLKELKDPWATSKSGADGISLTSKTSSHIESPHLAIGKAIVDMWDKVTSFVSSVEHAIGLVVIILMVIVAIWIIRFLIKVMSRRTERVVKKEYTRKELLEMADDLLVKNRGEDPISWE

SEQ ID NO: 15327 - protein, 648 aa, unidentified; identical to SEQ ID NO: 8678

SEQ ID NO: 15328 - protein, 567 aa, unidentified
MSKFRNILIIFISMLSPGLFIERYHPIFFEKYGVLIEPNGVVTSYDKVKYVTLIYHFPGLQKAVTPSHCNRNASEQLYRNTLKHQIKIMYDLIPSSTHTIMSNYCSKHHALCLDLEKKDRPKRQIIAAIAALSGIAGLAISAYDWISSSELKNHLDKVSEHITKIDNKLIIQENLDYKLTKLSNDIIKKTSMSFENYHKFVKEYVCQSSQFNNFLSHHVATTHLEMELQALQRLINGEPDSYIINAETLESILSSDTEVERSIYSSDPSLFYQVVRSNLIHSDIEKSLFAFILEVPIIQETMISPLYKVYNGGWESKGILHKIDLPDSFYLYSSLDDVDYHAISLGKSNCWKRNEVVVCDNSKHMMTEDMICLNSILKREYYDSCDIKFSKFTRRKFVVKALSGVLVCGDLEVKIITSAGSQFHYIKNNKQENNYTKYYSYNEFKQIIVGNTIVSTNINKMPIVRRNDTISVNFDYDLKWADKILHERPWTSLKEINLLKDSGFEQYHGTISHNLNQWSVFLWVTIILCLIILIYLLIASRRKITSLEDRLKLTNGIIKLSNKRSIL

SEQ ID NO: 15329 - protein, 458 aa, unidentified
MKPAHESQTIPKETVGTRNAPANRPPGPKKKVPGPKHLPLDRLKELSETFRSSAVAGFSTAFKDAACEAAKYTLPTPQQIKRKLVVFNCNSEDHLGYLSQAVYVYATMGPPLDGMLTGYASALRAACGSEAGFNERFKEPLRNYGFEIEHLPIPPDGALNKLFMSTDPSVRDLMEECYGDDLTGSLQLTSAPSGITGAKLLLFTADDELLVLSGILFLLAVKNVTELNWAGWNKNRVRSLAGAIGVPVDRLQLTSADMPDAVRESELYTRLSSMYQVRVLEYQLMVSLTEIPSRWQKIAQCVLTLMKGAEMAHFILINQYVVGKYPFLLHMPQLRQEAQQLIKTMEVLESYAGPPAAWPYAKICLPEKQQPVLSRLHFQALTAVAVAIGEKESETLRQYAMSSDRQPEIMKNLIERVMNIIEEYETNYDPAYDEGSAEIRRVANQLPTFEDVSEVEYY

SEQ ID NO: 15330 - protein, 740 aa, unidentified
MSLTQVLHMVVIVIGVAVSFMPPMRLHYIQEDGTTFLTKNPSGYIPFPPIIQLKSQSRASMNPSNQMPPTPHHAPSPLHGPRAATTPPDLVMPHRPRDNDNDESVTLFSEVRVREVPLIKCGGASRGQLVPIPARPKCQVFTSSPTHKLYPAGVFLFKQDTSEWLLPLVECKAVRVYRQCTVYFFGAQEKSQWEEELDMPQIDCPAQLPHDFHLQFTTHHASSKVLISGSPPDYLCKWTGTNTVHSDISYRIHSTGMVDHRTLEIRSAVSVIPTCQSPVGICRTTAKGWLVWNPKRFAYAQQCPLQLAQRLACTCQLLRESNVIMVSCNQAHLLFHMALAQKTPPIAYNPIYNCSHRFIEPGSVYVSMEGYLVSFNISGMSLHKWLKYIYLASYGQPFGTHIPSPLGCHSPHSDPHMCMSSQHGHPLPPQTGSSSGSTDSLDVHPLEAASLSPAELGWTLNHLLSLDQERLYHINKGFCAQLQSDWDLGLALSHSNQELAVQMFLRSRMWTGRFIRGFMEVWRCQSITKYRFLTNSHNSMNWPVEYSDGVSLHIAYVESPSMKLSNTSGPRLTKGSHIPFLYPLNSTHVINLAESTGITLARPVMFTPLSSSEQEVIFANPPLYSVAELTGHQDLWDAIKQLQDYNHAIHTTLTSAGNNSEVSLDIGGIISKIPDVTPMWMSPLNQLFGSFFGPIFQGLLELLAAVALVVLATKMLVSCLKTHKSCKTQDRAPHPRRHSL

SEQ ID NO: 15331 - protein, 650 aa, unidentified; identical to SEQ ID NO: 8686

SEQ ID NO: 15332 - protein, 140 aa, unidentified
NGNYTCQTSLNANINLLHLGDTACFRFTNQQGDTIGTLNVLYDLSLYVAPLSPIYYTSDWLGLSCSHKSCRNDHPCSLSDGCPSDSTLLNSVLTPQCVVYPGRTKCESSCGCAGCGCFFCSDACLISRAAFQPVGLPYQV

SEQ ID NO: 15333 - protein, 334 aa, unidentified; identical to SEQ ID NO: 11116

SEQ ID NO: 15334 - protein, 643 aa, unidentified; identical to SEQ ID NO: 8685

SEQ ID NO: 15335 - protein, 540 aa, unidentified
MVSNHSWKCVIIILVNFTTMHGDLIFPDIGYMCEPTRFMMFSTGSETFHIGLKLPNIRHKGADCIKESPEVSNLLEELYDLPQKVIPNMNFLKEISPRSNFTRDKRFLTAIIGVVSLLSLGTSLYGLGKQYSFESDIDDKIRRQDLALHELMIKHNQLLTVLDEQSNELKNLGSSVDMLHRIIENITCIQDEKIQQLETITYIQFFILKLESFVYAALKGDLHPDLVTLSMIRTLIKQRSSLRDTLLDKDPSVLYNVGKVIPLSYNHAHRVITLMIIMPIIRLDQISHIYDCSNIGFKKNNTLFKYTLPENIITVKVDGKQVMTSVNLQYCHTSGIIVMCNVNAIPTTNYQCLDDLNNNVSSNCSPKLLDNLLPVAINTQQHIMLRGFSRYSVHTQSTIPRYGSYKINLNPDQNTVIAIDKGKKYVVGGDIFTNNVVKANYDIPTNLSIKTMVKNISLNNKELDNISKEIQKLRIENISDWDVSDPSTYHFITIYTLLLVSIAALLAISWCYLRGHLIRKNKSKKFKKIVMQHSNNEDSD

SEQ ID NO: 15336 - protein, 625 aa, unidentified
MLAITTLLFLLHFTTSDPAVDLRLKFFADSTIPHVLKVPHIRSCPHYATMHPDNPDLSIPTSATIYRVVESGEPSFGYLLTAYQLTIECGRGFWGFPTSHLLHDNPTDLDLIPGNLLSAFITRTQPLVSQRKTLQSLIETFDQDLTECPWLSTSKKTSFVLRLKQITPVWSIDGHLLQPLNTHNCTLTTEDPCRLGKSSLLLRASSQQASCSMTTLMDLDGVLSIHAEASTYSLQFSALDIDFSLSIKQDHLVVLCSSTTQLIFNSEEGHIFSIATHGGRSAMFNLLSRYDNKTYYDYKKWLEVTTNKRYKRSTLSSSQFKLISFPSIVSPDHENDQYNHSRRLRRSTIFDYPEYQRLQVLEERLAWGFSELGAVTNRFHSSGVKSALVSKTQNCIQDVWIKRLLELAPNPWLIAAYFTRDSSIITAGRTSLGPIILQGSPVSKIFLPNRGEEVWCNSSIRVNFSLPDGSMEQQGWLESGYGRLFPLTRPCGKSQPLLEFYIPSYEKGDYELMSRSYPDMAISEPEEKMFRFSFVDFTPDSGLHRLHYLERIQSYAGEDTESNKDWTSYARMFADPTGASHSILSSYVVNLLTPFVILFLSLYTILFCVSICRRSTESLFKARSY

SEQ ID NO: 15337 - protein, 363 aa, unidentified
LLCLSPASAACISTTTVAIPTTQCTLLNGNYTCQTSLNANINLLHLGDTACFRFTNQQGDTIGTLNVLYDLSLYVAPLSPIYYTSDWLGLSCSHKSCRNDHPCSLSDGCPSDSTLLNSVLTPQCVVYPGRTKCESSCGCAGCGCFFCSDACLISRAAFQPVGLPYQVKTIGSVSVYPRLTVEYNFNGTTVSSTSDLFNPLSTPDFTLNLVGSYQAATTSISLGAAAFSSDGASALYYSYSDYNNPQFGVIGDVQSSLINGFSNPPYNFIFPDSSISQITSSSSVDYQFPQSGISRARQTPFPLLKDGIIYTADSERLYGLNPNAPAITVAMSSSHTSFSLVSETVCPKYVSHSISGCYNCPQG

SEQ ID NO: 15338 - protein, 1714 aa, unidentified
RELSKIALVIVTTVAIILYATGDGEVASTVAFAGYSGVLLLYTISKQEFASEQNKYLYNIMRHSKKVKRTVAGETVANKKIIEEDDETPIFYNESKKISKKSLKNISIGAAASLFFDNIDQASALKICCRPFKLMHFNSIIIDHAKGGMEHILITDDWFTPGPEKQTISINGTKYCEYNMYCMNAAYKFIIDSSWYIGFSMFLMAALKVALYSYKIFKTPTGSVTIEYHQDNCFATENIKNKTKKNNKRPKNDRIYTGSETDSAERGSLIKEPRYQEDLVKITRTTHTYCSGLRVVLVLLYIISFVSILSWGLSLMSTTGVSGFTISKEDTITIDGKKATIEEFIEIMKQEDDGVLVMANKKENIRMKRELTSVIDGIQPMEMNQTSTTEQSLTAGPDNKSPEDIYVNRLTCLYDQETYYLTGKLETHCVVNSSSLGIMMVPSENSLIKRVDSRCKSSLSISLARFGTPVCLKVCTMVDDCEIYYEPNQANKIKIPYSLKDVLKYNMNEMGNSNKIRTDTVEIKISRRAKRSITISKPVSDFGQGVHIVEGWRTQFENENGGVFLAEEGPLDDCMAGIPTNVNKYVRCTPLRRQVISCEPNLWAHYTIGSNMYECKVPTKEEFEKMPAWRKSGTTIPYTVPPNKHSGKIDRFIHKMEIGTESYLKVEMLWGEKYQDSVQQIGGLKYHIYSTVFKVTAHGLDSKTPFPKLWDSMITKANRWVDRKYTGYRMHSLETDLPNGLPEILIKVKHIEEPNTNNMWQDRAYVNFVFKSDIFASDGTKISPSDTDPACIPSDSSKDCVYLVPVYYAIRVYGPLLADIKFFGYVVDTIAFDNNVCTSVNAIRVKGVCYIPDMSTVSTDVVVGGYPWTEWSGIFTSSTKAIFELFSFYQNHPKVGSGQYLSAVSDSANIGHFSVNGKCSDMYYHSGKLMCMGSNVVNIKMVEYTTFHRPLMSPPSCSTYPNNSLVCHFSDPTEVTRCTHDPYLTRKQDNCSTTIIKKMDHTVDEAAGLTVKTPQVVFHLQRGFDGCKGTCFFASIIEVGYRCSWCLAIIVIAAGIGYIALIVHLLVILICFINGYTIGRLLRLLGLRSLFRCPLTTACSICGMYSYSANEAAKHKLFCSSTQCPYCITLDESNNLCILEFPTRANHREHMKLHKMVRINPYLGVIRMKRYRVATFFLVQLALAGLSGVNAQYFPAETGLRSNAVGLNISIPADSVECSDKGCKVIKDYNAHIPLVDGSSIIMRTKVDGKAFAKKITVENPNMDVTCDYLYTSSEVVVGPRRIVYTCSGKTECTEKTEIDLLTKPIANRGATDDFIPIDTENPLKSLYCPKATSCRSPIIDFMWIPAGCFTVNDGTAIGYEYYMPSIKKEMVHVFRCTVRNIKYKICEGALCKKIDGSSSDLEQGVLKFEHISSKLPIQFMVGAMSRQGDDKPSHIFHGVPDLRTDGSNTNFAYRMTMIPQGETCMEGTSYYGGKCDINTDGSSPALNCKSTLPKIDSDTLIKNYESLHEVYHCNFENSMLRWNTKVVPREITVNKKTTKDTQTVSWPSLNLTSINCNFGFTDINLLTFGHTTMEIVRYTGAITKVVCTGSYNRNGMTQLEFNIKEHSGMLELHCPMLFSETCLFDTVKTNKCNITTLLPFNSTCLYNGQSINIDCSKLELSSADPLSGNIVGWTGSQSKDTWISGFKIGLSNWWYITMIAVGTTSILIFMLWL

SEQ ID NO: 15339 - protein, 500 aa, unidentified
MLHSTYSRFVFGTLVLGLWVQTYAIPALKCNTESTPSLIDLEIRRMCHNKTENVVSCSVSYRNHTFAELNVTHVSCYKYHCKTYWGFFGSYSTDKLISRFTGDSSQCINGSVEDPFVCNWYYCCSAIVNDVCRCSISNAQVSVKSFPPFMYCSFADCSTVNEKDLSNGNATLSDGSLLLFDPYNLTHDVVNGTFNGTIYCNGSSKVVSFDAFRRSYGLKNCTYTDQSLNITCENCSSHCPHRRRRRDLSEVTYLAHKLRPMLADAWEDCEILQSLILGSFGSGMSGASQFLREWLNHTDIVGYIVNGIGVIWQCQRVNVSFLPWNESTYYPPVDSNGTRLYLNDESRLQTGSPEAIPGLKRVMWYGRMYLGTVNSGQRPKRVKYNRSSHDYHLDEFDWSFNFTPIIALATGHETNPINHAFGTQSNLLPYAKSSNLTSTDTGSGWVHIGLPSFAFLNPMGWLRDIFSWAAWLGGILYLVQLAMSFPVLIARRRRLGRWSE

SEQ ID NO: 15340 - protein, 500 aa, unidentified
  VARIANT 261: note = Any amino acid
MLHSTYFRIVFGTSVLVLWAQTYAIPALRCNTESTPSLIDLEIRRLCHNQTDNVVPCTVSYRNHTLNELSAVHISCYKYHCKTYWGFFGSYSTDKLISRFVGDLAQCLNVSAEDPFVCNWYYCCSAVVKDICRCSISNVTVSVKSFPPFMYCSFADCSTINEKDLLNGNATLSDGSLLTFSPYNLTHDIKNATLNGTIYCNGPAKVVSFDEFRRSYGLRNCTYTDQSLNITCKNCTDHCRPRRRRRDLSETAYLAHKLRPXLADAWEDCEILQSLILGSFGNGMSGASQFLREWLNHTDIVGYIVNGIGIIWQCQRANVTFLPWNESTYYPPVCDNGTRLYLNDEGRLQTGSPEAMPGLKRVMWHGRMYLGTVNSGQRPKRVKYNRSSHDYHLNEFDWNFNFTPSITLATGHETNPINHAFGTQSNLLPYTRSSNLTSTDTGSGWVHIGLPSFAFLNPMGWLRDIMSWAAWLGGILYLVQLVMSLPVLIARRKRLGRWSE

SEQ ID NO: 15341 - protein, 499 aa, unidentified
MRLSMCSLIVCGILALVLSHRTFAIQALKCNTDSTPTLIDLEIRRLCHNRTENVVSCQVSYKNHTTFELSAQHISCFKYHCKTYWGFFGSYSADRIINRYLGDASLCVNASSEDPFKCDWHYCCSARVTEICRCSNTNVTVAIRSFPPFMYCSFTDCSTVNEFDLRAGRANLSDGSYLIFAPYNLTSDIVNGTFNGTILCNSTSKVVSFDEFRRSYPLKNWTYQSETMNITCSNSNGTCKGKSRKRRDLSQLTYLVHQLRPTLRDAWEDCEILQSLLLGVFGTGMTSSSRFLREWLNHTDIVGYVVNGIGVVWQCSRVNITFLPWNESTYYPPVYAESTRYYLNEEGRLQTNTPEARPGLKRIFFHDRFYLGTVGSGLRPKRVKYNRSSHDYHLTEFEWSLNITPSVIVGHETNPINHAYGTQSDLLPYTRSSNLTSTDTGSGWVHIGLPSFAFVNPLGWIRDILSWAAWLGGILYLITLCISLPALFMRKRRLGRWRE

SEQ ID NO: 15342 - protein, 499 aa, unidentified
MYFRIVYGTLVLGLLGPIYAFRALKCNTDSSPTLIDLEIRRLCHNSTENVISCEVSYLNHTVTEVNVTHVSCFKYHCKTYWGFFGSYSADRLINRYTGKPGLCDNSTMDDPFVCNWYYCCSATITEVCRCTTTNAVVAVRSFPPFVYCSFADCSTVTEGELATGRANLSDGSYLIFSPYNISSDIVNQTLNGTILCNQSSKVVSFDEFRRSYSLTNGSYTSSTLNITCNNVTGTCRAPKRRTRRDVSQIEYLAHKLRPTLLDAWEDCEILQSLLLGVFGSGLSSASRFLREWLNHTNLVGYIVNGIGIIWQCQPVENVTFLPWNESTYYPPVKVKDKRLYLNDEGRLQTSTPEARPGLKRIFWHERLYLGTVGSGLKPKRVKYNRSSHDYHLEEFNWSLNFTPSINFAAGHETNPINHAYGTQSSLLPYTRSSNITSTDTGSGWVHIGLPSFAFINPLGWLKDVFSWAAWIGGILYLITLCISLPALFARRRRLGRWKE

SEQ ID NO: 15343 - protein, 503 aa, unidentified
MQPSMSFLTGFGTLVLALSAQTFDLQGLSCNTDSTPGLIDLEIRRLCHTPTENVVSCEVSYLNHTTISLPAVHTSCLKYHCKTYWGFFGSYSADRLINRYTGTVRGCLNNSAPEDPFECNWFYCCSAITTEICRCSIKNVTVAVQTFPPFMYCSFADCSTVSQQELESGSAVLSDGSTLTYAPYSPRSETVNTTLNGTILCNSSSKIISFDEFRRSYSLANGSYQSPSINITCFNYTSSCRPRLVRRRRDTQQIEYLIHKLRPTLKDAWEDCEILQSLLLGVFGTGIASASQFLRGWLNHPNIIGYIVNGVGVVWQCHRVNITFMVWNESTYYPPVDYNGRKYYLNDEGRLQTNTPEARPGLKRVMWFGRYFLGTVGSGVKPKRIRYNKTSHDYHLEEFEASLNMTPQLDIASGHETDPINHAYGTQADLLPYTRSSNMTSTDTGSGWVHIGLPSFAFLNPLGWLRDLLAWAAWLGGVLYLINLCVSLPASFARRRRLGRWQE

SEQ ID NO: 15344 - protein, 503 aa, unidentified
  VARIANT 221: note = Any amino acid
  VARIANT 222: note = Any amino acid
  VARIANT 223: note = Any amino acid
  VARIANT 224: note = Any amino acid
  VARIANT 225: note = Any amino acid
MQSTQHSMSFPIVCVILGSVLLVQTFELRGLRCNTDSTPALVDLEIRRLCHTPSENVISCEVSYYNHSQQSLEARHTSCYKYHCKTYWGFFGSYSADRLVSRYTGAFNVCNNGSFPDDPYECNWYYCCSALTTEICRCSINNVTVAVRTFPPFMYCSFADCSTVSQLELTTGFASLSDGSVLEFEPWNISKELINGTFNGTILCNSSSKIISFDEFRRSYXXXXXTYMSSSINITCSSYNGTCRAKPRKKRDLSQIEYLVHKLRPTLRDAWEDCEILQSLLLGVFGTGMASASQFLREWLNQTNIVGYVVNGVGVVWQCDWVNVSFLPWNESTYYPPVNFSNSRLYLNDESRLQTSTPEARPGLKRVLWFGRYFLGTVGSGVKPRRIRYNRTSHDFHLQDFDASLNLTPSINLATGHETDPINHAFGTQANLLPYTRSNNITSTDTGSGWVHIGLPSFAFLNPLGWLRDIFSWAAWIGGILYLITLCISLPASFARRRRLGRW

SEQ ID NO: 15345 - protein, 246 aa, unidentified; identical to SEQ ID NO: 10234

SEQ ID NO: 15346 - protein, 673 aa, unidentified
  VARIANT 276: note = Any amino acid
  VARIANT 277: note = Any amino acid
  VARIANT 278: note = Any amino acid
  VARIANT 279: note = Any amino acid
  VARIANT 280: note = Any amino acid
  VARIANT 281: note = Any amino acid
  VARIANT 282: note = Any amino acid
  VARIANT 283: note = Any amino acid
  VARIANT 284: note = Any amino acid
  VARIANT 285: note = Any amino acid
MSDFKTQTNTLQVLMLLGIGILSMVNFISGTGDGQGKVIGIVKKAQTIYRKVPSPPECELDDDHEVSFPVQGSIWRYKSSNADMVGFILTKSETTTFCHENLLGGEEKRILQVRDLPFREVDTEDRIQVEKLRKATFEAKIPEWECSYFSDNTVKTKIYHVKKMNYQYDPSTRKIVIPPGITSEEGNGIFKLGNNSLFITMSPKPVFPECNIELFKSSVATLVRKKTEVHQVIFNQFKEMYYYNVKQFMMCFKTRIYLTLGGYLISTVNITSTSHXXXXXXXXXXATKPPLIITDAPIPTSTAGHGHGKRTKREVTPQEETIRVPSYRDIQLSCVTENWLENIKLRKKVYSVDIGAACWELSSETIEEDSTSSRRRRSLNDVHEVDSHIFLNYQHELSRTELQWGLYHLANKTSEALTHLAKEFCLEQLMHHTALMEEIDKGSISMATFSSFYPDYIYHSISLKNNVIEIQEGSIKFVNLMDPLVCCERRCRIIDTKNRTMWLESSSRRIYELSESQTSCRWKPNSFIVQDKKTRNWIDVMDAEVISPLYKLKSLNRPDPLEFSFNTTNIYNPYDFLSPLYTDIVKSHRGEDVTVSYGKKFSWLLGAVDSVKEFVSSFKGQLIIGLFCIFLIVVLVLKMFHFILNKKVNRRGEGSPVMVPLTRYGDRIPASSF

SEQ ID NO: 15347 - protein, 430 aa, unidentified; identical to SEQ ID NO: 8534

SEQ ID NO: 15348 - protein, 431 aa, unidentified; identical to SEQ ID NO: 15277

SEQ ID NO: 15349 - protein, 337 aa, unidentified; identical to SEQ ID NO: 8339

SEQ ID NO: 15350 - protein, 429 aa, unidentified; identical to SEQ ID NO: 15209

SEQ ID NO: 15351 - protein, 610 aa, unidentified
MQPGISEVSFVNDERSERGTWRLLFRILTIVLCLTSIGIGIPALIYSKEAATSGDIDKSLEAVKTGMSTLSSKIDESINTEQKIYRQVILEAPVSQLNMESNILSAITSLSYQIDGTSNSSGCGSPMHDQDFVGGINKEIWTTDNVNLGEITLTPFLEHLNFIPAPTTGNGCTRIPSFDLGLTHWCYTHNVILSGCQDYSSSFQYIALGVLKISATGHVFLSTMRSINLDDERNRKSCSISATSIGCDIICSLVTEREVDDYNSPAATPMIHGRLDFSGKYNEVDLNVGQLFGDWSANYPGVGGGSFLNGRVWFPIYGGVKEGTPTFKENDGRYAIYTRYNDTCPDSESEQVSRAKSSYRPSYFGGKLVQQAVLSIKIDDTLGLDPVLTISNNSITLMGAESRVLQIEEKLYFYQRGTSWFPSLIMYPLTVDDKMVRFEPPTIFDQFTRPGNHPCSADSRCPNACVTGVYTDGYPIVFHNNHSIAAVYGMQLNDVTNRLNPRSAVWYGVSMSNVIRVSSSTTKAAYTTSTCFKVKKTQRVYCLSIGEIGNTLFGEFRIVPLLLEVYSEKGKSLKSSFDGWEDISINNPLRPLDNHRVDPILISNYTSSWP

SEQ ID NO: 15352 - protein, 590 aa, unidentified
LVGYDCTSSVANITTISLFSVLPCELDQKPQSEYLSVIQVVQQRSVSRVHTFSCLVIRSSVIHHCGMHHHTSVGPMSIGEIMHTSNTQCADLHHFGKLAVGSGTLLTGFKVNETVQISITEHGYSDSEFKCRGTSFSHNGIAYHDAVMKSSYTVTLREEWASLDLDTGDLKMSTGYMHPFKTGQSFDASAGDVFWSTQDNQDCTPTSYLVLHEGAGIIYQGHRDTKTLVVNSSTHAMAVGILGPTLVCHQPALRTEHPKIFIVMKHPGSPSFFFKKSIVDPANVDMFLYINSKLVYLERHMGYQMSLVYEHFHKRTCNIKHQLLRHLIAIAVMNPEEFAWLYSKRPGVTAILRGELIYLMECQAVPVTIRKPSGRCYNELPVTFNNTPMFIKPRSRILVHYGSEIDCSPIVPAGFMIEGRWWALRPDSTQLPAPTTLSAEPEEGKWSYTSPHDLFKSGIYTLEELLAFQKRLLFSFEKPAISHTLSSAAARQPADLSGIDGAGLFHPGQLEEIQKNFMSKIWGWYWNVSVVLGGLVGIYMVFQLIKSVINSIITCTCLYRAYGCGVEILTCCFSSCAKYLLLKRHTDPDF

SEQ ID NO: 15353 - protein, 499 aa, unidentified
MSSLIVFGTLVLDLSALTSAFQALKCNTDSTPTLIDLEIRHLCHNSTENVISCEVSYCNHTSTEVPATHISCFKYHCKTYWGFFGSYSADRLINRYTGQPRLCINTTGEDPFVCNWYYCCSAIVNEICRCSVANVTIVVRTFPPFAYCSFADCSTVSESELNRGRANLSDGSFLLFTPQNITFDAVNITLNGTVMCNQSSKVVSFDEFRRSYPLVNGTYCSSTLNITCSNISGTCRQRSKRTRRDLSQMEYLVHKLRPTLRDAWEDCEILQSLLLGVFGSGLTSASRFLREWLNHTDIVGYVVNGIGIVWQCQRVENVTFMPWNESTYYPPVKVDGRRLYLTEEGRLQTNTPEARPGLKRIFWHERLYLGTVGSGLRPRRVKYNRSSHDYHLDEFNWRLNLTPSINILTGHETNPINHAYGTQSNLLPYTRSNNITSTDTGSGWVHIGLPSFAFINPLGWIRDILSWAAWIGGILYLITLCISLPALFTRRRRLGRWKE

SEQ ID NO: 15354 - protein, 505 aa, unidentified
IRCIGIGNRDFIEGMSGGTWVDIVLEHGGCVTVMSNDKPTLDFELVTTTASNMAEVRSYCYEANISEMASDSRCPTQGEAYLDKMADSQFVCKRGYVDRGWGNGCGLFGKGSIVTCAKFTCVKKLTGKSIQPENLEYRVLVSVHASQHGGMINNDTNHQHDKENRARIDITASAPRVEVELGSFGSFSMECEPRSGLNFGDLYYLTMNNKHWLVNRDWFHDLSLPWHTGATSNNHHWNNKEALVEFREAHAKKQTAVVLGSQEGAVHAALAGALEAESDGHKATIYSGHLKCRLKLDKLRLKGMSYALCTGAFTFARTPSETIHGTATVELQYAGEDGPCKVPIVITSDTNSMASTGRLITANPVVTESGANSKMMVEIDPPFGDSYIIVGTGTTKITHHWHRAGSSIGRAFEATMRGAKRMAVLGDTAWDFGSVGGMFNSVGKFVHQVFGSAFKALFGGMSWFTQLLIGFLLIWMGLNARGGTVAMSFMGIGAMLIFLATSVSG

SEQ ID NO: 15355 - protein, 544 aa, unidentified
KASETCQIRDCTFICLDYFTNFVCYSTTTQAIIGFVFISVIILLIALMSFISYKIYCCINRMYTFKVTPDPRMAAALCILLCLSPASAACISTTTVAIPTTQCTLLNGNYTCQTSLNANINLLHLGDTACFRFTNQQGDTIGTLNVLYDLSLYVAPLSPIYYTSDWLGLSCSHKSCRNDHPCSLSDGCPSDSTLLNSVLTPQCVVYPGRTKCESSCGCAGCGCFFCSDACLISRAAFQPVGLPYQVKTIGSVSVYPRLTVEYNFNGTTVSSTSDLFNPLSTPDFTLNLVGSYQAATTSISLGAAAFSSDGASALYYSYSDYNNPQFGVIGDVQSSLINGFSNPPYNFIFPDSSISQITSSSSVDYQFPQSGISRARQTPFPLLKDGIIYTADSERLYGLNPNAPAITVAMSSSHTSFSLVSETVCPKYVSHSISGCYNCPQGFTITFNAFSACRPGSVSVVVEGNFLCTTSFVTLNTTSLPSILYCISQQKQIEGTIKLLGDTEEHFPVLTVLNEAPPLSPNDFQRFYGNFTPTFNSAANFWDS

SEQ ID NO: 15356 - protein, 669 aa, unidentified
  VARIANT 68: note = Any amino acid
  VARIANT 69: note = Any amino acid
  VARIANT 70: note = Any amino acid
  VARIANT 71: note = Any amino acid
  VARIANT 72: note = Any amino acid
  VARIANT 73: note = Any amino acid
  VARIANT 74: note = Any amino acid
  VARIANT 75: note = Any amino acid
  VARIANT 76: note = Any amino acid
  VARIANT 77: note = Any amino acid
  VARIANT 78: note = Any amino acid
  VARIANT 79: note = Any amino acid
MYHLIVLLVMLGQRAVAEPADIARAAKIIQYAEERLRNKTGLRIELSSRDPAQSAASPPDVPATKQPXXXXXXXXXXXXSAPIKVGLPESEYLRQVVEPWFTVCESKVPRTLTDVVHRILRKGDGKAHRMLRGTPNGDDHSVYTKFGSGISPAPSRLVVLSESLQEVQRPQLYRVSRLRSSSTPHRVVLCEVMSAFSPLNVEEMECTGVLGKLSDTSSVTLNVVDPGYVLTMIRVCSCSAMRVKRWTWTSFFNVKERLEDRWRIPPDPKECESHCEPIFAGEVTSAVRGSVPDYCYAWMSTCEVQGDVYQVSLGTAKFHRFLNQIRAPFIVDDPCTPSAPCKGSGDSLVLAKIEEDNPRFTTMNGELTPRYNWDTHKVYQVHLPGVTTSILDASCGFLHGGYVYYQLMSGRIVSVSVGTLQFGDKVKPPICTEWKGPYMPFVLPDSQVASTSEQLRQDLLHCQTRKEVVLNALATKRLPSITLFEGLGYKGSESYGLVSRKGLLYAAPCPSVEYTDLEHVEGNIWMVVNNGREVGCLDGGLNFAVKSGCVVNPNASVSILLGEWKVISDRDGKLLAEPIPKAGWGSIPALENISAAFGDYLASLEQPPLWDDGNGPIIIPTSNSTGDPVIHSGASSLWSSMSLASKITAILMPLLSLAVVVGIIMCCRR

SEQ ID NO: 15357 - protein, 589 aa, unidentified
GLVGYDCTSSVANITTISLFSVLPCELDQKPQSEYLSVIQVVQQRSVSRVHTFSCLVIRSSVIHHCGMHHHTSVGPMSIGEIMHTSNTQCADLHHFGKLAVGSGTLLTGFKVNETVQISITEHGYSDSEFKCRGTSFSHNGIAYHDAVMKSSYTVTLREEWASLDLDTGDLKMSTGYMHPFKTGQSFDASAGDVFWSTQDNQDCTPTSYLVLHEGAGIIYQGHRDTKTLVVNSSTHAMAVGILGPTLVCHQPALRTEHPKIFIVMKHPGSPSFFFKKSIVDPANVDMFLYINSKLVYLERHMGYQMSLVYEHFHKRTCNIKHQLLRHLIAIAVMNPEEFAWLYSKRPGVTAILRGELIYLMECQAVPVTIRKPSGRCYNELPVTFNNTPMFIKPRSRILVHYGSEIDCSPIVPAGFMIEGRWWALRPDSTQLPAPTTLSAEPEEGKWSYTSPHDLFKSGIYTLEELLAFQKRLLFSFEKPAISHTLSSAAARQPADLSGIDGAGLFHPGQLEEIQKNFMSKIWGWYWNVSVVLGGLVGIYMVFQLIKSVINSIITCTCLYRAYGCGVEILTCCFSSCAKYLLLKRHTDP

SEQ ID NO: 15358 - protein, 319 aa, unidentified; identical to SEQ ID NO: 8681

SEQ ID NO: 15359 - protein, 310 aa, unidentified; identical to SEQ ID NO: 8697

SEQ ID NO: 15360 - protein, 313 aa, unidentified; identical to SEQ ID NO: 8356

SEQ ID NO: 15361 - protein, 574 aa, unidentified
  VARIANT 50: note = Any amino acid
  VARIANT 51: note = Any amino acid
  VARIANT 52: note = Any amino acid
  VARIANT 53: note = Any amino acid
  VARIANT 54: note = Any amino acid
  VARIANT 55: note = Any amino acid
  VARIANT 56: note = Any amino acid
  VARIANT 57: note = Any amino acid
  VARIANT 58: note = Any amino acid
  VARIANT 59: note = Any amino acid
  VARIANT 60: note = Any amino acid
  VARIANT 61: note = Any amino acid
  VARIANT 62: note = Any amino acid
MEYWGHTNNPDKINRKVGVDQVRDRSKTLKIITFIISMMTSIMSTVALIXXXXXXXXXXXXXRIILQELRDETDAIEARIQKASNDIGVSIQSGINTRLLTIQNHVQNYIPLALTQQVSSLRESINDVITKREETQSKMPIQRMTHDDGIEPLIPDNFWKCPSGIPTISASPKIRLIPGPGLLATSTTINGCIRLPSLVINNLIYAYTSNLITQGCQDIGKSYQVLQIGIITINSDLVPDLNPRITHTFDIDDNRKSCSLALRNADVYQLCSTPKVDERSDYSSIGIEDIVLDIVTSEGTVSTTRFTNNNITFDKPYAALYPSVGPGIYYDNKIIFLGYGGLEHEENGDVICNITGCPGKTQHDCNQASYSPWFSNRRMVNAIILVNKGLNKVPSLQVWTIPMRQNYWGSEGRLLLLGNKIYIYTRSTSWHSKLQLGTLDISNYNDIRIRWTHHDVLSRPGSEECPWGNTCPRGCITGVYNDAYPLNPSGSVVSSVILDSRTSRENPIITYSTDTSRVNELAIRNNTLSAAYTTTNCVTHYGKGYCFHIIEINHKSLNTLQPMLFKTEIPKSCN

SEQ ID NO: 15362 - protein, 305 aa, unidentified; identical to SEQ ID NO: 12665

SEQ ID NO: 15363 - protein, 310 aa, unidentified; identical to SEQ ID NO: 8697

SEQ ID NO: 15364 - protein, 585 aa, unidentified; identical to SEQ ID NO: 8999

SEQ ID NO: 15365 - protein, 600 aa, unidentified
VLCVLVAIGGQTWGLVGYDCTSSVANITTISLFSVLPCELDQKPQSEYLSVIQVVQQRSVSRVHTFSCLVIRSSVIHHCGMHHHTSVGPMSIGEIMHTSNTQCADLHHFGKLAVGSGTLLTGFKVNETVQISITEHGYSDSEFKCRGTSFSHNGIAYHDAVMKSSYTVTLREEWASLDLDTGDLKMSTGYMHPFKTGQSFDASAGDVFWSTQDNQDCTPTSYLVLHEGAGIIYQGHRDTKTLVVNSSTHAMAVGILGPTLVCHQPALRTEHPKIFIVMKHPGSPSFFFKKSIVDPANVDMFLYINSKLVYLERHMGYQMSLVYEHFHKRTCNIKHQLLRHLIAIAVMNPEEFAWLYSKRPGVTAILRGELIYLMECQAVPVTIRKPSGRCYNELPVTFNNTPMFIKPRSRILVHYGSEIDCSPIVPAGFMIEGRWWALRPDSTQLPAPTTLSAEPEEGKWSYTSPHDLFKSGIYTLEELLAFQKRLLFSFEKPAISHTLSSAAARQPADLSGIDGAGLFHPGQLEEIQKNFMSKIWGWYWNVSVVLGGLVGIYMVFQLIKSVINSIITCTCLYRAYGCGVEILTCCFSSCAKYLLLKRHT

SEQ ID NO: 15366 - protein, 578 aa, unidentified
YDCTSSVANITTISLFSVLPCELDQKPQSEYLSVIQVVQQRSVSRVHTFSCLVIRSSVIHHCGMHHHTSVGPMSIGEIMHTSNTQCADLHHFGKLAVGSGTLLTGFKVNETVQISITEHGYSDSEFKCRGTSFSHNGIAYHDAVMKSSYTVTLREEWASLDLDTGDLKMSTGYMHPFKTGQSFDASAGDVFWSTQDNQDCTPTSYLVLHEGAGIIYQGHRDTKTLVVNSSTHAMAVGILGPTLVCHQPALRTEHPKIFIVMKHPGSPSFFFKKSIVDPANVDMFLYINSKLVYLERHMGYQMSLVYEHFHKRTCNIKHQLLRHLIAIAVMNPEEFAWLYSKRPGVTAILRGELIYLMECQAVPVTIRKPSGRCYNELPVTFNNTPMFIKPRSRILVHYGSEIDCSPIVPAGFMIEGRWWALRPDSTQLPAPTTLSAEPEEGKWSYTSPHDLFKSGIYTLEELLAFQKRLLFSFEKPAISHTLSSAAARQPADLSGIDGAGLFHPGQLEEIQKNFMSKIWGWYWNVSVVLGGLVGIYMVFQLIKSVINSIITCTCLYRAYGCGVEILTCCFSSCAKYLL

SEQ ID NO: 15367 - protein, 590 aa, unidentified; identical to SEQ ID NO: 8679

SEQ ID NO: 15368 - protein, 683 aa, unidentified
MDAGYLFVLCVLVAIGGQTWGLVGYDCTSSVANITTISLFSVLPCELDQKPQSEYLSVIQVVQQRSVSRVHTFSCLVIRSSVIHHCGMHHHTSVGPMSIGEIMHTSNTQCADLHHFGKLAVGSGTLLTGFKVNETVQISITEHGYSDSEFKCRGTSFSHNGIAYHDAVMKSSYTVTLREEWASLDLDTGDLKMSTGYMHPFKTGQSFDASAGDVFWSTQDNQDCTPTSYLVLHEGAGIIYQGHRDTKTLVVNSSTHAMAVGILGPTLVCHQPALRTEHPKIFIVMKHPGSPSFFFKKSIVDPANVDMFLYINSKLVYLERHMGYQMSLVYEHFHKRTCNIKHQLLRHLIAIAVMNPEEFAWLYSKRPGVTAILRGELIYLMECQAVPVTIRKPSGRCYNELPVTFNNTPMFIKPRSRILVHYGSEIDCSPIVPAGFMIEGRWWALRPDSTQLPAPTTLSAEPEEGKWSYTSPHDLFKSGIYTLEELLAFQKRLLFSFEKPAISHTLSSAAARQPADLSGIDGAGLFHPGQLEEIQKNFMSKIWGWYWNVSVVLGGLVGIYMVFQLIKSVINSIITCTCLYRAYGCGVEILTCCFSSCAKYLLLKRHTDPDFRGGTARIVDWISRRSRPTTQVAQEDSVEAAVQLDDVRVEAPIATAPSRIHSPLYPPNEPIDTTYPSAYLRRS

SEQ ID NO: 15369 - protein, 604 aa, unidentified
MLPYQDKVGAFYKDNARANSTKLSLVTEGHGGRRPPYLLFVLLILLVGILALLAITGVRFHQVSTSNMEFSRLLKEDMEKSEAVHHQVIDVLTPLFKIIGDEIGLRLPQKLNEIKQFILQKTNFFNPNREFDFRDLHWCINPPSTVKVNFTNYCESIGIRKAIASAANPILLSALSGGRGDIFPPHRCSGATTSVGKVFPLSVSLSMSLISRTSEVINMLTAISDGVYGKTYLLVPDDIEREFDTREIRVFEIGFIKRWLNDMPLLQTTNYMVLPKNSKAKVCTIAVGELTLASLCVEESTVLLYHDSSGSQDGILVVTLGIFWATPMDHIEEVIPVAHPSMKKIHITNHRGFIKDSIATWMVPALASEKQEEQKGCLESACQRKTYPMCNQASWEPFGGRQLPSYGRLTLPLDASVDLQLNISFTYGPVILNGDGMDYYESPLLNSGWLTIPPKDGTISGLINKAGRGDQFTVLPHVLTFAPRESSGNCYLPIQTSQIRDRDVLIESNIVVLPTQSIRYVIATYDISRSDHAIVYYVYDPIRTISYTHPFRLTTKGRPDFLRIECFVWDDNLWCHQFYRFEADIANSTTSVENLVRIRFSCNR

SEQ ID NO: 15370 - protein, 630 aa, unidentified
MAYLAILLISIAFISGTVADNPFEEFQKSALQNNPVHEAGKRVGHGMDSLQPYYICESESSGNAMTLSAWHYSCKQSCLDDNARTAVNITRVRWHYIGDDIPVYKVVTNEVCYTAHENMWGYCTQTQTIKPVATTKADKDALSNLLFHDTAQITGTRTITNSQYGDCEYFSDNTKCGRDYTVTYRPGKTSKKSDSDPLMLNVYGDGIRVDPNTGELYQNDVAWFWDKSKIQPSSDCGWWIYDDDTCRITTTSDTMYCPSIGYQYNIHNLKASSTCKGEVYDINGPAPFMYKAKTQDPKRKDIMAKAAEGKGDPDINMITGINAAFERLEETYCSSTCDLFARGLGSDDNQVLDTPLGNWRLVNSTSDHPALLPCSPTSTWKIKNPTSMCHGKDHILVEDSKTKHTCSWDTKKDYITVDDTCINTSAEAAEMDETMRRTMLRGEDVRIRFWTGDTYILSPPYTTPRWEKTNLTRTQNPSWFSKVELNQNMLHNPEDISHLLTTMAHDTKQEIMYNQTASRSVKKYILDEVLLGAGTVGAAIVSFVGSLVGTLPKLIFGVVVLVLAIWVGKTIIGWRINRRGPFDSPQRTVKFDPNISESLLGSPPQAPSAPKRRPQSRSAKLGDLFDEYGI

SEQ ID NO: 15371 - protein, 569 aa, unidentified
GKIMYNMAPNILVFLTVLCLSSYLIDGRKGATVKSINKNRLSIGPVAHCRGELLDLGVQQRNCYMKCEGYSEPKRGITIGIANAKTKGPPVIRCSKVRLSQTFTQTWTWSTVMGDLLSEAIPTTVEECRESINTNCPTGNCDIRAPNKLEAEFHYASTTRVESLFIVLQSIPSVLYIDDGKEWLSPMGTTGRFAAGDGLAQEEHNHYIWNKVSSLTTCPYQVEGTYGCDEFDEGDELFYACAAGGLTVTPRKSSPMIHPTLCPGLKWSQEGLLYEISKGDPNSDMVGRLGIEAKPDTVESADNTYLRHKIQMVARKLDSDLCYTQCEVMALESRSANKSAHLIRAGHEHYLAYSNGTAQYCGPITGCRLSDPPLMCGNPPRVGIVCVGTSRLWDPLLPYITDDHKCDKPREIEEMHFNLGASKYIVDRQLTIPVNKTELHGVYHSEFFRYHNSRMMMAIDDLSKLKPEWDRAKQGKPTESVRTESTRNVDAPHIMLGGWFLRAWGSIRDMFHSIEAVIGCIVIGLAVYMTVMLILKIKAASTTGIYKPVQMRMTNRSKSREEPERMVWT

SEQ ID NO: 15372 - protein, 608 aa, unidentified
VLCVLVAIGGQTWGLVGYDCTSSVANITTISLFSVLPCELDQKPQSEYLSVIQVVQQRSVSRVHTFSCLVIRSSVIHHCGMHHHTSVGPMSIGEIMHTSNTQCADLHHFGKLAVGSGTLLTGFKVNETVQISITEHGYSDSEFKCRGTSFSHNGIAYHDAVMKSSYTVTLREEWASLDLDTGDLKMSTGYMHPFKTGQSFDASAGDVFWSTQDNQDCTPTSYLVLHEGAGIIYQGHRDTKTLVVNSSTHAMAVGILGPTLVCHQPALRTEHPKIFIVMKHPGSPSFFFKKSIVDPANVDMFLYINSKLVYLERHMGYQMSLVYEHFHKRTCNIKHQLLRHLIAIAVMNPEEFAWLYSKRPGVTAILRGELIYLMECQAVPVTIRKPSGRCYNELPVTFNNTPMFIKPRSRILVHYGSEIDCSPIVPAGFMIEGRWWALRPDSTQLPAPTTLSAEPEEGKWSYTSPHDLFKSGIYTLEELLAFQKRLLFSFEKPAISHTLSSAAARQPADLSGIDGAGLFHPGQLEEIQKNFMSKIWGWYWNVSVVLGGLVGIYMVFQLIKSVINSIITCTCLYRAYGCGVEILTCCFSSCAKYLLLKRHTDPDFRGGT

SEQ ID NO: 15373 - protein, 478 aa, unidentified
MLYVLFMLVLSRQLILSGAFSVLACNKTEDYPSVLQCLQSCDSLKTGRHVGIDIMKHDVSTIIQVAKCTWIVEERAFTETWTFSRFSSEITRSYSPASSYECRGMFNNHCKKRSGCVSGDVPIDPVYSWARTEIRRSKFLHIETVNATAYPYEKKGMIIINGRTIPISDQEHIDGDITYVWDKVDIGNECPWSNNTETLSCHYQGDQEEHIVCPGEGIVLWNTSQLNTGCNWKIYKDSTGVIFRKLENSTADWYPNVIETSGEALRVLTNGIRYSLRVRDSFSCLQNCGNLNRGLVFIGGYYYYRGDQRCKLVNGCTINKYTFSCNDGRYLWTRCYSESAWIDMERAELIKNPTCDKDHRRRLSKEEAESAINKYHNVSRLFSVLNLKVMKDVELKEGESTEMARVLRTNATLDSETQEDNIFLSFHPWEMFKEALGYIQHEIKVLAFTGVSLYVGYKIYAIYSKKTSKKPAELIAMI

SEQ ID NO: 15374 - protein, 500 aa, unidentified
MLHSMFSHIVFGTLVLVLWAQTYAIPALKCNTESTPSLVDLEIRRLCHNKTDNVVSCSVSYRNHTFNELNVTHISCYKYHCKTYWGFFGSYSTDKLISRFTDDLQQCLNVSIEDPFVCNWYYCCSAIINDVCRCSITHAIVSVKSFPPFMYCSFADCSTVNEKDLANGNATLSDGSLLTFNPYNLTHDIVNNTFNGTIYCNGSSKVISFDVFRRSYGLKNCSYTDQSLNITCENCTSHCSSRRRRRDLSETTYLAHKLRPMLADAWEDCEILQSLILGSFGNGMSGASQFLREWLNHTDIVGYIVNGIGVIWQCQPVNVSFLPWNESTYYPPVNLSGTRLYLNDESRLQTGSPEAIPGLKRVMWHGRMYLGTVNSGQRPKRVEYNRSSHDYHLDEFNWSFNFAPSVTLAAGHETNPINHAFGTQSNLLPYARSSNLTSTDTGSGWIHIGLPSFAFLNPMGWLRDIMSWAAWLGGTLYLVQLVMSLPALIARRRRLGRWSE

SEQ ID NO: 15375 - protein, 502 aa, unidentified
RCIGIGNRDFIEGMSGGTWVDIVLEHGGCVTVMSNDKPTLDFELVTTTASNMAEVRSYCYEANISEMASDSRCPTQGEAYLDKMADSQFVCKRGYVDRGWGNGCGLFGKGSIVTCAKFTCVKKLTGKSIQPENLEYRVLVSVHASQHGGMINNDTNHQHDKENRARIDITASAPRVEVELGSFGSFSMECEPRSGLNFGDLYYLTMNNKHWLVNRDWFHDLSLPWHTGATSNNHHWNNKEALVEFREAHAKKQTAVVLGSQEGAVHAALAGALEAESDGHKATIYSGHLKCRLKLDKLRLKGMSYALCTGAFTFARTPSETIHGTATVELQYAGEDGPCKVPIVITSDTNSMASTGRLITANPVVTESGANSKMMVEIDPPFGDSYIIVGTGTTKITHHWHRAGSSIGRAFEATMRGAKRMAVLGDTAWDFGSVGGMFNSVGKFVHQVFGSAFKALFGGMSWFTQLLIGFLLIWMGLNARGGTVAMSFMGIGAMLIFLATSV

SEQ ID NO: 15376 - protein, 511 aa, unidentified
MRNRANTQSTRPSMSSPIGYGILVLALLHLTFALQALKCNTDSTPALVDLEIRRLCHNRTEDVIPCQVSYRNHTTIELQAVHISCYRYHCKTYWGFFGSYSADRLINRYLGDASLCTNDTVEDPFKCNWHYCCSARITEICRCSISNVTVAVRSFPPFMYCSFSDCSTVNELELSIGRANLSDGSYLLFEPYNLTSDDVTGTFNGTILCNSTSKVVSFDEFKRSYPLRNWTYTSDTISISCNGTRFSNCKGKERRRRDTSQIEYLVHKLRPTLRDAWEDCEILQSLLLGVFANGMASSSRFLREWLNHPDIVGYVVNGIGVVWQCDRVNITFLPWNESTYYPPVKTDSKRYYLNEEGRLQTSTPEARPGLKRIFFHEKFYLGTVGSGLRPKRVKYNRSSHDYHLTEFEWSLNITPTINILVGHETNPINHAYGTQADLLPYTRSTNLTSTDTGSGWIHIGLPSFAFINPLGWIRDILSWAAWLGGILYLITLCISLPALFMRRKRLGRWRE

SEQ ID NO: 15377 - protein, 431 aa, unidentified
EFVEPFLVLKHDHSTMLMTRLYPGEIAHVATPAGLVDIRVSHAQIFGGQRFRELLSDCSVNASYSTDICPGGSQLDLESIKGPGRVCMTAPYNRGWGTGCFKWGIGAVATCVELNCTRETKVDLLTNSAIVANVTVNFHSTNDTKLLVPDTPITLKFGKLGTMTMTCRLGNDRIANDFYHVTDNIASGLFQKALIDAWEGPSKMANHISGHEKVVKWGHILPNEIKVSKIIEMELDWEKAITTHDGFSNTYFWCQVAVNKLVVGSFASCKSGAKASFIQSSWGFDGVVEVTLDEATKTICSLPLTCTGCSLLATKVVFLEGSQRAVGHVGCGNGTSMLTVGTTKVGIQCVVTPVSQIWNFVTHASGRYAKLGFGGVGGAFHDLLVKVGLTFTWDSWKIITVLSGLVVAFAIFDRKLVILIIILCGIAYTRA

SEQ ID NO: 15378 - protein, 429 aa, unidentified; identical to SEQ ID NO: 15209

SEQ ID NO: 15379 - protein, 496 aa, unidentified; identical to SEQ ID NO: 8708

SEQ ID NO: 15380 - protein, 493 aa, unidentified
MGQIVTFFQEVPHIIEEVMNIVLITLSFLAILKGLYNVATCGIIGLISFCILCGRSCSLVYKGTYNLSSIELDAGHLNTTMPLSCTKNNSHHYIFVNGSGLEMTLTNTSILNHKFCNLSDAHKKDLYNHALMSIITTFHLSIPNFGQYEAMSCDFNGGNITVQYNLTHNSVVDSGNHCGTLANSIMDVFMRMYWGHSLSVGIVLPDSEKNTYNCIMTSYRYLVIQNVSWADHCIFSRPSPMGFISLISQRVRSIYISRRILGTFTWTLSDSSGNDLPGGYCLQKWMLISAEMKCFGNTAVAKCNLNHDEEFCDMLRLFDFNKQAIDKLRIEAQRGLNLITKAVNSLVNDQLIMRNHLKDLMGIPYCNYTKFWFLNDTRTGRTSLPKCWKVTNGTYLNETHFSDEIEQEADNMITEMLQKEYLNRQGKTPLGLVDLFVFSTSFYLISIFLHLIKIPTHRHIRGKPCPKPHRLTKMAICSCGAYGQPGLPTKWAR

SEQ ID NO: 15381 - protein, 510 aa, unidentified
MVALSFVPIMGQIVTFFQEIPHMLEEVMNIVLITLSLIAILKGLYNFATCGLGGLIIFLLLAGRSCNGMDSSGVLYKGEYRLHNVTLNTASLNKTMPLSCSKNNTHHYIYLSNETGLEITFTNNSLLNHKHCNLSDAHKKNLYDHSLMTIITQFHLSIPNFNQYEAMSCDFNGGNITIQYNLSHSKVVDAGNHCGTVANGILYTFYRMFWSRGNIADGIDVLDEKKKLVHCMTTSFKYLIIQNVSWEDHCIMSSPTPIGPISVLNSQIRSIYLSRRLRSVFSWTLTDASGTENPGGYCLERWMLFASELKCFGNTAVAKCNLNHDSEFCDMLRLFDYNKQAIIKLKADLETTLETFRKAVNALINDQLIMRNHLRDLLGIPYCNYTKFWYLNSTKTGRHSLPKCWLVSNGSYLNVTHFSTEIEQEADNLITEMLQREYIDRQGKTPLGLMDLFMFSTSFYLISVFLHLIKIPTHRHIQGKSCPKTHRLNSKAICRCGAYNQPGLPIKWKR

SEQ ID NO: 15382 - protein, 127 aa, unidentified
NHKFCNLSDAHKKDLYNHALMSIITTFHLSIPNFGQYEAMSCDFNGGNITVQYNLTHNSVVDSGNHCGTLANSIMDVFMRMYWGHSLSVGIVLPDSEKNTYNCIMTSYRYLVIQNVSWADHCIFSRP

SEQ ID NO: 15383 - protein, 482 aa, unidentified
TNCVTISQREILKGVEGVTWFEVLLEKTSCITIAAQNRPSIDLWLDDVKQSSVMASKEFCMKVEVSETQIAARCPTQGDATLPMEGKDDYVCKKTFSDRGWGNGCALFGKGSIVGCAKVACNTANVMKTHIYEQQAVQYVVGIEVHRGEVIKANVSDKVIKASFSAEAEKHTVEIPDYGSLDFTCRVVASADLSNIRLLEVDGHYFNVHEDWLDDLPLPWRINAGPWRGMDKLVNFREPYAVKMVIMGYGDQRPAVLGALDKAEEIKKVGDNYHLNGGHVSCKVSVAKLKLKGMTYVVCGGKFAWAKKPIATNHDTVAMEVTYTGNDTPCRVTVKNVKENSDDQGTLITTNPFVESNGATIFLELEPVYGLSTIKVGDITYQWNQQGSVIGKAVRKITNDIHKTIVVGSAFWNSDQRFSAINLMDLIRLPFAFLFGGLGFMMKMIISLVLIWFCLNTRNFSIAVTSGIVGFGLLAFTTGVMG

SEQ ID NO: 15384 - protein, 501 aa, unidentified; identical to SEQ ID NO: 8222

SEQ ID NO: 15385 - protein, 500 aa, unidentified; identical to SEQ ID NO: 15213

SEQ ID NO: 15386 - protein, 150 aa, unidentified
KLQPPMPPKTMIKEQTAVGMLSWYDHTVQGYLYKRELYTNYQYYGTALDANSYPMKRWQTFLPDTSELEEWIRTKKCQVGRNLCGESDFWGSWSQECLKSPRDLLTTNPQWVNDEVRHECSGGEWIKFPYHTCLISWSCFIREIDLPVRV

SEQ ID NO: 15387 - protein, 72 aa, unidentified
IPERGILLEPAGQYYSYSGYSLIPIIYTIPSVKLQGDNRTYCPSNRIIHPIYRSMVDRIYANIKPQRHSRAP

SEQ ID NO: 15388 - protein, 489 aa, unidentified
MGQIVTFFQEVPHIIEEVMNIVLITLSLLAILKGIYNVMTCGLIGLITFLLLCGKSCSKIYKDNYEFMHLDLDMSGLNATMPLSCSKNNSHHYIQVFNTSGLELTLTNDSIITHKYCNLSDAHKKNLYDHTMMAIISTFHLSLPNFNQYEAMSCDFNGGKISVQYNLSHQTDSKAQQHCGSVANGVLDTFRRMMWCSSCDYNVYMPGTHCITTPYNYLIIQNTTWDDHCQFSRPSPMGYLSLLAQRTRQIYISRRLLGTFTWTLSDSSGNDLPGGYCLQRWMLIEAELKCFGNTAVAKCNQQHDEEFCDMLRLFDFNKEAIKRLRVDAEKSINLINKAINSLINDQLVMRNHLRDLMGIPYCNYSKFWYLNDTRSGKTSLPKCWLVTNGSYLNETHFSSEIEQEADNMITEMLKKEYDRRQSTTPLGLVDLFVFSTSFYLISVFLHLVKIPTHRHIVGKPCPKPHRLNHMGVCSCGMYKQPGVPTKWKR

SEQ ID NO: 15389 - protein, 293 aa, unidentified; identical to SEQ ID NO: 8158

SEQ ID NO: 15390 - protein, 567 aa, unidentified
  VARIANT 505: note = Any amino acid
  VARIANT 510: note = Any amino acid
  VARIANT 512: note = Any amino acid
  VARIANT 562: note = Any amino acid
MSNSKEVKSFLWTQALRRELSPYCTSVKLQVIKDAQSLLNSLDFSEVSNVQRLMRKGKRDDGDLKRLRDLNQAVNNLVELKSQQQKNVLSVGQLSSDDLLVLAADIDRLKAKITRTERPQSNGVYMGNLTVQQLEQRKRLLEMVGMTRPNLRAGSDGVVRVWDVRNPDLLNNQFGTMPSLTIACMTKQGQSDINDVVQALTDLGLIYTAKYPNSSDLDQLVKDHPVLGIIDTEKSAINVSGYNFSLSAAVKAGACMLDGGNMLETIKVTPQNIDPILKKTLAVKKSVGMFVSDTPGDRNPYENFLYKICLSGNGWPYIASRTSILGRAWDNTVVDLSNNNPTTKPPNQQARDKVPGLQQTVGLTYSQVMCLKEIMTGMDPTSKTWIDIEGRAEDPVEIAIYQPAGGQYIHFYREPTDAKQFKQDSKYSHGIDIIDLFRVQPGLTSAVIESLPKGMVLTCQGSEDIRKLLDSQGRRDIKLIDVMMSKIDARKFENEVWDDLKTLCXMHTGXVXEKKKRGGKQEITPHCALLDCIMYEAATQGSYRTPKLTPLLPTDLVFRAGXPKVTL

SEQ ID NO: 15391 - protein, 603 aa, unidentified
MFILKLLFNYILFVHYSYALIAFDCESKISERRTFSLVETNPCIPIVHNITTSIEKIQVVQPRVFDKLEYIQCMITISHQIFRCGKTIDTFQAGGIYSEVVEVSRSQCEDLHKLRTFNYFGVQIKLEKGNSVTKLSTETFGSIDSDGSCTPGNGQLHANNRVYSRAVRTSNIEITLIKSLGTIDIDEKKFILEDTTKCRYEDFECFSVNNGYSYWEEANDKIHCPESQEYTVLFEGACTKIIETKDGFSITSYLMNIDDYDFQITRRDKQIRLCGQLGWATEHPKLSIIEEQQNLGFNLKPDKTLFNKEVNLMTYFNSKLLYIMKHTKDQVDSLYQKISHDRCNSETRIVNSMMTLALISPLEFAYEYFQSPGYTATVRGEVIHVGKCQPVHVNYTSSIDKCYNELPVTYDGNLAFMLPRTRILSKIGTEVDCSGLINIMYKLTDSWYSVSRDLIHTHKPEIISITPNDIWEFKMISGLAESGIYSQRDLDQVQKILMNPVEKEILSSRILRTLDGASSLPTGYSLYNTFTPQDLERLTKNTVSTFFMVFYGKMTTIGNFFSFLLALFMILRFIKFILNSIINWTYLYRTVGLSWKLIFCWWE

SEQ ID NO: 15392 - protein, 433 aa, unidentified
SSDSSGVDCRGIFKLQPPMPPKTMIKEQTAVGMLSWYDHTVQGYLYKRELYTNYQYYGTALDANSYPMKRWQTFLPDTSELEEWIRTKKCQVGRNLCGESDFWGSWSQECLKSPRDLLTTNPQWVNDEVRHECSGGEWIKFPYHTCLISWSCFIREIDLPVRVLEDGKIYSSFSNGTMFELTKHIYTMEKGAQLYIPTLPLKHQSEVILDCLGSENSGGLKCILRSGPKELIGGVYSGNSTYVANRHSNILVNLTSLNMTASERVIISDKSASLSDLYEVDSLVREVSLRSDLNDFELTKGLTELTGVVTRLIENLSQKDPLLLSKVLQGEELYRTVYTSGGLFTKCLIARPYKPVSEFCVPQGLTMQSGIPVPWDGKSVCLKPNAEVTPIVLLHEIHEIEGLEKGVSIEGASFQWSIYEFIELERLNMEESM

SEQ ID NO: 15393 - protein, 229 aa, unidentified; identical to SEQ ID NO: 8171

SEQ ID NO: 15394 - protein, 526 aa, unidentified
MPSQAVFLVLTTVFSQCVGKFPIYTIPDKLGPWSPIDIHHLSCPNNLVVEDDGCTTLSGFTYMELKVGYITTIKVDGFTCTGIVTEAETYTNFVGYVTTTFKRKHFRPGPSACRDAYNWKAAGDPRYEESLHNPYPDSHWLRTVTTTKESLLIISPSVVDMDAYDKSLLSKIFPNGKCPGVSIASPFCSTNHDYTIWMPENTKTGMSCDIFTTSKGKRATKDGKLCGFVDERGLYKSLKGSCKLKLCGVSGLRLMDGSWVSIQNHEEAKWCPPDQLVNVHDFHSDEIEHLIVEELVKKREECLDALESIMTTKSISFRRLSHLRKLVPGFGKAYTIINKTLMEADAHYKSIREWSEIIPSKGCLVAGGRCYHHHNGVFFNGIILSPDGHVLIPEMQSALLQQHIELLESSVIPLMHPLADPSTVFKGDDGAEDFVEVHLPDVQKQISGIDLGLPEWKRYFLIGVAALTLFALTIFVVVCCRRVRRRERAKPNPVELIRKVSVTSQSGKVIPSWESYKVEAEGQSQA

SEQ ID NO: 15395 - protein, 620 aa, unidentified
MKAMHYYKNDFADPGTNDNSSDLTTNPFISNQIKSNLSPPVLAEGHLSPSPIPKFRKILLTISFVSTIVVLTVILLVLTIRILTIIEASAGDEKDIHTILSSLLNTFMNEYIPVFKNLVSIISLQIPQMLIDLKTSSTQMMQSLKTFPRDLETLSTVTQSVAVLLEKAKSTIPDINKFYKNVGKVTFNDPNIKVLTLEVPAWLPIVRQCLKQDFRQVISNSTGFALIGALPSQLFNEFEGYPSLAIVSEVYAITYLKGVMFENQENFLYQYFEIGTISPDGYNKPYFLRHTSVMLSTFKLSGKCTAAVDYRGGIFLCTPSPKIPKILQNPPDLPTLTVVSIPFDGRYTIRNISLMLTDEADIIYDLDTLQGRGVLQAMRFYALVRVISSSSPRHFPFCKNSWCPTADDKICDQSRRLGADGNYPVMYGLISIPAHSSYQGNVSLKLIDPKYYAYTRDASLFYNSMTDTYHYSFGTRGWVSRPIIGELLLGDDIVLTRYTVRSVSRATAGDCTTVSMCPQACSGGMNSIFYPLNFDKPQVTGVAIRQYERQQEGIIVVTMNDHYYYSVPIIKNGTLLISSVTDCFWLMGDLWCMSLMEKNNLPLGVRSLAHLTWNIHWSCS

SEQ ID NO: 15396 - protein, 615 aa, unidentified
MDKLSVFCIVLLHSSLSTQSFDFGKLIQEGGRGPVIQSPSSSKDIQDEYAPSFIPNPAAKNLYNDPGLQAYSVTHSDTIYDMVPVYSCNTTDEGFSVSEWYGICKAQCSYSSDMRHTALSIFQYSQKIDYIPVMGVETFTITKKSHVSLLGTCMVYVESSVPTVLNISEFSPYLDQIIQLGEDPRKTAIEYQTMDDPECTYWEDIEVSGYKFIIYPDAWGVSSDLEGNLVVKNPYTGNYSSLSDNGVFYGSTWHLWNSSYAYMPRTCPLLLASVEDCLLNPLLGVYHCPDSGVLINTNGVIEKSDTCVGSVNISSNGIFYVEGNKSLSLAITGRVSTLIGSQNPSYTGITDLLTTISDTIGILEDTYCGTLCDLADRSFQQMIYEEDVVDTANGPWLPVQNGGIMRVVPCRVDTRHAFSIPLSYCANKNMFMIRNIDTGDTNWWNPVYSYFDKSDMCNISSINPYKQMMDQGSPIKFNFWRGEAVLYPPYTGPLQWTPRANPNSIRSSKWFPQIKNVSDSIGMTIDKFSDHIVFNVNKTSSQVSQNTPYSTVVTSPIVKILTKIWTDVQIIAGGIWSFLTGFTKWVYILVLTILVLYATRIFISFFRRTNDPGWM

SEQ ID NO: 15397 - protein, 579 aa, unidentified
MESGISQASLVNDNIELRNTWRTAFRVVSLLLGFTSLVLTACALHFALNAATPADLSSIPVAVDQSHHEILQTLSLMSDIGNKIYKQVALDSPVALLNTESTLMSAITSLSYQINNAANNSGCGAPVHDKDFINGVAKELFVGSQYNASNYRPSRFLEHLNFIPAPTTGKGCTRIPSFDLAATHWCYTHNVILNGCNDHAQSYQYISLGILKVSATGNVFLSTLRSINLDDDENRKSCSISATPLGCDLLCAKVTEREEADYNSDAATRLVHGRLGFDGVYHEQALPVESLFSDWVANYPSVGGGSYFDNRVWFGVYGGIRPGSQTDLLQSEKYAIYRRYNNTCPDNNPTQIERAKSSYRPQRFGQRLVQQAILSIRVEPSLGNDPKLSVLDNTVVLMGAEARIMTFGHVALMYQRGSSYFPSALLYPLSLTNGSAAASKPFIFEQYTRPGSPPCQATARCPNSCVTGVYTDAYPLFWSEDHKVNGVYGMMLDDITSRLNPVAAIFDRYGRSRVTRVSSSSTKAAYTTNTCFKVVKTKRVYCLSIAEIENTLFGEFRITPLLSEIIFDPNLEPSDTSRN

SEQ ID NO: 15398 - protein, 476 aa, unidentified
MIAHKLILPLVILTSFQKIRREDITCPVYNHKNVNVSSQSLLQFELKQVSFNSGEDVINYNPLITGYLCRKLSYETSCYANLFTSNTVDYKLKILPVTKQECTTGSNSQVKSFPIPICNWSMFGSNVVKETKQYIEYEQRSYKMDMVSGKLKHVEEIFDKCSDEYCILKGNSGYWIRDDQEEKKYCPKVEEQKIPAKIKVIDQFEYLEVAQHIYDIQELCSLEVCGQNLVHIPDIGNFVGDDRFVRKLKKCKSLPSLRNAIENNSEDIVGNEKCLDFRLKMLDNPDKSIKYHDIRNLHPRSPGINRVYRLGENNTLESAIAYYGSTGVEKISKKLNYWVNCTEDKVCSYNGYMGRDKLHLRSKLDNEIYQDIFEVDDNLIVYQPIRNISESFYTDVVHYELLDKVTKSFSIFDSNYYIKIICFVLILLSLFLIYKIIRVLVVTCLNNKPRFGKFQKINKTKGHELDTMKKDISQWK

SEQ ID NO: 15399 - protein, 470 aa, unidentified
MITHKYILPIIVLSNFMPVKRDDLTCPIYNHQNVEFVNTTITYIRLNSVLLQSKSLELKQMPYVRGHICQKIRYITTCKANLFTSNEIFYKKEYLTVTKNDCEMKAVHETGEYPAPICTWSLFGSNLHNEEIIVTEIQSHDYHYDLFNGKIKDSEYLFEHCTLMYCKLREHKGYWIKSEPTKNDICPIVQDDEIVAELKFYNENHFLKINHHLYSTEEVCKIKYCNNSLLFFKDIGFFNIKSTLQKMDKIFKKCTKIEDLRYIIHDNVEKIDNLNDCLNFKLNVLTNKDRTIAYHDIRKLHPKGTGINRIYRLNGNNTLESAIAYYGSVESNETKIYLDYWNDCSKTHTCTYNGYMGKKGLNIRARLNIDLFQEVYEEDSSLLIYNGTTDLSTGTIGELTKGDANVTFTTKEWIPHISNYIIIIVFCLLSGAVFIIMINIYNRIMVMKRNRKAFYNRENDNRVIYVNDWK

SEQ ID NO: 15400 - protein, 576 aa, unidentified; identical to SEQ ID NO: 9004

SEQ ID NO: 15401 - protein, 595 aa, unidentified
MATNLSTITNGKFSQNSDEGSLTELPFFEHNRKVATTKRTCRFVFRSVITLCNLTILIVTVVVLFQQAGFIKRTESNQVCETLQNDMHGVVTMSKGVITTLNNLIEITSVNLPFQMKQFGQGIVTQVTQMVRQCNAVCKGPTIGPDIQNIVYPASYESMIKHPVNNSNILLSEIRQPLNFVPNTGKLNGCTRTPSFSVYNGFWCYTHAESDWNCNGSSPYMQVFRVGVVTSDYDYNVIHKTLHTKTSRLANVTYQCSTISTGYECYFLCSTPNVDEITDYKTPGIESLQIYKIDNRGTFAKFPITDQLNKELLTALYPGPGNGVLYQGRLLFPMHGGMQSSELNKVNLNNTVLSQFNDNKGCNATEIKLESEFPGTFTSPYYSNQVMLNYILICEMIENLPGNCDLQIVAPKNMSMGSESQLYSINNKLYLYQRSSSRWPYPLIYEVGTRLTNRQFRLRAINRFLIKSTTRPGSEGCNIYRVCPKVCVTGVYQAPWILHVSKAGSQSIAKVLYAVAWSKDHMSRKGPLFSICDNDTCFLTKSLASEHVHSGYSITRCYLENSERHIICVVIMELDASPWAEMRIQSVIYNITLPS

SEQ ID NO: 15402 - protein, 583 aa, unidentified
MDNSMSISTISLDAQPRIWSRHESRRTWRNIFRITSLVLLGVTVIICIWLCCEVARESELELLASPLGALIMAINTIKSSVVKMTTELNQVTFTTSIILPNKVDQFGQNVVSQVAQLVKQCNAVCRGHQDTPELEQFINQKNPTWILQPNYTTKLTNLHEIDSIIPLVDYPGFSKSCTRFPSFSEGSKFWCFTYAVVKEPCSDISSSIQVVKYGAIKANHSDGNPYLVLGTKVLDDGKFRRGCSITSSLYGCYLLCSTANVSEVNDYAHTPAYPLTLELISKDGITTDLSPTYTVQLDKWSALYPGIGSGVIFKGYLMFPVYGGLPFKSPLISASWVGPGNKWPVDFSCSEDQYSTFNFSNPYSALYSPHFSNNIVVSALFVCPLNENLPYSCEVQVLPQGNLTIGAEGRLYVIDQDLYYYQRSTSWWPYLQLYKLNIRITNRVFRVRSLSLLPIKSTTRPGYGNCTYFKLCPHICVTGVYQSPWLISIRDKRPHEEKNILYFIGWSPDEQIRQNPLVSLCHETACFINRSLATNKTHAGYSESHCVQSFERNKLTCTVFYELTAKPWAEMRVQSLLFQVDFL

SEQ ID NO: 15403 - protein, 583 aa, unidentified
MDRSRSLDYLADSPEIKNTWRQFFRVVLIILQITMLCISISALAITIQVRDQHLPSLIKENPKTTSSLISSELNPLLSYLPGINREVQLNIPIQLDKIQQSATSEINRLTAAINQMAFGTLSPGLLLKNSKDYVGGINKPLIPSDKLNWTNATISGFIEHPSFIPGPTTKKGCTRIPSFHLAESHWCYTHNTIASGCEDHGVSSMYISGGILYKGSNKEPSLLTTVSILLADELNRKSCSIIASSYGCDVLCSLVTESESQDYKSVNPTPMVHGRLFFNGSYSEQELDPRIFGDLWTANYPGVGSGILLKDRLVFPIYGGLDETKLNLTSYLNHPLYTKNEWVSCNKSYDEVVQTLRAAYRPSWFAGRVVTQGVMVCHYDRELLGRCLIARFNTSTVMMGAESRLVMQGDSLLLYQRSSSWWPVGIVYLVPESIISINETNSVFDLSPIPLSKFPRPTNKKGYCERPAVCPAVCVTGVYQDLWPLSPLAIENRTATNPTFAGAFLNAFTTRTAPYFGVAGPNKWARSVQLFTDQTPASYSTTTCFKDTITTQTYCLIIIELQENLLGTWKIVPLLVKVSLVYS

SEQ ID NO: 15404 - protein, 580 aa, unidentified
MDSRSDSFTDIPLDNRIERTVTSKKTWRSIFRVTAIILLIICVVVSSISLNQHNDAPLNGAGNQATSGFMDAIKSLEKLMSQTINELNQVVMTTSVQLPNRITKFGQDILDQVTQMVRQCNAVCRGPGVGPSIQNYVIQGHAPTVSFDPISAEYQKFVFGITEKTLITAYHNPWECLRFPSQHLFDTTWCVSYQILTQNCSDHGPRITVIQLGEIMIANNLSTVFRDPVIKYIRHHIWLRSCSVVAYYSQCTIFCTSTNKSEPSDYADTGYEQLFLATLQSDGTFTEHSMHGVNIVHQWNAIYGGVGNGVIIGRNMLIPLYGGINYYDHNTTIVQTVDLRPYPIPDSCSQTDNYQTNYLPSMFTNSYYGTNLVVSGYLSCRLMAGTPTSCSIRVIPIENMTMGSEGQFYLINNQLYYYKRSSNWIRDTQVYLLSYSDKGNIIEITSAERYIFKSVTSPDEGDCVTNHGCPSNCIGGLFQAPWILNDFKLCGSNITCPKIVTVWADQPDKRSNPMLSIAETDKLLLHKSYINYHTAVGYSTVLCFDSPKLNLKTCVVLQELMSDDKLLIRISYSIVSIMVE

SEQ ID NO: 15405 - protein, 610 aa, unidentified
MVFLSLSTIIFILSLRAVTCSNPLSYPNGILTNNSTHNHPLSDFYIFYENSSLTYTQFPVAPDCSSILDTRDEQYPTTVTLWKVDQESQAEWGLLLWQERIDTTCSWNFWGNYKGSIVSKSSVPLKDIPSGSARNGYWALSNDEVQEIDHVPYNLRYYCYWCRNEYPGSFYMRYVKKVRIIRNPDGSIKTPRGSWVHELDNLWGDQMRYLVIRRFGGESSCPLKIYDVRAGVLSKSRSNFILVSLPSLNLQFSVSLESTETKCSFGDKTYDIVQSMGGYLLSIDIGNANWRGPWDPTPQHPGRERRSIMEFPDQTSFRYNQFINYHSSPRHKRHDQEFEFPLSLKSSYDYAQFRYEQNFIIRQINKNFGLLQKSICDIQFSKWQNLSPPNLAMKIAHYVTGSIHSIGGVHHGSYSIQRTEKSITKVNLVFPIVIVHGMYKCQREPSKEVVWAEPVTGILFKSPIPTHFSLSSSWLPGVNGSSIVPLTGQILLPEITMDHLEVVQQVEAKMVKSMYTNVELFGSTEEFQRYQTQGITSDEQSNTVNPWIGLLIHGGVSIATGILVALLIPSILKLFRHIIEKGEASLEERLHLRETSRKEFVKVRGKPWGV

SEQ ID NO: 15406 - protein, 506 aa, unidentified
MLRYAFVLLMIAVAFGWEPELGEYWVPSPISPWRLATKTDFTCPSIRVDPVSPLKAINESYVEYPTMGGARKEHPGWLCIRKTYQTTCDTNFWGHQTIKHEEWSIVADVEECRQAVSHYQLGTYEDPRHPDPVCTWMAISSTYRAGTLLLPHTTLVDPFSYTFVDSLFPGTHCKTIPCMTVHPDVLWHSSSTITENCPMANGIHIKLYNDNRARKKAHEWLSVNDGPLIPLGGSCSMHYCGQAGLRTPGGIWYPYLGRQKYPECKEAWRATPTPAGNGAKLDIELQELIARRECLNVLQQIRSGVSPTFHMLSHFQPRHTGYYRVYRMNNGLVEYSLALYAPIFNITMPPSINFGVRRNKSRYHLPMIESGHPGVWSAFNGIHIMHNKTVIVPELELYKEHYSETLFYYKAQLAEHPSQVRQANSTDITPHTKTTVTVKRPTLKAWFSTMWDSLWGKVVSITGIILAIFTTGFLIKVLPWSRLFRRPQPMHPQIVHYTPATGSVSW

SEQ ID NO: 15407 - protein, 582 aa, unidentified
MHARNSSVSSISDSIDNVFGKRNTPVIKRTGKKLFRLGSLIFLIVIISLTVKIITELSLVKSECSNRDHVTEIINLQQKELSLMNNIITTLNTLLTTTTVDLPIKLTNFGKSIVDQVTMMVRQCNAVCRGPGDKPTQNIQLFNGRYAIINNSTAYPSRNSISELKVPRDFVPSPGTFHGCSRFPSYSNHYGLWCYSHTVSNDTCDGSNPSVQILSVGKLITGDNGQPEHKTLYTQQLSQTDRLYHCSVTMTTLGCYILCSKPRVNETQDYETIGIEPMIIGMLGLDGVYTDLGNPVGISDNSLYAMYPGPGGGVMYKDFLVFPLHGGVRFSEASKMLGKNITFRGFPPSDTCTEHEKSLTQEPANMLTSPYYGEVLVLDFLYVCTLLDNIPGECSIQLIPPDNMTMGSESKLYKLNNSLLLYKRSSSWWPYTEVYQLSLRVSKNSMKVRESVRLNITSTTRPGVEGCNINKVCPKVCVTGVFQAPGIIRKALSPKESNEDLLFFQAWTSDSIARQGPLISLCRADSCVLTIPLGNSDVFIGYTDSFCLSDRDNEKIYCVALLELDNMPYSEMTIRSFLYLIK

SEQ ID NO: 15408 - protein, 569 aa, unidentified
MESIGKGTWRTVYRVLTILLDVVIIILSVIALISLGLKPGERIINEVNGSIHNQLVPLSGITSDIQAKVSSIYRSNLLSIPLQLDQINQAISSSARQIADTINSFLALNGSGTFIYTNSPEFANGFNRAMFPTLNQSLNMLTPGNLIEFTNFIPTPTTKSGCIRIPSFSMSSSHWCYTHNIIASGCQDHSTSSEYISMGVVEVTDQAYPNFRTTLSITLADNLNRKSCSIAATGFGCDILCSVVTETENDDYQSPEPTQMIYGRLFFNGTYSEMSLNVNQMFADWVANYPAVGSGVELADFVIFPLYGGVKITSTLGASLSQYYYIPKVPTVNCSETDAQQIEKAKASYSPPKVAPNIWAQAVVRCNKSVNLANSCEILTFNTSTMMMGAEGRLLMIGKNVYFYQRSSSYWPVGIIYKLDLQELTTFSSNQLLSTIPIPFEKFPRPASTAGVCSKPNVCPAVCQTGVYQDLWVLYDLGKLENTTAVGLYLNSAVGRMNPFIGIANTLSWYNTTRLFAQGTPASYSTTTCFKNTKIDTAYCLSILELSDSLLGSWRITPLLYNITLSIMS

SEQ ID NO: 15409 - protein, 588 aa, unidentified
MPPVPTVSQSIDEGSFTDIPLSPDDIKHPLSKKTCRKLFRIVTLIGVGLISILTIISLAQQTGILRKVDSSDFQSYVQESFKQVLNLMKQFSSNLNSLIEITSVTLPFRIDQFGTDIKTQVAQLVRQCNAVCRGPIKGPTTQNIVYPALYETSLNKTLETKNVRIQEVRQEVDPVPGPGLSNGCTRNPSFSVYHGVWCYTHATSIGNCNGSLGTSQLFRIGNVLEGDGGAPYHKSLATHLLTTRNVSRQCSATASYYGCYFICSEPVLTERDDYETPGIEPITIFRLDPDGNWVVFPNINRFTEYSLKALYPGIGSGVLFQGKLIFPMYGGIDKERLSALGLGNIGLIERRMADTCNHTEKELGRSFPGAFSSPYYHDAVMLNFLLICEMIENLPGDCDLQILNPTNMSMGSESQLSVLDNELFLYQRSASWWPYTLIYRLNMRYTGKYLKPKSIIPMVIKSNTRPGYEGCNHERVCPKVCVTGVFQAPWILSIGRDHKERVSNVTYMVAWSMDKSDRTYPAVSVCGSDTCKLTVPLGDSKVHSAYSVTRCYLSRDHMSAYCLVIFELDARPWAEMRIQSFLYKLILT

SEQ ID NO: 15410 - protein, 575 aa, unidentified
MDSSQMNILDAMDRESSKRTWRGVFRVTTIIMVVTCVVLSAITLSKVAHPQGFDTNELGNGIVDRVSDKITEALTVPNNQIGEIFKIVALDLHVLVSSSQQAIAGQIGMLAESINSILSQNGSASTILSSSPEYAGGIGVPLFSNKLTNGTVIKPITLIEHPSFIPGPTTIGGCTRIPTFHMASSHWCYSHNIIEKGCKDSGISSMYISLGVLQVLKKGTPVFLVTASAVLSDDRNRKSCSIISSRFGCEILCSLVTEAESDDYKSDTPTGMVHGRLYFNGTYREGLVDTETIFRDFSANYPGVGSGEIVEGHIHFPIYGGVKQNTGLYNSLTPYWLDAKNKYDYCKLPYTNQTIQNSYKPPFIHGRFWAQGILSCELDLFNLGNCNLKIIRSDKVMMGAESRLMLVGSKLLMYQRASSWWPLGITQEIDIAELHSSNTTILREVKPILSSKFPRPSYQPNYCTKPSVCPAVCVTGVYTDMWPISITGNISDYAWISHYLDAPTSRQQPRIGIANQYFWIHQTTIFPTNTQSSYSTTTCFRNQVRSRMFCLSIAEFADGVFGEFRIVPLLYELRV

SEQ ID NO: 15411 - protein, 582 aa, unidentified
  VARIANT 46: note = Any amino acid
  VARIANT 47: note = Any amino acid
MHNRTQSVSSIDTSSDVYLPRRKKAVTKFTFKKIFRVLILTLLLSXXIIIAVIFPKIDHIRETCDNSQILETITNQNSEIKNLINSAITNLNVLLTSTTVDLPIKLNNFGKSIVDQVTMMVRQCNAVCRGPGDRPTQNIELFKGLYHTSPPSNTSTKLSMITEASNPDDIVPRPGKLLGCTRFPSFSVHYGLWCYGHMASTGNCSGSSPSVQIIRIGSIGTNKDGTPKYVIIASASLPETTRLYHCSVTMTSIGCYILCTTPSVSETDDYSTMGIEKMSISFLSLDGYLTQLGQPTGLDNQNLYALYPGPGSGVIFRDFLIFPMMGGIRLMDAQKMLNRNITYRGFPPSETCTESELKLKQEVANMLTSPYYGEVLVLNFLYVCSLLDNIPGDCSVQLIPPDNMTLGAESRLYVLNGSLIMYKRGSSWWPYTELYQINYRVNNRAFRVRESVRINTTSTSRPGVQGCNLEKVCPKVCVSGIYQSPGIISAPVNPTRQEEGLLYFLVWTSSMSSRTGPLSSLCDHSTCRITYPIGDDTIFIGYTDSSCFMSSIKEGIYCIAFLELDNQPYSMMAIRSLSYIIN

SEQ ID NO: 15412 - protein, 622 aa, unidentified
  VARIANT 73: note = Any amino acid
  VARIANT 74: note = Any amino acid
  VARIANT 75: note = Any amino acid
  VARIANT 76: note = Any amino acid
  VARIANT 77: note = Any amino acid
  VARIANT 78: note = Any amino acid
  VARIANT 79: note = Any amino acid
  VARIANT 80: note = Any amino acid
  VARIANT 81: note = Any amino acid
  VARIANT 82: note = Any amino acid
  VARIANT 83: note = Any amino acid
  VARIANT 84: note = Any amino acid
  VARIANT 85: note = Any amino acid
  VARIANT 86: note = Any amino acid
  VARIANT 87: note = Any amino acid
  VARIANT 88: note = Any amino acid
MLSQLQKNYLDNSNQQGDKMNNPDKKLSVNFNPLELDKGQKDLNKSYYVKNKNYNVSNLLNESLHDIKFCIYXXXXXXXXXXXXXXXXISIVITRLKVHEENNGMESPNLQSIQDSLSSLTNMINTEITPRIGILVTATSVTLSSSINYVGTKTNQLVNELKDYITKSCGFKVPELKLHECNISCADPKISKSAMYSTNAYAELAGPPKIFCKSVSKDPDFRLKQIDYVIPVQQDRSICMNNPLLDISDGFFTYIHYEGINSCKKSDSFKVLLSHGEIVDRGDYRPSLYLLSSHYHPYSMQVINCVPVTCNQSSFVFCHISNNTKTLDNSDYSSDEYYITYFNGIDRPKTKKIPINNMTADNRYIHFTFSGGGGVCLGEEFIIPVTTVINTDVFTHDYCESFNCSVQTGKSLKEICSESLRSPTNSSRYNLNGIMIISQNNMTDFKIQLNGITYNKLSFGSPGRLSKTLGQVLYYQSSMSWDTYLKAGFVEKWKPFTPNWMNNTVISRPNQGNCPRYHKCPEICYGGTYNDIAPLDLGKDMYVSVILDSDQLAENPEITVFNSTTILYKERVSKDELNTRSTTTSCFLFLDEPWCISVLETNRFNGKSIRPEIYSYKIPKYC

SEQ ID NO: 15413 - protein, 625 aa, unidentified
  VARIANT 163: note = Any amino acid
  VARIANT 164: note = Any amino acid
  VARIANT 165: note = Any amino acid
  VARIANT 166: note = Any amino acid
  VARIANT 167: note = Any amino acid
  VARIANT 168: note = Any amino acid
  VARIANT 169: note = Any amino acid
  VARIANT 170: note = Any amino acid
MATNRDNTITSAEVSQEDKVKKYYGVETAEKVADSISGNKVFILMNTLLILTGAIITITLNITNLTAAKSQQNMLKIIQDDVNAKLEMFVNLDQLVKGEIKPKVSLINTAVSVSIPGQISNLQTKFLQKYVYLEESITKQCTCNPLSGIFPTSGPTYPPTDKXXXXXXXXDKVDTTIKPIEYPKPDGCNRTGDHFTMEPGANFYTVPNLGPASSNSDECYTNPSFSIGSSIYMFSQEIRKTDCTAGEILSIQIVLGRIVDKGQQGPQASPLLVWAVPNPKIINSCAVAAGDEMGWVLCSVTLTAASGEPIPHMFDGFWLYKLEPDTEVVSYRITGYAYLLDKQYDSVFIGKGGGIQKGNDLYFQMYGLSRNRQSFKALCEHGSCLGTGGGGYQVLCDRAVMSFGSEESLITNAYLKVNDLASGKPVIIGQTFPPSDSYKGSNGRMYTIGDKYGLYLAPSSWNRYLRFGITPDISVRSTTWLKSQDPIMKILSTCTNTDRDMCPEICNTRGYQDIFPLSEDSEYYTYIGITPNNGGTKNFVAVRDSDGHIASIDILQNYYSITSATISCFMYKDEIWCIAITEGKKQKDNPQRIYAHSYKIRQMCYNMKSATVTVGNAKNITIRRY

SEQ ID NO: 15414 - protein, 733 aa, unidentified
MSQLAAHNLAMSNFYGTHQGDLSGSQKGEEQQVQGVIRYVSMIVSLLSLFTIIALNVTNIIYMTESGGTMQSIKTAQGSIDGSMREISGVIMEDVKPKTDLINSMVSYNIPAQLSMIHQIIKNDVPKQCTPSFMFNNTICPLAENPTHSRYFEEVNLDSISECSGPDMHLGLGVNPEFIEFPSFAPGSTKPGSCVRLPSFSLSTTVFAYTHTIMGHGCSELDVGDHYFSVGRIADAGHEIPQFETISSWFINDKINRRSCTVAAGAMEAWMGCVIMTETFYDDRNSLDTGKLTISYLDVFGRKKEWIYTRSEILYDYTYTSVYFSVGSGVVVGDTVYFLIWGSLSSPIEETAYCFAPDCSNYNQRMCNEAQRPSKFGHRQMVNGILKFKTTSTGKPLLSVGTLSPSVVPFGSEGRLMYSEITKIIYLYLRSTSWHALPLTGLFVLGPPTSISWIVQRAVSRPGEFPCGASNRCPKDCVTGVYTDLFPLGSRYEYAATVYLNSETYRVNPTLALINQTNIIASKKVTTESQRAGYTTTTCFVFKLRVWCISVVELAPSTMTAYEPIPFLYQLDLTCKGKNGSLAMRFAGKEGTYKSGRYKSPRNECFFEKVSNKYYFIVSTPEGIQPYEIRDLTPDRMPHIIMYISDVCAPALSAFKKLLPAMRPITTLTIGNWQFRPVEVSGGLRVNIGRNLTKEGDLTMSAPEDPGSNTFPGNHIPGNGILDAGYYTVEYPK

SEQ ID NO: 15415 - protein, 526 aa, unidentified
MRTLVIWFLINVTMAFAKPPGSASLSLGLYWVPRIDNNTWKSVHTTNLVCPSFVGSVLPEMEESFEIDIQVPKHSQTTSHQGGYLCYGFSFSVVCEEGFWGGQKVTEHTFTHLVSSEECLKAIEDKKSGEYRPPHTPVSECGWMQTNTKTLRFVTLEEHPVLFDPYTVNFVDGLFEKTLCNQRICPTVHANTIWIGDNEPKKDCPPTENEKAVLYVEKQNVVPVVWVKLTGGTVYKLDRACTMTYCDIDGVRMEDGHWFAGVNLTQYVRRDCDKGMDITFDTLASLSLLTKIELEHVQDRMECLDAVQDLRAGGKVTYAKLSKLQPKRGGLFHVYRINKGTLEYTMGRYEGLTSLITNIPFVIGKNQKDEKVQLHHVPSGDNSTLSSYNGVHMFLNGTVIIPEMELYKLRYSETLLYEHLLGKMKHPSAKQRERMGLTPDDDKRTTNKSLNIGEWFSSFWSHLVGKIVSILGTALAIFLILYICWTCLKIQIKRVSDKNRVDQMEMQILSKARAPEVRPTLSGPIW

SEQ ID NO: 15416 - protein, 546 aa, unidentified
RVAIILVSLSITFGQVDYGRLRKIGVFEKQTMNLKLSISASQRYMVIKTVPNLGTVSSCGDKEMAAYKESIRKLISPMHDMIEYIKGEVVVEAATSVALNGTQVRFFGLVVAIGALGLATSAQITAGIALHNSLENAKAIKGLSDAMKESNQAIQKLQDATAGTVIALNALQDQINTQIVPALNTLGCSVVSNTLGVALTRYYSELVQLFGPSLANPVEAPLSIQAISGAFNGDLKGMIRDYGYSPSDLEDIIRTGAITGRVIDVDMEDLTIILEISLPTLLVMRDTKVVNFGRITYNLNGSEWQTLSPDWIAIRNTLMSGVDLSTCVMSRQNLICKQDPTFAIDHTVSQCLRGEITSCPRGRVVNSIAPRFAIVNGNVLGNCVATTCLCGDPGTPVIQDASSSLTIMSIDKCELVSIDGYNFRPGPPVVNTTFHLSIDDIGPEVSVNPIDISGALGKIEQDLQSSKEHLANSDTILASINPKIINTNAAIGLIVVSSLGLIAAVLALCWLCCLTKSMVGRDSTAFIGGKGPDMGPIMSSLEGMSF

SEQ ID NO: 15417 - protein, 574 aa, unidentified
MDKSYYTEPEDQRGNSRTWRLLFRLIVLTLLCLIACTSVSQLFYPWLPQVLSTLISLNSSIITSSNGLKKEILNQNIKEDLIYREVAINIPLTLDRVTVEVGTAVNQITDALRQLQSVNGSAAFALSNSPDYSGGIEHLVFQRNTLINRSVSVSDLIEHPSFIPTPTTQHGCTRIPTFHLGTRHWCYSHNIIGQGCADSGASMMYISMGALGVSSLGTPTFTTSATSILSDSLNRKSCSIVATTEGCDVLCSIVTQTEDQDYADHTPTPMIHGRLWFNGTYTERSLSQSLFLGTWAAQYPAVGSGIMTPGRVIFPFYGGVIPNSPLFLDLERFALFTHNGDLECRNLTQYQKEAIYSAYKPPKIRGSLWAQGFIVCSVGDMGNCSLKVINTSTVMMGAEGRLQLVGDSVMYYQRSSSWWPVGILYRLSLVDIIARDIQVVINSEPLPLSKFPRPTWTPGVCQKPNVCPAVCVTGVYQDLWAISAGETLSEMTFFGGYLEASTQRKDPWIGVANQYSWFMRRRLFKTSTEAAYSSSTCFRNTRLDRNFCLLIFELTDNLLGDWRIVPLLFELTIV

SEQ ID NO: 15418 - protein, 614 aa, unidentified
MESATSQVSFENDKTSDRRTWRAVFRVLMIILALSSLCVTVAALIYSAKAAIPGNIDASEQRILSSVEAVQVPVSRLEDTSQKIYRQVILEAPVTQLNMETNILNAITSLSYQIDASANSSGCGAPVHDSDFTGGVGRELLQEAEVNLTIIRPSKFLEHLNFIPAPTTGNGCTRIPSFDLGQTHWCYTHNVVLNGCRDRGHSFQYVALGILRTSATGSVFLSTLRSVNLDDDRNRKSCSVSATPIGCEMLCSLVTETEEGDYDSIDPTPMVHGRLGFDGKYREVDLSEKEIFADWRANYPAVGGGAFFGNRVWFPVYGGLKEGTQSERDAEKGYAIYKRFNNTCPDDNTTQIANAKASYRPSRFGGRFIQQGILSFKVEGNLGSDPILSLTDNSITLMGAEARVMNIENKLYLYQRGTSWFPSALVYPLDVANTAVKVRAPYIFDKFTRPGGHPCSASSRCPNVCVTGVYTDAYPLVFSRSHDIVAVYGMQLAAGTARLDPQAAIWYGNEMSTPTKVSSSTTKAAYTTSTCFKVTKTKRIYCISIAEIGNTLFGEFRIVPLLIEVQKTPLTRRSELRQQMPQPPIDLVIDNPFCAPSGNLSRKNAIDEYANSWP

SEQ ID NO: 15419 - protein, 577 aa, unidentified
  VARIANT 34: note = Any amino acid
  VARIANT 35: note = Any amino acid
  VARIANT 36: note = Any amino acid
  VARIANT 37: note = Any amino acid
  VARIANT 38: note = Any amino acid
  VARIANT 39: note = Any amino acid
  VARIANT 40: note = Any amino acid
MEPTGSKVDIVPSQGTKRTCRTFYRLLILILNLXXXXXXXISIYVSISTDQHKLCNNEADSLLHSIVEPITVPLGTDSDVEDELREIRRDTGINIPIQIDNTENIILTTLASINSNIARLHNATDESPTCLSPVNDPRFIAGINKITKGSMIYRNFSNLIEHVNFIPSPTTLSGCTRIPSFSLSKTHWCYSHNVISTGCQDHAASSQYISIGIVDTGLNNEPYLRTMSSRLLNDGLNRKSCSVTAGAGVCWLLCSVVTESESADYRSRAPTAMILGRFNFYGDYTESPVPASLFSGRFTANYPGVGSGTQLNGTLYFPIYGGVVNDSDIELSNRGKSFRPRNPTNPCPDPEVTQSQRAQASYYPTRFGRLLIQQAILACRISDTTCTDYYLLYFDNNQVMMGAEARIYYLNNQMYLYQRSSSWWPHPLFYRFSLPHCEPMSVCMITDTHLILTYATSRPGTSICTGASRCPNNCVDGVYTDVWPLTEGTTQDPDSYYTVFLNSPNRRISPTISIYSYNQKISSRLAVGSEIGAAYTTSTCFSRTDTGALYCITIIEAVNTIFGQYRIVPILVQLISD

SEQ ID NO: 15420 - protein, 704 aa, unidentified
MLRIQIPPIAIILVSLLTLDLSGARRTTTQRIPLLNDSWDLFSSYGDIPEELVVYQNYSHNSSELPPPGFERWYINRRVADTSIPCRGPCLVPYILHGLNDTTVSRRGGGWRRSGMKYPTHAVRLGPSTDDERVEEDIGYVNVSALSCTGSPVEMAIPTIPDCTSAIHPRSEVTVPVKLDVMRRNPNYPPIRAWSCIGQKITNRCDWALFGENLIYTQVEASSLAFKHTRASLLNESNGIDAEGRAVPYILGDIEPGYCRTLFNTWVSSEIVSCTPIELVLVDLNPLSPGHGGYAVLLPNGDKVDVHDKHAWDGDNKMWRWVYEKKDPCAFELVSREVCLFSLSRGSRLRGATPPQGELLTCPHSGKAFDLKGARRITPISCKIDMEYDLLSLPTGVILGLHLSELGTSFGNLSMSLEMYEPATTLTPEQINFSLKELGSWTEAQLKSLSHSICLSTFSIWELSVGMIDLNPTRAARALLHDDNILATFENGHFSIVRCRPEIVQVPSHPRACHMDLRPYDKQSRASTLVVPLDNSTALLVPDNIVVEGVEASLCNHSVAITLSKNRTHSYSLYPQGRPVLRQKGAVELPTIGPLQLHPATRVDLYTLKEFQEDRIAHSRVTDIKAAVDDLRAKWRKGKFEADTTGGGLWSAIVGVFSSLGGFFMRPLIALAAIVTSIIILYILLRVLCAASCSTHRRVRQDSW

SEQ ID NO: 15421 - protein, 632 aa, unidentified
MPQKTVEFINMNSPLERGVSTLSDKKTLNQSKITKQGYFGLGSHSERNWKKQKNQNDHYMTVSTMILEILVVLGIMFNLIVLTMVYYQNDNINQRMAELTSNITVLNLNLNQLTNKIQREIIPRITLIDTATTITIPSAITYILATLTTRISELLPSINQKCEFKTPTLVLNDCRINCTPPLNPSDGVKMSSLATNLVAHGPSPCRNFSSVPTIYYYRIPGLYNRTALDERCILNPRLTISSTKFAYVHSEYDKNCTRGFKYYELMTFGEILEGPEKEPRMFSRSFYSPTNAVNYHSCTPIVTVNEGYFLCLECTSSDPLYKANLSNSTFHLVILRHNKDEKIVSMPSFNLSTDQEYVQIIPAEGGGTAESGNLYFPCIGRLLHKRVTHPLCKKSNCSRTDDESCLKSYYNQGSPQHQVVNCLIRIRNAQRDNPTWDVITVDLTNTYPGSRSRIFGSFSKPMLYQSSVSWHTLLQVAEITDLDKYQLDWLDTPYISRPGGSECPFGNYCPTVCWEGTYNDVYSLTPNNDLFVTVYLKSEQVAENPYFAIFSRDQILKEFPLDAWISSARTTTISCFMFNNEIWCIAALEITRLNDDIIRPIYYSFWLPTDCRTPYPHTGKMTRVPLRSTYNY

SEQ ID NO: 15422 - protein, 419 aa, unidentified
ELFKEYKLTKPYMAKCIRCAVGSCHSPIAIEEVRSDGHDGYIRIQTSSQYGLDPSGGVKSRTMRYNLQGNIEEIPLHEVSLHTSRPCHIIDGHGYFLLARCPEGDSLTMEFKKDTVTHSCSVPYKVKFIPVGRELYTHPPEHGTDHPCRVYAHDAQKRGAYVEMHLPGSEVDSTLLSMSGGAVQVNPPAGTNVLVECNCGTQISETVSTVKKFNQCTQTNRCRAYRLQSDKWVFNSDKLPKASGDTLKGKLHVPFLLSEAKCTVPLAPEPVVSFGFRSVSLKLHPNNPTYLTTRHLGGEPQYTHELISEPVVKNFSITEKGWEFVWGNHPPQRFWAQETAPGNPHGMPHEIVTHYYYRYPMSTVVGLSICAAIVIISIAASLCLLCKSRVSCLTPYRLTPNARLPICLALLCCARPTRA

SEQ ID NO: 15423 - protein, 499 aa, unidentified
CSGIDKRDFIQGVSGGTWVDVVLDRKGCVTISATGKPTIDVRMVKMEASNLASVRTYCLEASTSEISSVNGCPSTTEAHNDKRKDSTYLCERSYPDRGWGNGCGLFGRGSLDTCVKFACSKKMAGHAISRENIVITAAVSVHGHSGAESDDDSQRKSRKELAELTITPKSSIVEADLGDYGKVQFECLMDFGIDLDDVYTADMSGKWWLVKRDWYHDIALPWTAPSADFWHDMDRLVEFSTPHATKQSVYTLGDQEGAMSTALGDAAVIEYMSSGSKVVFRTGFLKCRVKMENLRLKGSTYMQCSKEFSILKRPTATPYGTVIMQVKYAQTDVPCRVPVGVHERPGGEQVGRIITAHPIILKQNDALVIEVEPPFGDSVIEIGLGTTKIVEQWHRDGSSIGAAFTSTMKGVERMALLGEHAWDFGSVGGFFNSMGKAIHSVFGGLFRAVFGGMSWISKVLIGAILMWLGVSAREKTLAMSLITVGAILLYLSTMTNAVS

SEQ ID NO: 15424 - protein, 499 aa, unidentified
LQCIDVAKRDFIQGVSGGTWVDVVLDVHGCVTIAAEGKPTVDFKLTKLEMTKLAKVRAYCLTASVSDITVESGCPGTGEIHNTKAKDTSYMCKVSYPDRGWGNGCGLFGKGSMETCAKFACTKQLHGHVISRENIEAEVDISIHGQSAPDSDDASKRKNRKELATATITPQASSIEADMGDFGKVGMDCSLDIGIDFEQVLIVDTASRWWMVKRDWFQDLALPWTSPSADFWHDRDRLVEFGVPHATRQSVYSIGDQEGAFFTAVAKAPSVEWNSDKVKLATGFLKCRIKLGNMKLKGSTYVTCAQAFTFAKRPVDTGHGTVVFQVSYAGTDAPCKIPVAVTDKPNGEHVGRLVTAHPFIAKQNEKAVVEVEPPFGDSYIEIGAGTTKISEAWHKPGSSIGNALALSYKGMKRITAMGEHAWDFGSIGGFFSSMGKAVHHVFGSLFRTLFGGIGWMAKILIGALLIWLGISTRDRMLATSFILTGSILLYLATTTVGVS

SEQ ID NO: 15425 - protein, 499 aa, unidentified
MLPSMCILIGSGMLELVHLVQTSELQALNCDTRSSPALIDLEIRRLCHKTTENVVSCEVSYQNHTVEEVKATLVSCYSYRCTTYWGFFGSYSADKMTFRYTGNATTCNNQTVEEPYICNWYYCCSKAVNTICRCTNNNVTVVIKSAPPYMYCSFGDCSTVTKREIERGLAKLSDGSLLYFNSTIIPPDIVNTSINGSVLCNNKSKLVSFDKFRRSYPLRKWKYNSQSINITCSNDSNICPAKRRKRDLSQVSYALHKIRPILADAWEDCEIMQSLILGMTGSNLFSSSQFLRKWLNRTDIIGYVVGGLGVIWQCSRVNVSFLSWNESTYFPPVSYMDKIMYLNDEDRLQDSTPEAKPGLKRLLLHGSYFLGTVGSGLKPKLVSYDRSTHDYHLDEFDAIFNLTPEVDLISGHETNPINHAFGTQSGLLPYTRSTNLTSTDTGSGWVHIGLPSFTFLNPLGWVRDILSWAAWIGGILYLITLCISLPALINRKRRLGRWS

SEQ ID NO: 15426 - protein, 511 aa, unidentified
MRSRASTQSMLPSTFFLIGCGTLVLVRLHLISAPQALKCNTDSTPALIDLEIRRLCHNKTEDVVPCEVRYRNHTTTELSAVHISCYKYHCKTYWGFFGSYSADRLINRYLGSASSCINTSSEDPFKCTWHYCCSARVTEICRCSISNVTVAVKSFPPFMYCSFSDCSTVSESELRLGRANLSDGSYLLFDQYNISSDIINGTFNGTILCNSTSKVVSFDEFRRSYPLKNWTYTSETLNVTCNGTYFSNCSGKTRKKRDTPQIEYLVHKLRPTLRDAWEDCEILQSLLLGVFANGMASSSRFLREWLNHSDIVGYVVNGIGVVWQCNRVNITFLPWNESTYYPPVKAESKLYYLNEEGRLQTSTPEARPGLKRIFFHERFYLGTVGSGLRPKRVKYNRSSHDYHLNEFEWSLNVTPVVNIIVGHETNPINHAYGTQSDLLPYTRSTNLTSTDTGSGWVHIGLPSFAFINPLGWIRDILSWAAWLGGILYLITLCISLPALFMRRRRLGRWRE

SEQ ID NO: 15427 - protein, 430 aa, unidentified; identical to SEQ ID NO: 8534

SEQ ID NO: 15428 - protein, 310 aa, unidentified; identical to SEQ ID NO: 10377

SEQ ID NO: 15429 - protein, 229 aa, unidentified; identical to SEQ ID NO: 8171

SEQ ID NO: 15430 - protein, 499 aa, unidentified
SQCSGIDKRDFIQGVSGGTWVDVVLDRKGCVTISATGKPTIDVRMVKMEASNLASVRTYCLEASTSEISSVNGCPSTTEAHNDKRKDSTYLCERSYPDRGWGNGCGLFGRGSLDTCVKFACSKKMAGHAISRENIVITAAVSVHGHSGAESDDDSQRKSRKELAELTITPKSSIVEADLGDYGKVQFECLMDFGIDLDDVYTADMSGKWWLVKRDWYHDIALPWTAPSADFWHDMDRLVEFSTPHATKQSVYTLGDQEGAMSTALGDAAVIEYMSSGSKVVFRTGFLKCRVKMENLRLKGSTYMQCSKEFSILKRPTATPYGTVIMQVKYAQTDVPCRVPVGVHERPGGEQVGRIITAHPIILKQNDALVIEVEPPFGDSVIEIGLGTTKIVEQWHRDGSSIGAAFTSTMKGVERMALLGEHAWDFGSVGGFFNSMGKAIHSVFGGLFRAVFGGMSWISKVLIGAILMWLGVSAREKTLAMSLITVGAILLYLSTMTNA

SEQ ID NO: 15431 - protein, 423 aa, unidentified
MSRNLSVVVLLVLAIGTSATITELLSLAASDNSSICHGLQFIEPTQSFLGITPNDTWPLFEFSIRAADGPPSPGRTLTMSHEMKLFGNEAVNYTIRTSVVRYENISYNLAIGSCRAQGFTACVQISVMKGRQVLHNRKVGFTSHELNRTHHQSSDKNFKSRGYKICISCKDFKRIKLVVYNKLNKTAALIMCPTELIFNDNFVMNSSAAKDYVTEDIANTSNYVCIALHNRNLLTHHSLALTSGSKVDNTIEPGCDSNVGLFGHSTGTDYGWGLGQLLQCWNNQLFTDIPTEHVTDAIACKIAKTPNYTTTALFLLNKEQGEIRDHVIEHEMALNYLLAHQGGLCGVFKGPLCCSDIDDFKRNVSDMIDKVHEEMKKFFHEPDPFGGLGTLGFYGSLLGHVIQWIPIIILVVLACFVCSWMKR

SEQ ID NO: 15432 - protein, 420 aa, unidentified; identical to SEQ ID NO: 9042

SEQ ID NO: 15433 - protein, 427 aa, unidentified
MAGWTQLPLFSILLLMVPQLTLGTIGEMLSLAASGNSSICHGMQFTEPTQSFMGILPNESRPMFIFSIMHSETVPKVGKTLKISHDMKLFGEEALNYMIFVNRIVFEPMKYHNISGSCRQQGFKACVRVYSDLVNNSRGFPSVKLGFTANELNKTHRANPNNMGFKICISCRDHNGVRLVVYSKINRTAQLMMCPNELIYGFDFTVNSTSTKTDEETVLPLLNVTGYSCVALHNKNMLTHHNLALSSGSKVDNTLEPGCDSNVGLFGHSTGTDYGWGLANFFSAGITNSLQISQLEHVTDAIACKIAKTSNYTTTALFLLNKEEGEIRDHVIEHEIALNYLLAHQGGLCNIVKGPMCCSDIDDFRRNVSDMIDRVHEEMKKFYHEPDPFGGLGTWGFYGTMFGHILQWIPIMIMVIIVCFVCNWVRR

SEQ ID NO: 15434 - protein, 497 aa, unidentified
MGQIVTFFQEVPHVIEEVMNVVLITLSILAILKGLYNLLTCGIGNLIIFLLLAGRSCEATDGSLYKGEFRLQNITWNSASLNETMPLSCSKNNSHHYIYLKNETGLEVTLTNTSILNHKFCNLSDAHKKALYDHSLMVIVTQFHLTIPNFGQWEAMSCDFNGGNITIQYNLSHSTAVKAANHCGTLANGILETFFKMFWGRDISNAFQIPDNGVLRNCFKTSYKYLIIQNTSWADHCVMSVPHPIGPISVLNSQVRSIYLSRRLKGTFSWSLSDSEGNSMPGGYCLEKWMLIAAEMKCFGNTAIAKCNLNHDSEFCDMLRLFDYNKQAIERLKGELEQTLNTFRKAVNALINDQLIMRNHLKDLMGIPYCNYTKFWYLNSTKTGVVSLPKCWLVSNGSYLNVTHFSNDIEQEADNMITEMLRKEYIERQGKTPLGLVDIFLFTTSFYLVTVFLHLVKFPTHRHIVGQGCPKPHRLTSMAICSCGVYGQPGLPVKWKR

SEQ ID NO: 15435 - protein, 496 aa, unidentified; identical to SEQ ID NO: 8708

SEQ ID NO: 15436 - protein, 496 aa, unidentified; identical to SEQ ID NO: 8708

SEQ ID NO: 15437 - protein, 286 aa, unidentified
GVEGIPLFYLGYHLEKMAEKAGILYADDTAGWDTRITMADLEDEYTLTELMEGEHKKLAETLFNFAYKNKVALCPRPGKNGGTVLDVISRTDQRGSGQVVTYALNTLTNIKVQLIRMAESEGVLDEEFHDNGMLKWLEKHGRDRLQRLMVSGDDCVVNAIDERFGKSLVWLNEMQKIRKDIDLWKPSAGHCNWEEVEFCSNHFHKLVMRDGRTLVVPCRHEVELVGRASVNQGGSTGISGTACLAKAYAQMWLLLYFHRRDLRILGMAICSAVPANWVPTGRTTWS

SEQ ID NO: 15438 - protein, 285 aa, unidentified; identical to SEQ ID NO: 8156

SEQ ID NO: 15439 - protein, 574 aa, unidentified
  VARIANT 462: note = Any amino acid
  VARIANT 463: note = Any amino acid
  VARIANT 464: note = Any amino acid
  VARIANT 465: note = Any amino acid
  VARIANT 466: note = Any amino acid
MQDSHGNTQILNQANSMVKRTWRLLFGIATLILLVSIFVLSLIIVLQSTPGNLQNDINIIRKELNELMENFETTSKSLLSVSNQITYDVSVLTPIRQEAIETNIISKIKDHCKDRVIKEGSTCTLNGSPLHDVSFLNGFNKFYFTYKDNMQIKFKSLLDYPNFIPTATTPHGCIRIPSFSLGQTHWCYTHNINLLGCADPASSNQYVSLGTLQVLKMGDPYFKVEHSHYLNDGRNRKGCSVVAVPDGCLRNCVTMTKNETENFKDLNWQHNYLHTYHIMVPLKTRIINPPGSSRDWVHIAPGVGSGLLYAKLLIFPLYGGLTEKSVIHNNQSGKYFFPNSTKLQCRNSTMEKIKGAKDSYTITYFSGRLIQSAFLVCDLRQFLSEDCEILIPSNDYMMVGAEGRLYNIENNIFYYQRGSSWWPYPSLYRIRLNLSKKYPRITEIKFTKIEIAPRPGNKDCPXXXXXPKECITGVYQDILPLSYPNTAFPHLKQAYYTGFYLNNSLERRNPTFYTADNLDYHQQERLGKFNLTAGYSTTTCFKQTTTARLYCLYIIEVGDSVIGDFQITLFLAAQ

SEQ ID NO: 15440 - protein, 430 aa, unidentified; identical to SEQ ID NO: 8534

SEQ ID NO: 15441 - protein, 526 aa, unidentified
MPLQAIPLFSLILPVLVAGKFPIYTIPDKIGPWSPIDINHLSCPNNLVVEDEGCTTLTAFSYMELKVGYITTIKVSGFTCTGVVTEAETYTNFVGYVTTTFRRKHFRPTASACREAYNWKATGDPRYEESLHNPYPDSHWLRTVKTTKESLLIISPSVADMDAYDKALYSKIFPNGKCLGVSLSSPFCSTNHDYTLWMPENPKPGVSCDIFTTSKGKKATKDGKLCGFVDERGLYKSLKGACKLKLCGVMGLRLMDGSWVSLQKTEESEWCSPNQLINIHDFHSDEIEHMVVEELVKKREECLDALESIMTTKSISFRRLSHLRKLVPGFGKAYTLINKTLMEADAHYKSVREWTEVIPSKGCLKAGGGCYPHYNRVFFNGIILSPDGHVLIPEMQSALLQQHIELLESSVIPLRHPLADPSTVFKGDDEAEEFVEVHLPDTQKQISGIDLGLPEWKRYFLMGMSAIGFLALTIILAVCCRRIKRRKQSKPNPVELIRKVSVTSQSGRAIPSWESYKVKTGDQPQV

SEQ ID NO: 15442 - protein, 533 aa, unidentified
MPLNAVIFTLLLRCSICLGKFPIYTIPDKLGPWSPIDIHHLSCPNNLVVEDEGCTTLTPFSYMELKVGYITSIKVSGFTCTGVVTEAETYTNFVGYVTTTFRRRHFRPSVNSCRDAYNWKIAGDPRYEESLHNPYPDSHWLRTVKTTKESLLIISPSVADMDAYDKKLYSKMFPNGRCSEISPGSPFCPTNHEYTIWMPESSNPGISCDIFTRSMGKKATKDGQLCGFVDERGLYKSLKGACRLRLCGISGLRLMDGSWVSLPQVNNSEWCSPDQLVNIHDFHSDEIEHLVADELVKKREDCLDALETIIFTKSISFRRLSHLRKLVPGFGKAYTIINRTLMEAEAHYKSVREWKEIIPSKGCLKAGGRCYPHHNGIFFNGIILGPGGEILIPEMQSALLQQHIELLESSVVPLKHPLADPSTVFKNDDEAESFVDVHLPDTNQKISGIDLGLPEWKRYFLIGVSAVALLALSIIIAVCCKRFRKRRKSKPSPVELTRKVSVISKGNGPVPSWESYKEGTTGDVRNTTPSTRE

SEQ ID NO: 15443 - protein, 569 aa, unidentified
MQSDMEGSRDNLTVDDELKTTWRLAYRVVSLLLMVSALIISIVILTRDNSQSIITAINQSYDADSKWQTGIEGKITSIMTDTLDTRNAALLHIPLQLNTLEANLLSALGGNTGIGPGDLEHCRYPVHDSAYLHGVNRLLINQTADYTAEGPLDHVNFIPAPVTTTGCTRIPSFSVSSSIWCYTHNVIETGFNDHSGSNQYISMGVIKRAGNGLPYFSTVVSKYLTDGLNRKSCSVAAGSGHCYLLCSLVSEPEPDDYVSPDPTPMRLGVLTWDGSYTEQVVPERIFKNIWSANYPGVGSGAIVGNKVLFPFYGGVRNGSTPEVMNRGRYYYIQDPNDYCPDPLQDQILRAEQSYYPTRFGRRMVMQGVLACPVSNNSTIASQCQSYYFNNSLGFIGAESRIYYLNGNLYLYQRSSSWWPHPQIYLLDPRIASPGTQNIDSGINLKMLNVTVITRPSSGFCNSQSRCPNDCLFGVYSDVWPLSLTSDSIFAFTMYLQGKTTRIDPAWALFSNHAIGHEARLFNKEVSAAYSTTTCFSDTIQNQVYCLSILEVRSELLGPFKIVPFLYRVL

SEQ ID NO: 15444 - protein, 501 aa, unidentified; identical to SEQ ID NO: 8222

SEQ ID NO: 15445 - protein, 495 aa, unidentified
MGQIVTLFESLPHIIDEVINIVIMVLILITAIKAVYNLCTCGLFALIMFLFMAGRSCSLEGPGMYKGTYQFKSVELNMSQFNQTLPNACSVNNSHHYIGMGDSGLELTFTNDSIIDHNQCNLTDYFKKSHFDHVLSSIITHLHLSVRGHSYYKAVSCDFNNGITIQYNLSINTPQKAVDNCRSFRGRVLDMFRTAFGGKHMRAGFGMTDANGKATWCSQTDYNYLIIQNRTWDNHCEYANPMGFARLLFAQEKTKFLTRRLMGTFTWTLSDSSGVESSSGYCLTRWMIIAADLKCFGNTAVAKCNLNHDEEFCDMLKLIDYNKAALTKFKKDVESALHLFKVTMNSLISDTLLMRNHLRDLMGIPYCNYSKFWYLEHYKTGETSLPKCWLVSNGSYLNETHFSDEIEQEANNMITEMLRKDYYKRQGSTPLALMDILMFSTSAYLISVFLHLLRIPTHRHVKGGTCPKPHRLNSKGICSCGAFKVPGVKVIWKRN

SEQ ID NO: 15446 - protein, 248 aa, unidentified; identical to SEQ ID NO: 8593

SEQ ID NO: 15447 - protein, 420 aa, unidentified; identical to SEQ ID NO: 8396

SEQ ID NO: 15448 - protein, 426 aa, unidentified
HTAQSPLYLVLLSVMFHPTFGTIGEMLSLAASSNSSICHGMQFTEPTESFMGILPNETQPMFKFSIMHSEAVPKVGKTLKISHDMKLFGEEAINYMIFINKIVFEPVSYYNITGTCRQQGLQACVRVYSDLVNGSKGFPSQKLGFTANELNKTKNSNSHNLGFKICLSCKDHNGIRLVVYNKVNRTAQLMMCPKELIFSQDFTINSTSNVKGDEETAVPLLNVTGYYCIALHNKNMLTHHSLALSSGSKVDNTLEPGCDSNVGLFGHSTGTDYGWGLANFFSAGITNSLQISQLEHVTDAIACKIAKTSNYTTTALFLLNKEEGEIRDHVIEHEVALNYLLAHQGGLCNVVKGPMCCSDIDDFRKNVSDMIDKVHEEMKKFYHEPDPFGGLGTWGFYGTIFGHIFQWIPIVIMVIIVCFICSWIKK

SEQ ID NO: 15449 - protein, 427 aa, unidentified
MMSHIRLVLCSALLSMMSCPTSGTIGEMLSLAASSNSSICHGMQFTEPTESFMGILPNETLPMFIFSIMHSEAVPKVGKTLRISHDMKLFGGEAVNYMIFVNKILYEPISYYNYTGSCRQQGLSSCVRVYSDLVNGSKGNPSVKLGFTAIELNKTKNTDFHNLGFKICFSCRDHNGIRLVVYNKNNRTAQLMMCPSELIFSQDFTINSTSVNPSEEAAVPLLNVTGYTCIALHNKNMLTHHSPALSSGSKVDNTLEPGCDSNVGLFGHSTGTDYGWGLANFFSAGITNSLQISQLEHVTDAIACKIAKTSNYTTTALFLLNKEEGEIRDHVIEHEVALNYLLAHQGGLCSVVKGPMCCSDIDDFRRNVSDMIDKVHEEMKKFYHEPDPFGGLGTWGFYGTIFGHVLQWIPIIIMVVVVCFVCSWVRK

SEQ ID NO: 15450 - protein, 560 aa, unidentified
MVSFSGFVTIAIAMLLIGLEVSVSDSSSDTFLNSSVGPIAVCGKKSLNIETTLSECFERCRRMPQPTSTAKIGLHQVTAKGLGPRVVECKKVTITQQFVETWTFSTWKSTPTREYSLPSEEECKTVISKKCGTLECDIREPTSLTEDYLYASTNFKKETYISLITMPSSFFTSGVELMIMPLASEDQFSVTRESGESTTARYYWKKVDPLTECPFERVGQQYRCDYFEIDKNDKHWLCNRGGFSLTPKSEIETVIPVCKGLVQSKEGMIYEILDKSDKLSIWSQRLSSVGTTYKDADTDWLKEKINHMMSSMDSDLCILQCQILSLEARMYQSSSRVLKIAANIILLRPDGTGEKCETAHGCKLSTPHLMCGDPPRVAITCTGTSAYWDPKEPYALMDGHCSKPGKNEKLTFSARHHTYVIDDDLKSLLPSGFMHRKTHDLFSIDHLKGLQFKQEDIDEIRTSWNAHKTSESSAELTDSSVDKDHCGIMIDIITGSKKLLSGVVDYFSYIKYLVYVIVGLIVAGMSIKLMMLFVPSKRVKEPGMRYASVRQATEPTIEWI

SEQ ID NO: 15451 - protein, 293 aa, unidentified; identical to SEQ ID NO: 8158

SEQ ID NO: 15452 - protein, 499 aa, unidentified; identical to SEQ ID NO: 15424

SEQ ID NO: 15453 - protein, 657 aa, unidentified
MAPINYPASYYTNNAERPVVITTKSTESKGQRPLPLGNARFWEYFGHVCGTLTFCMSLIGIIVGIIALANYSSDKDWKGRIGGDIQVTRMATEKTVKLILEDTTPKLRNILDSVLFQLPKMLASIASKINTQTPPPPTTSGHSTALATQCSSNCENRPEIGYDYLRQVEQSLQRITNISIQLLEASEIHSMAGAYPNALYKIRTQDSWSVTAKECPLQAFQPNLNLIPAMIGTATGALIRNCVRQPVIVVDDGVYMLTYLAMRGSCQDHQKSVRHFEMGVITSDPFGDPVPTPLRHWTKRALPAYDGCALAVKGHAGFALCTETSVGPLRDRTAKRKPNIVLFKASLVGELSERVIPPQSWLSGFSFFSVYTVAGKGYAYHSKFHAFGNVVRVGQSEYQAKCRGTGCPTANQDDCNTAQRVSQEDNTYLHQAILSVDIDSVIDPEDVVYVIERDQYYQASAGDLYRVPETGEILYNLHNGGWSNEVQVGRIQPSDRFYMREIQLTSTRVPAPNGCNRVKGCPGGCVAVISPAFTPMHPEFNVGVGIFPMNQPHNPSIMHVQQQTELFWKPIVGGNITLHESSIACYSTVPPNPSYDLCIGVMTLLLHQGQLPQFQALSWYQPTMCNGNAPQNRRALIPVIVEDSKAMSVSSDAPRTP

SEQ ID NO: 15454 - protein, 501 aa, unidentified
SQCSGIDKRDFIQGVSGGTWVDVVLDRKGCVTISATGKPTIDVRMVKMEASNLASVRTYCLEASTSEISSVNGCPSTTEAHNDKRKDSTYLCERSYPDRGWGNGCGLFGRGSLDTCVKFACSKKMAGHAISRENIVITAAVSVHGHSGAESDDDSQRKSRKELAELTITPKSSIVEADLGDYGKVQFECLMDFGIDLDDVYTADMSGKWWLVKRDWYHDIALPWTAPSADFWHDMDRLVEFSTPHATKQSVYTLGDQEGAMSTALGDAAVIEYMSSGSKVVFRTGFLKCRVKMENLRLKGSTYMQCSKEFSILKRPTATPYGTVIMQVKYAQTDVPCRVPVGVHERPGGEQVGRIITAHPIILKQNDALVIEVEPPFGDSVIEIGLGTTKIVEQWHRDGSSIGAAFTSTMKGVERMALLGEHAWDFGSVGGFFNSMGKAIHSVFGGLFRAVFGGMSWISKVLIGAILMWLGVSAREKTLAMSLITVGAILLYLSTMTNAVS

SEQ ID NO: 15455 - protein, 412 aa, unidentified
YKLARPYIADCSNCGHGRCDSPIAIEDIRGDAHAGYIRIQTSAMFGLKSDGVDLAYMSFMNGKTLKAIKIEHLYARTSAPCSLVSYHGYYILAQCPPGDTVTVGFQDGANKHMCTIAHKVEFKPVGREKYRHPPEHGVELPCTKYTHKRADQGHYVEMHQPGLVADHSLLSMSSTKVKITVPSGSQVKYYCKCPDVKEGTTGSDYTTACTNLKQCRAYLIDNKKWVYNSGKLPRGEGETFKGKLHVPFVPVTSKCTATLAPEPLVEHKHRSLILHLHPEHPTLLTTRALGSNARPTRQWIEQPTTVNFTVTGEGFEYTWGNHPPKRVWAQESGEGNPHGWPHEIVIYYYNRYPMTTVIGLCTCVAIIMVSCVTSVWLLCRTRNLCITPYRLAPNAQVPILLAVLCCVKPTRA

SEQ ID NO: 15456 - protein, 416 aa, unidentified; identical to SEQ ID NO: 8502

SEQ ID NO: 15457 - protein, 423 aa, unidentified
SITDDFTLTSPYLGHCPYCLHATPCFSPIKIENVWDESDDGTIRIQVSAQLGYNQAGTADPTKFRYMSYEQDHDIKEASMDKIAISTSGPCSRLGHKGYFLLARCPPGDSVTVSITSGASATSCTVEKKIRRKFVGREEYLLPPVHGKLIKCHVYDHLKETTAGYITMHRPGPHAYATYVEESSGEVYIRPPSGKNVTYECKCGDYSTGTVNTRTKMPGCTKKKQCIAYKSDQTKWVFNSPDLIRHSDHAVQGKLHIPFKLTATACPVPLAHTPTVEKWFKGVTLHLTASHPTLLTTRKLGPRAEPTSEWIVGTVSRNFSVGREGLEYTWGNHDPVRVWSQESAPGDPHGWPHEIIVHYYHRHPLYTIAVLCGLVLITVIGIASAAACISKARRDCLTPYALAPNAAVPTLLAVLCCIRPTHA

SEQ ID NO: 15458 - protein, 417 aa, unidentified
THFTQYKLARPYIADCSNCGHGRCDSPIAIEDIRGDAHAGYIRIQTSAMFGLKSDGVDLAYMSFMNGKTLKAIKIEHLYARTSAPCSLVSYHGYYILAQCPPGDTVTVGFQDGANKHMCTIAHKVEFKPVGREKYRHPPEHGVELPCTKYTHKRADQGHYVEMHQPGLVADHSLLSMSSTKVKITVPSGSQVKYYCKCPDVKEGTTGSDYTTACTNLKQCRAYLIDNKKWVYNSGKLPRGEGETFKGKLHVPFVPVTSKCTATLAPEPLVEHKHRSLILHLHPEHPTLLTTRALGSNARPTRQWIEQPTTVNFTVTGEGFEYTWGNHPPKRVWAQESGEGNPHGWPHEIVIYYYNRYPMTTVIGLCTCVAIIMVSCVTSVWLLCRTRNLCITPYRLAPNAQVPILLAVLCCVKPTRA

SEQ ID NO: 15459 - protein, 491 aa, unidentified
MGQIITFFQEVPHIIEEVMNIVLITLSLLAILKGLYNISTCGLFGLITFLFLCGRSCSTMYKDNYRLDSVDLDMSVLNFTMPLSCSKNNTHHYIQTFNDSGLELTLTNDSLLKHKFCNLSDAHKKGLYDQTLMSIVTTFHLNIPNFNQYEAMACDFNGGKITVQYNLSHQTPIGAANHCGTVANGVLDTFRRMHWGPAQFPNPPFTISGTTCVQSSYSYLIIQNTTWEDHCQMSRPTPIGYLSLIAQRTRQLYISRRLMGTFTWTLSDSAGNDLPGGYCLQRWMLFADELKCFGNTAVAKCNQQHDEEFCDMLRLFDFNKEAISRLRVEAEKSINLINKAVNSLINDQLIIKNHLRDLMGIPYCNYSKFWYLNDTRNGKTSLPKCWKVSNNSYLNETQFSNEITEEANNMITEMLRKEYEKRQSTTPIGLVDLFVFSTSFYLISVFLHLIKIPTHRHVVGKGCPKPHRLNHMAICSCGLYCQPGIPVKWKR

SEQ ID NO: 15460 - protein, 415 aa, unidentified
MVPTYPYSSLLDWRPPPNTLPWILNLVVFYTIAWLPGGVSGIPLGLLGNNSITQTVVDNVVCKEHLATTDQLQAIGLGLEGLGEHADLPTATKRWGFRSDVIPKIVGYTAGEWVENCYNLEITKKDGHPCLPSPPTGLLGYPRCRYVHRAKGAGPCPGGNAFHKYGSFFLYHGMASTVIYHGVTFTEGTIAFLIVPKDAPRLKAGLGTGFSHQAENQNPNNQFRTTTLDYDVMSPWMDNATFFFRAREDTSMLIQTRYPPANLELVQERLANLTGDQADPSKMEEIVAEVLTLELGDWSGWTTKKTAVQTIRLRNPSPASGSTKDKTGQKPMTDHQEFILQPHSAVGQPCLWNILRTPGRNPARRHRRETPPTMSITAAPGSGYKPYIQAIPLVKFRCHWEGLRHVCRRYPSWVQ

SEQ ID NO: 15461 - protein, 607 aa, unidentified
MFSLLNVTVFLACLTAIFAEFIPNTGTQGTVVNPPDGTTPPSAPTLPTPPPPRYDPGLAAYKETHSDTMYDVNPVYQCNQTGIGYSVSEWYGICKDQCSSSTKRSIWNISLFDYQNFVASIPVFATTILSVTKTSHVSFFGTCLAYVSDERAIDMNYTDFISHIPRLLNSTSLRPGDTSIVDDTSSADCSYWSDNTRVGNIFTMDTDVWSLTITITGDLLIKNPYSLSYTPYNESAVFFNGKWFFWDSRDTHSAPECALSPAGDDSCSLNANLGILSCERSGIIINLNGLRSLDNTCVGSVNISSNNVPFRISSSLQHDPVRSKLYDLMSSTSPSYTGITALLETIGDTIDTLESTYCSALCDLSDRSFQTIVDDEDVVDTPNGPWLPVQDQEIIRLVPCGADINWLIYIPLTVCVGSNLVKISRLGSSDAHWWDPQKTYYDPQESCDHESVNNYDSLTRRRQNISIVFWRGTAVLSYPYTGPIIWIPRGNPNSIRSSKWFPQIKNISDKASLTMSTLSATITQSIGRSINTSRDDSYIDYSTNQISFLAGKIWTDICIAASSVWNFATGTLKYGTAIIMALVATYIGGTLFRILTAPRRSSSWADM

SEQ ID NO: 15462 - protein, 501 aa, unidentified; identical to SEQ ID NO: 8222

SEQ ID NO: 15463 - protein, 374 aa, unidentified
PDPRMAAALCILLCLSPASAACISTTTVAIPTTQCTLLNGNYTCQTSLNANINLLHLGDTACFRFTNQQGDTIGTLNVLYDLSLYVAPLSPIYYTSDWLGLSCSHKSCRNDHPCSLSDGCPSDSTLLNSVLTPQCVVYPGRTKCESSCGCAGCGCFFCSDACLISRAAFQPVGLPYQVKTIGSVSVYPRLTVEYNFNGTTVSSTSDLFNPLSTPDFTLNLVGSYQAATTSISLGAAAFSSDGASALYYSYSDYNNPQFGVIGDVQSSLINGFSNPPYNFIFPDSSISQITSSSSVDYQFPQSGISRARQTPFPLLKDGIIYTADSERLYGLNPNAPAITVAMSSSHTSFSLVSETVCPKYVSHSISGCYNCPQG

SEQ ID NO: 15464 - protein, 382 aa, unidentified
KNFTKTLSSEELSVIFVPRAQDPGSNQKTKVTPTSFANNQTSKNHEDLVPEDPASVVQVRDLQRENTVPTPPPDTVPTTLIPDTMEEQTTSHYEPPNISRNHQERNNTAHPETLANNPPDNTTPSTPPQDGERTSSHTTPSPRPVPTSTIHPTTRETHIPTTMTTSHDTDSNRPNPIDISESTEPGPLTNTTRGAANLLTGSRRTRREITLRTQAKCNPNLHYWTTQDEGAAIGLAWIPYFGPAAEGIYTEGIMHNQNGLICGLRQLANETTQALQLFLRATTELRTFSILNRKAIDFLLQRWGGTCHILGPDCCIEPHDWTKNITDKIDQIIHDFIDKPLPDQTDNDNWWTGWRQWVPAGIGITGVIIAVIALLCICKFLL

SEQ ID NO: 15465 - protein, 423 aa, unidentified; identical to SEQ ID NO: 9151

SEQ ID NO: 15466 - protein, 489 aa, unidentified
MGQIVTFFQEVPHILEEVMNIVLMTLSILAILKGIYNVMTCGIIGLITFLFLCGRSCSSIYKDNYEFFSFDLDMSSLNATMPLSCSKNNSHHYIQVGNETGLELTLTNTSIIDHKFCNLSDAHRRNLYDKALMSILTTFHLSIPDFNQHEAMSCDFNGGKISVQYNLSHSNYVDAGNHCGTIANGIMDVFRRMYWSTSLSVASDISGTQCIQTDYKYLIIQNTSWEDHCMFSRPSPMGFLSLLSQRTRNFYISRRLLGLFTWTLSDSEGNDMPGGYCLTRSMLIGLDLKCFGNTAIAKCNQAHDEEFCDMLRLFDFNKQAISKLRSEVQQSINLINKAVNALINDQLVMRNHLRDLMGIPYCNYSKFWYLNDTRTGRTSLPKCWLVTNGSYLNETQFSTEIEQEANNMFTDMLRKEYEKRQSTTPLGLVDLFVFSTSFYLISVFLHLIKIPTHRHIKGKPCPKPHRLNHMAICSCGFYKQPGLPTQWKR

SEQ ID NO: 15467 - protein, 430 aa, unidentified
SIEPLYTISATGTSLTHARLLSNEIYSISTERGLIHLDIHNVTVRGERPFKTLLTKCDVVESFSEDTCPGGSHLDMARIRRHNRTCKVDSFNRGWGTGCFEWGLGQVATCVEVSCASHTNVSVLVDSIIQAKVSMEIHGHQDTQSIVRDVPTQFQFGDVGTITLTCGVTTDRIAGHYYHIREGVKAGLVLREAVDSWPGMIKMGGFTSGMDKIVRWGITTANEIKIDGLINPQIDWQTSVLRDIRSISFTCEMIFDNISFSSLPLCAANASGTFIQNGYGQDGVVAVSLEEVMEQACSFPLKCKGCTLTCPSLVIAEKSQVGRAHVICGNGTSHVEFGTTVVPVECLVTPVTQAWRLLSHVTGRYTKTGVTGLGSVWEDLLGNLRFSWSWFPSSWLVMAFIGLALFLVFGRVGSFVVFVVIIAVYVRSVS

SEQ ID NO: 15468 - protein, 285 aa, unidentified; identical to SEQ ID NO: 8156

SEQ ID NO: 15469 - protein, 248 aa, unidentified; identical to SEQ ID NO: 8593

SEQ ID NO: 15470 - protein, 454 aa, unidentified
MGQIVAVFQAIPEILNEAINIVIIVIIMFTLIKGVFNLYKSGLFQLVIFLLLCGKRCDSSLLSGFNLETVHFNMSLLSSIPMVSEQQHCIQHNHSSITFSLLTNKSDLEKCNFTRLQAVDRVIFDLFREFHHRVGDFPVTSDLKCSHNTSYRVIEYEVTKESLPRLQEAVSTLFPDLHLSEDRFLQIQAHDDKNCTGLHPLNYLRLLKENSETHYKVRKLMKLFQWSLSDETGSPLPGGHCLERWLIFASDIKCFDNAAIAKCNKEHDEEFCDMLRLFDYNKASIAKLRGEASSSINLLSGRINAIISDTLLMRSSLKRLMGIPYCNYTKFWYLNHTKLGIHSLPRCWLVSNGSYLNETKFTHDMEDEADKLLTEMLKKEYVRRQEKTPITLMDILMFSVSFYMFSVTLCICNIPTHRHITGLPCPKPHRLRKNGTCACGFFKSINRSTGWAKH

SEQ ID NO: 15471 - protein, 500 aa, unidentified; identical to SEQ ID NO: 15213

SEQ ID NO: 15472 - protein, 430 aa, unidentified; identical to SEQ ID NO: 8534

SEQ ID NO: 15473 - protein, 423 aa, unidentified; identical to SEQ ID NO: 15457

SEQ ID NO: 15474 - protein, 504 aa, unidentified; identical to SEQ ID NO: 8334

SEQ ID NO: 15475 - protein, 505 aa, unidentified; identical to SEQ ID NO: 15354

SEQ ID NO: 15476 - protein, 501 aa, unidentified; identical to SEQ ID NO: 8222

SEQ ID NO: 15477 - protein, 548 aa, unidentified
MTFSSVIRIVITLCVLYDQLFLALSDFNHSVGPIAICTLEMEDARAYAESCYRRCTRDKEPDHHGSVYLYSESSYRGGPIVTRCNKVRVEQIFTETWTLSTVQSEITRTLLDITEAECQNAIRDKCPTKNCNVKAPADLPPEYHYASDTKVSQDHISVPSGIDYLEETIRVTPALGSESYPVADGRAISGKYIYLWDPDFDAQTCPFMSVQQLGCDWYEKPKDLISCRRSRFVIPDISNSVQLKGACSGISRSSSGLLYKWEDKSASPNRGAKRLALTPTANSDEHVASLRLQVSDAIEVLGEDICQTQCEILDMMLRGDRNKEVLTRIGGSYMVLSKTGYLRKCHPAIGCQLVKPHQFCGNPNRVAVSCQGKIYMWNPKKGYLEDSTECERHRVDSKLVFTVGAHEYSIDDGLRVELPDKEHFGVAHDLVSRATDNISTEIVNPELLRQSWMEHINREASLSLVPLLKDRNVTQWEPDITFGFGFLKSAARIFTDIMTRITLWITVLLTLVAIVLGTKAWRNIRANKTVRTQQHHLVPTTDTQVTWM

SEQ ID NO: 15478 - protein, 507 aa, unidentified
MGQLVTLFQSIPEIIEEAVNIALIAVAIMCIVKGTVNLWKCGIVQLCIFLLLAGKRCDGFQIDRRHKLESVEFNLTRMFNNLPMSCSKNNTHHYYKGPEGTNWGIELTLTNESVANYSNMSAIRSLAYGNITNCDKTNEAGHTLKWLLNELHFNVLHVTRHIGARCLTTDSAGILIQYNLTVGDYGGEVGRHLIASLAQIIGDDKAAWVGKCFNNCSANGTCRLTNCEGYTHYNYLIIQNTTWENHCSYSPMSTIRMALNKVAYSSVSRKLLGFFTWDISDSSGRHVPGGYCLEQWALVWAGIKCFDNSVMAKCNKDHNEEFCDTMRLFDFNQNAIKTLQLNTENSINLLKRSINGLISDSLVIRNSLKQLARIPYCNYTKFWYVNDTITKRHSLPQCWLTYNGSYLNETHFRNDWLLESQQLYNDMLVKEYEERQGKTPIALTDICFWSLVYFTVSVFLQLVGIPSHRHIVGQGCPKPHRISRNGLCSCGYYNIPMKPVRWVRKGK

SEQ ID NO: 15479 - protein, 507 aa, unidentified
MGQVVTFLQSLPEVINEAINIALIAISIICILKGLVNFWKCGVVQLAIFLCLAGRKCDGLMIDRRHELSHVELNLTRMFDNLPQSCSKNNTHHYYKGPKGTTWGIELTLTNTSLDSYANMSRIRSLAFGNITNCDKTGEAGHTLKWLLNELHFNVLHVTRHVGARCRVSEGAGLLIQYNLTIGDHGGEVGRHLIASLAQIIGDNKAAWVGKCDSHCTMDGKCNYTNCEGFTHYNYLIIQNTTWENHCSYSPMSTIRMALNKVAYSSVSRQLLGFFTWDISDSSGAHVPGGYCLEQWAIVWAGIKCFDNAVMAKCNKDHNVEFCDTMRLFDFNQNAIKTLQLNVENSVNLLKRSINGLISDSLVIRNSLKQLAKIPYCNYTKFWYVNDTITGKHSLPQCWLMRNGSYLNETHFKNEWLWESQNLYNEMLLKEYEDRQGKTPIALTDICFWSLVFFTSTVFLQLVGIPTHRHLVGEGCPKPHRITSNSLCACGYYKIPKRPTRWVRKGK

SEQ ID NO: 15480 - protein, 485 aa, unidentified
MGQLISFFGEIPTILQEALNIALIAVSIIATIKGVVNVWKSGLIQLLMFVMLAGRSCSVQIGHHLELEHIILNSSSILPFTPTLCKLNKTYFLVRGPFQAHWGVDLAIGSTTVAVENATKTYTLKSKNFTGCFEGNPDPDSAALLVTWLFNSLHHDYKNDPSILCERVSGENSFRFQINISEPEYCEKILSRMANLFGSFENYCLNNRHIKKLIIIRNLTWSQQCHENHMSAMQLITSNIHTQVVRARRILSFFTWSLSDAVGNDMPGGYCLEKWMLIASQLKCFGNTAVAKCNLNHDSEFCDMLRLFDFNRKAIETLQNKTRSQLNIAINAINSLISDNLLMKNRVKELMDIPFCNYTKFWYVNHTKLNHHSLPRCWLVKNGSYLNESEFRNDWLLESDHLISEILSREYEERQGRTPLSLVDVCFWSTLFYTASIFLHLIRIPTHRHIVGEGCPKPHRLRADSTCACGLYKQKRRPLKWVRSN

SEQ ID NO: 15481 - protein, 481 aa, unidentified
MGQLISFFGEIPTILQEALNIALIAVSIIATIKGVVNVWKSGLIQLLMFVMLAGRSCSVQIGHHLELEHIILNSSSILPFTPTLCKLNKTYFLVRGPFQAHWGVDLAIGSTTVAVENATKTYTLKSKNFTGCFEGNPDPDSAALLVTWLFNSLHHDYKNDPSILCERVSGENSFRFQINISEPEYCEKILSRMANLFGSFENYCLNNRHIKKLIIIRNLTWSQQCHENHMSAMQLITSNIHTQVVRARRILSFFTWSLSDAVGNDMPGGYCLEKWMLIASQLKCFGNTAVAKCNLNHDSEFCDMLRLFDFNRKAIETLQNKTRSQLNIAINAINSLISDNLLMKNRVKELMDIPFCNYTKFWYVNHTKLNHHSLPRCWLVKNGSYLNESEFRNDWLLESDHLISEILSREYEERQGRTPLSLVDVCFWSTLFYTASIFLHLIRIPTHRHIVGEGCPKPHRLRADSTCACGLYKQKRRPLKW

SEQ ID NO: 15482 - protein, 484 aa, unidentified
MGQLVSFFQEIPNIIQEAINIALIAVSLIAILKGLVNLWKSGLFQLLVFLILAGRSCSFKIGRSTELQNITINMLKVFEDHPISCTVNKTLYYIRESENATWCVEIAALDMSVLLSPHDPRVMGNLSNCVHPDIKHRSELLGLLEWILRALKYDFLNYPPLLCEKVTSSVNETRIQINVSDSAGSHDFKETMLQRLAILFGTKLMFDKTPKQFIVIRNQTWVNQCKSNHVNTLHLMMANAGHAVKLRRLQGVFTWTITDAAGNDMPGGYCLERWMLVTSDLKCFGNTALAKCNLNHDSEFCDMLKLFEFNKKAIESLNDNTKNKVNLLTHSINALISDNLLMKNRLKELLDTPYCNYTKFWYVNHTITGEHSLPRCWMVKNNSYLNESEFRNDWILESDHLLSEMLNKEYFDRQGKTPITLVDICFWSTLFFTTTLFLHLVGFPTHRHIQGEPCPLPHKLNSNGGCRCGRYPELKKPTTWHRKH

SEQ ID NO: 15483 - protein, 910 aa, unidentified
FGYVVDTIAFDNNVCTSVNAIRVKGVCYIPDMSTVSTDVVVGGYPWTEWSGIFTSSTKAIFELFSFYQNHPKVGSGQYLSAVSDSANIGHFSVNGKCSDMYYHSGKLMCMGSNVVNIKMVEYTTFHRPLMSPPSCSTYPNNSLVCHFSDPTEVTRCTHDPYLTRKQDNCSTTIIKKMDHTVDEAAGLTVKTPQVVFHLQRGFDGCKGTCFFASIIEVGYRCSWCLAIIVIAAGIGYIALIVHLLVILICFINGYTIGRLLRLLGLRSLFRCPLTTACSICGMYSYSANEAAKHKLFCSSTQCPYCITLDESNNLCILEFPTRANHREHMKLHKMVRINPYLGVIRMKRYRVATFFLVQLALAGLSGVNAQYFPAETGLRSNAVGLNISIPADSVECSDKGCKVIKDYNAHIPLVDGSSIIMRTKVDGKAFAKKITVENPNMDVTCDYLYTSSEVVVGPRRIVYTCSGKTECTEKTEIDLLTKPIANRGATDDFIPIDTENPLKSLYCPKATSCRSPIIDFMWIPAGCFTVNDGTAIGYEYYMPSIKKEMVHVFRCTVRNIKYKICEGALCKKIDGSSSDLEQGVLKFEHISSKLPIQFMVGAMSRQGDDKPSHIFHGVPDLRTDGSNTNFAYRMTMIPQGETCMEGTSYYGGKCDINTDGSSPALNCKSTLPKIDSDTLIKNYESLHEVYHCNFENSMLRWNTKVVPREITVNKKTTKDTQTVSWPSLNLTSINCNFGFTDINLLTFGHTTMEIVRYTGAITKVVCTGSYNRNGMTQLEFNIKEHSGMLELHCPMLFSETCLFDTVKTNKCNITTLLPFNSTCLYNGQSINIDCSKLELSSADPLSGNIVGWTGSQSKDTWISGFKIGLSNWWYITMIAVGTTSILIFMLWLVITIVNNCKTMKLAMTYS

SEQ ID NO: 15484 - protein, 481 aa, unidentified
MGQLVSFFQDIQLFFQEALNVALAVVTVLAIIKGLVNLWKSGLFQFLFFLILAGRSCSFRIGHHTTFESVTMSVGGVFHELPALCRINNSHSLIQLSHNSSLALSVEYVDLCVVLESDQYLVAGDYSNCTGEATGYNWVIDWTLKGLGHGLEGDPKLHCQPKRSTNAEFTLQLNISRRHTNDHYRERIETGIRHMFGPFKILTKEGKDCVILRNTTWKEQCVKSHYNTLAFLLKNTANSLPKRRPLAFFSWSLSDSSGNDMPGGYCLEEWMLIAAKLKCFGNTALAKCNLNHDSEFCDMLKLYEFNKNAISKLNNQTREAVNALTHSINSLISDDLLMKNKLREFLKVPYCNYTKFWYVNHTKSGEHSLPKCWLVNNGSFLNESEFRNEWILESDHLIAEILSKEYQDRQGKTPITLVDMCFWSAIFFDNKSLLHLVGFPTHRHIVGEACPLPHKINRHGACACGLYQKLKKKTAWRKRHQ

SEQ ID NO: 15485 - protein, 507 aa, unidentified; identical to SEQ ID NO: 15479

SEQ ID NO: 15486 - protein, 518 aa, unidentified
MGQVIGFFQSLPNIINEALNIALICVALIAILKGIVNIWKSGLIQLFIFLILAGRSCSHTFQIGRNHEFQSITLNFTQFLGYAPSSCSVNNTHHYFRGPGNVSWGIELTLTNNSVINASNSLKVFTNIHHNITNCVQNIDEQDHLMKWLIETMHLQIMKPGKRLPPILCEKDKGLLIEYNLTNIASREEKHSEYWSQLLYGLSKLLGSSKSLWFDYCQRADCMMQEHSSHLKCNYSECSGHTTFKYLILQNTTWENHCEFNHLNTIHLLMSSTGQSFITRRLQAFLTWTLSDATGNDLPGGYCLEQWAIVWAGIKCFGNTAVAKCNQNHDSEFCDMLRLFDYNRNAIKSLNDQSQSRLNLLTNTINSLISDNLLMKNKLAEIMNIPYCNYTKFWYINDTRTGRHTLPQCWLISNGSYLNETKFRTQWLSESNALYTEMLTEDYDKRQGSTPLSLVDLCFWSTLFYVTTLFAHLVGFPTHRHILDGPCPKPHRLTKKGICSCGHFGIPGKPVRWVKRSR

SEQ ID NO: 15487 - protein, 480 aa, unidentified
MGQLVSFFQEIPVFFQEALNIALAVVTLLAIVKGVLNLWKSGLFQLLMFLILAGRSCSFRIGYHTSFESFTMTIGGVFHELPALCKVNDTYNLVRLSHNSSLALSVEYGDTGTVMCEHGHVVSGNYTECTGASEEYNWVLDWVLRGLQHDFSRDPVICCEPKKKTNAEFQFRLNLTQRHKGDHYQNKIKTALTHLFGPFAYNEKDPKIFVTMRNTTWTNQCVMSHTDSLRLLASNGGNSFSGRGLKAFFSWSLSDSTGVDMPGGYCLEKWMLIASELKCFGNTALAKCNLKHDSEFCDMIKLFDFNKNAISKLNNNTIEAVNQLTKTVNSLISDNLLMKNRLRELLKVPYCNYTRFWYVNHTRTGEHSLPKCWLVNNGSYLNESDFRNEWILESDHLISEMLSKEYQERQGRTPLTLVDLCFWSAVFYTTTLFLHLVGFPTHRHISGEPCPLPHRLNRHGACNCGRFKRLKKPLVWYKHH

SEQ ID NO: 15488 - protein, 483 aa, unidentified
MGQLVSFIGEIPAIVHEALNVALIAVSIIAIMKGLINIWKSGLFQLIMFLILAGRSCSISIGHHLELQHFIINSTSLLPSMPTLCRINATNSLIRGPFSAQWGLDIFIGDLTILVNPEPGSKTKRMTATNITGCFPNNEDPDSVAQVLSWFFRGVHHDFHLDPTILCDESVTVFRIQMNLTERMYCDRIVSKLARLFGSFGDYCSKVGKKLVIIRNVTWSNQCHEDHVGSMQLILQNAHNQVMRFRKLQNFFSWSLVDSAGNSMPGGYCLEKWMLVASELKCFGNTAVAKCNINHDSEFCDMLRLFDYNKKAIVNLQDKTKAQLDSLIDAVNSLISDNLITKNKIRELMNIPYCNYTKFWYVNHTGLNVHSLPKCWHVRNGSYLNESDFRNEWIIESDHLVSEILAKEYEERQKRTPLSLVDLCFWSTLFYTASIFLHLLHIPTHRHIIGEGCPKPHRLTSDSLCACGFFQLKGRPTRWARIP

SEQ ID NO: 15489 - protein, 501 aa, unidentified; identical to SEQ ID NO: 8222

SEQ ID NO: 15490 - protein, 576 aa, unidentified
MSQLGTDQIMHLAQPAIARRTWRLCFRIFALFILIAIVITQIFMLTFDHTLLTTTQFLTSIGNLQSTITSWTPDVQAMLSISNQLIYTTSITLPLKISTTEMSILTAIRDHCHCPDCSSACPTRQMLLNDPRYMSGVNQFIGAPTESINITFGPLFGIPSFIPTSTTTQGCTRIPSFALGPSHWCYTHNFITAGCADGGHSNQYLAMGTIQSASDGSPLLITARSYYLSDGVNRKSCSIAVVPGGCAMYCYVATRSETDYYAGNSPPQQLLTLVFSNDTIIERTIHPTGLANGWVMLVPGVGSGTLYNEYLLFPAYGGMQQILANQSGEINQFFTPYNATVRCAMAQPQFSQRAAASYYPRYFSNRWIRSAIVACPYRAIYQTQCTLIPLPNRMVMMGSEGRIFTLGDRLFYYQRSSSWWPYPLLYQVGLNFLTTPPSVSSMTQVPLEHLARPGKGGCPGNSHCPATCVTGVYADVWPLTDPRSGVGGTSLVAAGGLDSTSERMAPVNYLAIGESLLSKTYLLSKTQPAAYTTTTCFRDTDTGKIYCITIAELGKVLLGEFQIVPFLREIKIQSRY

SEQ ID NO: 15491 - protein, 552 aa, unidentified
MMAPTNQPDTMSIFRSSIILMLSLISGSGALSLVPKTVCEKEVGLHVDEWLHSCLGACKSSDNDLDLTPHMLMEPTLGYFKAFGYFIHVSTLTKSSHTFLFGGCHITSQETPSDSQELPTNMAENILRHGGPEGEVFMTKEPQCSLWSDNYVKGMLVKYHRVILTVSHTERGITVLYEQEGVIGHGKVGKAMSSSGTLVWDIRAQYPKCNYRPTGVLSCKREGSYIRCRGMSEERISSTKEDCGVIILTTDTRNIYGYHKHDGALATTQTDDNQIGMVKKIIEIENLMCHHLCESSSEEGGVTHHEYLVSTPIGPWLSVSTESHRTMFMCTDESIVSLVVPVVLCGNGPLVKVRVNEKEQWWNISSPYVGMGTHCVPGLSTGLSTADGVINTWLGQVTIVNGSFTFKRDFINKNFHGAFRPSQFSWTHKTGNDLEHIIDALNTQEKVLSHSHVIESHSVGAGENALHSFIGMFTTVFEWIQSLIPSVKGWIIKVFLWALLAALAVLLLWILWKILWLFIKSVFVRRSIRAIPTSENSDTSLNRAIHNWAKMD

SEQ ID NO: 15492 - protein, 524 aa, unidentified
MLLSTAIFAFFLNCAPCLAKFPIYTIPDKIGPWSPIDINHLSCPNNLIVEDEGCTTLTPFSYMELKVGYITTIKIEGFTCTGVITEAETYTNFVGYVTTTFKRKHFRPTVSACRDAYNWKITGDPRYEESLHNPYPDSHWLRTVKTTKESLLIISPSVVDMDAYDKNLYSKMFPNGKCLASPPSAICCPTNHDYTIWIPENPKPGLSCDIFTTSKGKKATKDGRLCGFVDERGLYKSLKGACKQRLCGVPGMRLMDGSWVSLQKTEAPEWCSPDQLVNVHDFHTDEIEHLVVEELVKKREECLDALETIITTKSISFRRLSHFRKLVPGFGKAYTLINKTLMEADAHYKSVREWKEVIPSKGCLMAGGRCHPHYSGIFFNGIILSPGGDVLIPEMQSALLQQHIELLESSMIPLRHPLADPSTVFKRDDEAEDFVEVHLPDTQKLISGIDLGFPEWKRYFLIGISVLALLALAIITAACCKRFKRRRRPKPNPIELIRKVSVTSQSGRAIPSWESYKVGATGES

SEQ ID NO: 15493 - protein, 524 aa, unidentified
MPFQAVLSALLSALTLCVGKFPIYTIPDKLGPWSPIDIHHLSCPNNIVVEDEGCTTLTVFSYMELKVGYITTIKVNGFTCTGVVTEAETYTNFVGYVTTTFKRKHFRPSPSACRDAYSWKTAGDPRYEESLHNPYPDSHWLRTVTTTKESVLIISPSVADMDAYDKTLYSKIFLNGKCSGVSQVSPFCSTNHDYTIWMPENPNPGVSCDIFTTSKGKKATKDGKLCGFVDERGLYKSLKGACKLKLCGISGMRLMDGSWVSIQNHDEAKWCSPDQLVNIHDFHSDEVEHLIAEELVKKREECLDALESIMTTKSISFRRLSHLRKLVPGFGKAYTIINKTLMEADAHYKSIREWTDVIPSKGCLMAGGRCYPHHNGVFFNGIILSPDGHVLIPEMQSAMLQQHIELLESSVIPLMHPLADPSTIFKKDDGAEDFVEVHLPDVQKQISGIDLGLPEWKRYFLIGVSALAFLALMIFIAACCRRVKRKKRAKPNPVELIRKVSVTSQSGRPIPSWESYKVETGGQS

SEQ ID NO: 15494 - protein, 582 aa, unidentified
MASLQSEPGSQKPHYQSDDQLVKRTWRSFFRFSVLVVTITSLALSIITLIGVNRISTAKQISNAFAAIQANILSSIPDIRPINSLLNQLVYTSSVTLPLRISSLESNVLAAIQEACTYRDSQSSCSATMSVMNDQRYIEGIQVYSGSFLDLQKHTLSPPIAFPSFIPTSTTTVGCTRIPSFSLTKTHWCYTHNYIKTGCRDATQSNQYIALGTIYTDPDGTPGFSTSRSQYLNDGVNRKSCSISAVPMGCALYCFISVKEEVDYYKGTVPPAQTLILFFFNGTVHEHRIVPSSMNSEWVMLSPGVGSGVFYNNYIIFPLYGGMTKDKAEKRGELTRFFTPKNSRSLCKMNDSVFSNAAQSAYYPPYFSSRWIRSGLLACNWNQIITTNCEILTFSNQVMMMGAEGRLILINDDLFYYQRSTSWWPRPLVYKLDIELNYPDSHIQRVDQVEVTFPTRPGWGGCVGNNFCPMICVSGVYQDVWPVTNPVNTTDSRTLWVGGTLLSNTTRENPASVVTSGGSISQTVSWFNQTVPGAYSTTTCFNDQVQGRIFCLIIFEVGGGLLGEYQIVPFLKELKYQGAVHA

SEQ ID NO: 15495 - protein, 499 aa, unidentified; identical to SEQ ID NO: 15288

SEQ ID NO: 15496 - protein, 500 aa, unidentified; identical to SEQ ID NO: 15213

SEQ ID NO: 15497 - protein, 500 aa, unidentified; identical to SEQ ID NO: 15213

SEQ ID NO: 15498 - protein, 502 aa, unidentified; identical to SEQ ID NO: 8762

SEQ ID NO: 15499 - protein, 503 aa, unidentified
RCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 15500 - protein, 430 aa, unidentified; identical to SEQ ID NO: 8534

SEQ ID NO: 15501 - protein, 164 aa, unidentified
LGGLTMGGIAAGIGTGTTALIKTQQFEQLHAAIQTDLNEVEKSITNLEKSLTSLSEVVLQNRRGLDLLFLKEGGLCAALKEECCFYADHTGLVRDSMAKLRERLNQRQKLFESGQGWFEGLFNRSPWFTTLISTIMGPLIVLLLILLFGPCILNRLVQFVKDRI

SEQ ID NO: 15502 - protein, 734 aa, unidentified
MSQLAAHNLAMSNFYGTHQGDLSGSQKGEEQQVQGVIRYVSMIVSLLSLFTIIALNVTNIIYMTESGGTMQSIKTAQGSIDGSMREISGVIMEDVKPKTDLINSMVSYNIPAQLSMIHQIIKNDVPKQCTPSFMFNNTICPLAENPTHSRYFEEVNLDSISECSGPDMHLGLGVNPEFIEFPSFAPGSTKPGSCVRLPSFSLSTTVFAYTHTIMGHGCSELDVGDHYFSVGRIADAGHEIPQFETISSWFINDKINRRSCTVAAGAMEAWMGCVIMTETFYDDRNSLDTGKLTISYLDVFGRKKEWIYTRSEILYDYTYTSVYFSVGSGVVVGDTVYFLIWGSLSSPIEETAYCFAPDCSNYNQRMCNEAQRPSKFGHRQMVNGILKFKTTSTGKPLLSVGTLSPSVVPFGSEGRLMYSEITKIIYLYLRSTSWHALPLTGLFVLGPPTSISWIVQRAVSRPGEFPCGASNRCPKDCVTGVYTDLFPLGSRYEYAATVYLNSETYRVNPTLALINQTNIIASKKVTTESQRAGYTTTTCFVFKLRVWCISVVELAPSTMTAYEPIPFLYQLDLTCKGKNGSLAMRFAGKEGTYKSGRYKSPRNECFFEKVSNKYYFIVSTPEGIQPYEIRDLTPDRMPHIIMYISDVCAPALSAFKKLLPAMRPITTLTIGNWQFRPVEVSGGLRVNIGRNLTKEGDLTMSAPEDPGSNTFPGNHIPGNGILDAGYYTVEYPKE

SEQ ID NO: 15503 - protein, 491 aa, unidentified
MGQIVTFFQEVPHIIEEVMNIVLITLSLLAILKGIYNVMTCGLIGLLTFLFLCGKSCSTIYKDNYRLMQLNLDMSGLNATMPLSCSKNNSHHYIQVFNTTGLELTLTNDSLIGHKWCNLSDAHKKDTYDHTLMSIISTFHLSIPNFNHYEAMACDFNGGKISIQYNLSHSSETDAMNHCGTVANGVLEVFRRMTWCTHCDTPLGASIAGFNCVRTSYKYLIIQNTTWEDHCTMSRPSPMGYLSLLSQRAREIYISRRLMGTFTWTLSDSEGNDLPGGYCLQRWMLIEAEMKCFGNTAVAKCNQQHDEEFCDMLRLFDFNKEAIHRLRVEAEKSISLINKAVNSLINDQLIMRNHLRDIMGIPYCNYSRFWYLNDTRSGRTSLPKCWMVSNGSYLNETHFSSDIEQEANNMITEMLRKEYERRQGTTPLGLVDLFVFSTSFYLISVFLHLIKIPTHRHLVGKPCPKPHRLNHMGVCSCGLYKQPGLPTKWKR

SEQ ID NO: 15504 - protein, 495 aa, unidentified
MGQIITFFQEVPHIIEEVMNIVLITLSLLAILKGVYNVMTCGLIGLISFLLLCGKSCSLIYKDTYNFSSIELDLSHLNMTLPMSCSRNNSHHYVFFNGSGLEMTFTNDSLLNHKFCNLSDAHKKNLYDHALMGIVTTFHLSIPNFNQYEAMACDFNGGNISIQYNLSHNDRTDAMNHCGTVANGVLDAFYRFHWGRNITYIAQLPNGDGTGRWTFCYATSYKYLVIQNISWADHCQMSRPTPIGFASILSQRIRSIYISRRLMSTFTWSLSDSSGTENPGGYCLTRWMLFAADLKCFGNTAIAKCNLNHDEEFCDMLRLIDFNKQALKTFKSEVNHGLQLITKAINALINDQLIMKNHLRDLMGIPYCNYSKFWYLNDTRTGRVSLPKCWMISNGTYLNETHFSDEIEQEADNMITEMLRKEYQERQGKTPLGLVDLFIFSTSFYSITVFLHLIKIPTHRHIVGQGCPKPHRLNSRAICSCGAYKQPGLPTKWKR

SEQ ID NO: 15505 - protein, 183 aa, unidentified
KLQPPMPPKTMIKEQTAVGMLSWYDHTVQGYLYKRELYTNYQYYGTALDANSYPMKRWQTFLPDTSELEEWIRTKKCQVGRNLCGESDFWGSWSQECLKSPRDLLTTNPQWVNDEVRHECSGGEWIKFPYHTCLISWSCFIREIDLPVRVLEDGKIYSSFSNGTMFELTKHIYTMEKGAQLYI

SEQ ID NO: 15506 - protein, 551 aa, unidentified
MVSKITLLCFAITCDVLISMGTVQGVFNHSVGPLAVCSPDMEDARAYTENCYRRCSRNKEPSTHGYVWLYSDTAPKGGPVVTRCNKVRVKQVFTETWSFSFIKGTPTRMTLDVTEAECVAVMRSQCPTHNCNIKAPSELPEEYHYASDTEVVQDYLEILSMPSGLDYMEENLRITPSQSKFSFQLTDGKGQEGQYIYFWDTKYDDTKCPFDSFQSHGCDKYDSPLDLINCRESRFVIPSIANSTTLVGACQGLQKSTTGLIYKWDDRPDSIANDSKRIALTKNDQTAGNVATLRVLVADSLNAVDEDLCHTQCEMLDFILRSDRKREVLTRIGGSYLVVSKTSYIRQCRPLVGCRIVKPHYFCGNPNRVAIICHGKVWYWDPLKSYVDEGMNCERRVAGTKLVFAVGNHEYAIDDDMHVELPEHETYGISHDLLASSEDRISKDIVDPTELRNSWQSHIAKEGRMSIEPLSQDKQVSHWDAEFSNPLTWLTSAGGWILDMSHKVTLWATVFLTLGALVAGAKVWEIMRKANRKSQYKRTNTEPHDSQATWI

SEQ ID NO: 15507 - protein, 501 aa, unidentified; identical to SEQ ID NO: 8222

SEQ ID NO: 15508 - protein, 260 aa, unidentified; identical to SEQ ID NO: 8254

SEQ ID NO: 15509 - protein, 709 aa, unidentified
MNPVAMSNFYGINQADHLREKGDQPEKGPSVLTYVSLITGLLSLFTIIALNVTNIIYLTGSGGTMATIKDNQQSMSGSMRDISGMLVEDLKPKTDLINSMVSYTIPSQISAMSAMIKNEVLRQCTPSFMFNNTICPIAEHPVHTSYFEEVGIEAISMCTGTNRKLVVNQGINFVEYPSFIPGSTKPGGCVRLPSFSLGLEVFAYAHAITQDDCTSSSTPDYYFSVGRIADHGTDVPVFETLAEWFLDDKMNRRSCSVTAAGKGGWLGCSILVGSFTDELTSPEVNRISLSYMDTFGKKKDWLYTGSEVRADQSWSALFFSVGSGVVIGDTVYFLVWGGLNHPINVDAMCRAPGCQSPTQSLCNYAIKPQEWGGNQIVNGILHFKHDTNEKPTLHVRTLSPDNNWMGAEGRLFHFHNSGKTFIYTRSSTWHTLPQVGILTLGWPLSVQWVDITSISRPGQSPCEYDNRCPHQCVTGVYTDLFPLGVSYEYSVTAYLDQVQSRMNPKIALVGAQEKIYEKTITTNTQHADYTTTSCFAYKLRVWCVSIVEMSPGVITTRQPVPFLYHLNLGCQDTSTGSLTPLDAHGGTYLNTDPVGNKVDCYFVLHEGQIYFGMSVGPINYTYSIVGRSREIGANMNVSLNQLCHSVYTEFLKEKEHPGTRNNIDVEGWLLKRIETLNGTKIFGLDDLEGSGPGHQSGPEDPSIAPIGHN

SEQ ID NO: 15510 - protein, 588 aa, unidentified
  VARIANT 510: note = Any amino acid
MSILVIILILPILFGEVPPVNSGRVVDLNRNVRTDDHPTDLYPLYECGKQDTAVPISSWYGACRGSCSITRNTTDNTMEIFFRNDSVGWIDVLSLQTSPIRKNSHVTWYGECEKSSDVSSARPAPSEIIDTVAPAILDKMDTWPYGGAVFIYDTIDFPECKYTSDYSRSGWRIMVSKRSLELKSDISGEGYIIDPDLGFYFPISKGKGLGRFWWIWQQNSLSQQGCYFKTAGVVNCTLLLDTYTYSCPGINVAFSARIGNHLTSSCVGEVNISTDGITYKLHNQVSVGSISNQLISLWHQSEEALIQQLIIVINDALGKIESSYCESTCDLTEIAMSKHSDHPLVIETPVGPWLPASKGGEFVVIPCQSEPNLVVMTPIETCLSPFLIKVKSLKTGEVYWWMPTESHVSPDRQCLGHEEEELYLKSTQRKPLQFEFWKGAYIIDYPYNGSGRWIMNPGGFIHRSSKWFPSLTELSYTAPISLPTITEGVDKKVHQVIMSVGDIGNTTGSXWFAWMQPLGDKLARAVGSVASSLLIWWTTLEEEVKHGVIIVFFTVIGLIIAVPTLKMLLKGRRPYEPVKSPVVWGGPR

SEQ ID NO: 15511 - protein, 285 aa, unidentified; identical to SEQ ID NO: 8156

SEQ ID NO: 15512 - protein, 501 aa, unidentified; identical to SEQ ID NO: 8222

SEQ ID NO: 15513 - protein, 416 aa, unidentified; identical to SEQ ID NO: 8502

SEQ ID NO: 15514 - protein, 491 aa, unidentified
MGQIVTFFQEVPHVIEEVMNIVLIALSVLAVLKGLYNFATCGLVGLVTFLLLCGRSCTTSLYKGVYELQTLELNMETLNMTMPLSCTKNNSHHYIMVGNETGLELTLTNTSIINHKFCNLSDAHKKNLYDHALMSIISTFHLSIPNFNQYEAMSCDFNGGKISVQYNLSHSYAGDAANHCGTVANGVLQTFMRMAWGGSYIALDSGRGNWDCIMTSYQYLIIQNTTWEDHCQFSRPSPIGYLGLLSQRTRDIYISRRLLGTFTWTLSDSEGKDTPGGYCLTRWMLIEAELKCFGNTAVAKCNEKHDEEFCDMLRLFDFNKQAIQRLKAEAQMSIQLINKAVNALINDQLIMKNHLRDIMGIPYCNYSKYWYLNHTTTGRTSLPKCWLVSNGSYLNETHFSDDIEQQADNMITEMLQKEYMERQGKTPLGLVDLFVFSTSFYLISIFLHLVKIPTHRHIVGKSCPKPHRLNHMGICSCGLYKQPGVPVKWKR

SEQ ID NO: 15515 - protein, 489 aa, unidentified; identical to SEQ ID NO: 15466

SEQ ID NO: 15516 - protein, 176 aa, unidentified
NEKTCRGMYKLVPPEPPKTQIREQLAKGTLIWYDHSVKAYIYGRELYTNYQYYGTGIDSNSYPVKSWRNTFPHLDELSEWIKRGGCKVGRNICGPGDFWGTWSSECLKSSEVLLSTDSQWGGEKIEHECSGSEWIKFPYHTCQISWSCHLHEVSLPIRLDTEGRVYTSLPNGSRLE

SEQ ID NO: 15517 - protein, 565 aa, unidentified; identical to SEQ ID NO: 8390

SEQ ID NO: 15518 - protein, 568 aa, unidentified; identical to SEQ ID NO: 9025

SEQ ID NO: 15519 - protein, 503 aa, unidentified
MGQIVTLIQSIPEVLQEVFNVALIIVSVLCIVKGFVNLMRCGLFQLVTFLILSGRSCDSMMIDRRHNLTHVEFNLTRMFDNLPQSCSKNNTHHYYKGPSNTTWGIELTLTNTSIANETSGNFSNIGSLGYGNISNCDRTREAGHTLKWLLNELHFNVLHVTRHIGARCKTVEGAGVLIQYNLTVGDRGGEVGRHLIASLAQIIGDPKIAWVGKCFNNCSGDTCRLTNCEGGTHYNFLIIQNTTWENHCTYTPMATIRMALQRTAYSSVSRKLLGFFTWDLSDSSGQHVPGGYCLEQWAIIWAGIKCFDNTVMAKCNKDHNEEFCDTMRLFDFNQNAIKTLQLNVENSLNLFKKTINGLISDSLVIRNSLKQLAKIPYCNYTKFWYINDTITGRHSLPQCWLVHNGSYLNETHFKNDWLWESQNLYNEMLMKEYEERQGKTPLALTDICFWSLVFYTITVFLHIVGIPTHRHIIGDGCPKPHRITRNSLCSCGYYKYQRNLTNG

SEQ ID NO: 15520 - protein, 609 aa, unidentified; identical to SEQ ID NO: 8763

SEQ ID NO: 15521 - protein, 286 aa, unidentified
DKIVSRAGGALVANILRTRANTALGFYESCAEWKIFYEGVVFSPYMRQACTGTNGEWSRMKEQFYTKFYEMATRFQCFKFVRVPYIRPAESTQEVAPGCGAGGTINGVEYITDPRNGTIITSVVTDLKITGEYLMPFCYFVYRSRDIWLAENRGYDSDPFLKVYNEQGETLFDWNQLTDGYGEPKAEKMIKCSFIIVEKTSKITIQSWSASQFITRAAYYFNETIPRRPIQVIESKWAQSRMSDPITQESACRRLGDYCIYFRIGTYLGIFDDELGDLQVRDILSG

SEQ ID NO: 15522 - protein, 488 aa, unidentified
MGQLFSFFEEVPNIIHEAINIALIAVSLIAALKGMINLWKSGLFQLIFFLTLAGRSCSFRIGRSTELQNITFDMLKVFEDHPTSCMVNHSTYYVHENKNATWCLEVSVTDVTLLMAEHDRQVLNNLSNCVHPAVEHRSRMVGLLEWIFRALKYDFNHDPTPLCQKQTSTVNETRVQINITEGFGSHGFEDTILQRLGVLFGSRIAFSNIQDLGKKRFLLIRNSTWKNQCEMNHVNSMHLMLANAGRSSGSRRPLGIFSWTITDAVGNDMPGGYCLERWMLVTSDLKCFGNTALAKCNLDHDSEFCDMLKLFEFNKKAIETLNDNTKNKVNLLTHSINALISDNLLMKNRLKELLNTPYCNYTKFWYVNHTASGEHSLPRCWLVRNNSYLNESEFRNDWIIESDHLLSEMLNKEYIDRQGKTPLTLVDICFWSTLFFTTTLFLHLVGFPTHRHIRGEPCPLPHRLNSRGGCRCGKYPELKKPITWHKNH

SEQ ID NO: 15523 - protein, 609 aa, unidentified
MSPPRDRVDAYYKDNFQFKNTRVVLNKEQLLIERPCMLLTVLFVMFLSLVGLLAIAGIRLHRAAVNTAKINNDLTTSIDITKSIEYQVKDVLTPLFKIIGDEVGLRTPQRFTDLTKFISDKIKFLNPDKEYDFRDINWCINPPERIKIDYDQYCAHTAAEDLITMLVNSSLTGTTVLRTSLVNLGRNCTGPTTTKGQFSNISLTLSGIYSGRGYNISSMITITGKGMYGSTYLVGKYNQRARRPSIVWQQDYRVFEVGIIRELGVGTPVFHMTNYLELPRQPELETCMLALGESKLAALCLADSPVALHYGRVGDDNKIRFVKLGVWASPADRDTLATLSAIDPTLDGLYITTHRGIIAAGTAIWAVPVTRTDDQVKMGKCRLEACRDRPPPFCNSTDWEPLEAGRIPAYGVLTIKLGLADEPKVDIISEFGPLITHDSGMDLYTSFDGTKYWLTTPPLQNSALGTVNTLVLEPSLKISPNILTLPIRSGGGDCYTPTYLSDRADDDVKLSSNLVILPSRDLQYVSATYDISRVEHAIVYHIYSTGRLSSYYYPFKLPIKGDPVSLQIECFPWDRKLWCHHFCSVIDSGTGEQVTHIGVVGIEITCNGK

SEQ ID NO: 15524 - protein, 596 aa, unidentified
MMARLVPCFTLALLLHLTECADYITSPIRPMYECNSFDSSVTLSSWYQTCRASCRPDAGWARSNITLYYDTFAGSVIPVYQMQIYRTTIESHTDILDNCKYTEYSTPIIIDKDDITMYTTKLFTTATLNPNNSTLIIENKTIPECSYFRDKYSSYDTIIATKYMARVMSSSVASEYYLKIPALQATMSYSSGSARYGSGVLVWNITLPNINQCTLSDGITETCRSDSMLGKWWCPSLIGSILLTKGATATCKGDLIQVSPGIYVTLSGTSTVDSTASMLQDGIDELEPDLVSVLTQINKAMTTFASASCESICDLADQTFSLRENTTSVVETPIGPWLGWRESLSNLNHIYYVSACRRVTQWKIMSPLNPCDSTVGLTITDGEKGLSLWDPAQNYFIMGAECADFVRSDWKTLMGKKQSIQIHFWGKKLIIYPPYIANTSWEESELHIHRTSKWTPYIDGQDINTEDDMLTLLDQIEHHSRKLVRVIGMEQTKNLTIFTKLWTGISDIGSTISGIYHGVASAIGHFLNFIIKLVIGFTVGTIMLYISWIIIRKLILKQKNRKPEQDQEMMDVAPIHRSGGLTQPILRRKGISMDDM

SEQ ID NO: 15525 - protein, 591 aa, unidentified
MSLIHLIYFPTILSLILGTEGTPALTYGNLADNQHGNEEQGDVDMYPLYECSKKGAGVSSNNWYGACRGACSMTKNTTDVHMEIYYRNDSVGWIDVLSIQTTEIWKHSHVTWYGECEHNTKYGSSNTAPVSVILERLEFLHNGMSSWPYGHSIHVHDTISSPDCSYFDDVSRSGWRLIISKRALELKSDIAGEGYIVDPDVGYVYPVADGIGKGRTWHVWKASSVPSSGCYFKSAGITNCTLLMDTFLYSCPSLNIAFSARVGKHIKSTCVGDMNISTDGVTYQTLGSTDQGSISTQLVSLWHQSQEALIQQLILTINEALGKIETSYCESTCDLTEMLISQHTEHPMVIETPVGPWLPYSIDGKVSVLPCQGGQDLVVIKPIEICASPFMLKVKSLKSLDTYWWVPTDSHVAPFTQCSNRDDEEMIIKIQRKKPLIFEFWRGAYKLDYPYNSSGIWLDNPGGHIHRSSKWFPTLDSLSYSSPINLPLISKGIRKHIQAIVSTTEITSGGNVTSWTHSISTIAEAMFDSAAIAAGRVVMWWYTLEESVKRYLTVAFGLVLTVITIWAMSKLFFRSSPTYARAPTNIEWVRS

SEQ ID NO: 15526 - protein, 510 aa, unidentified
MGQFITLMQSIPEALNMAFNVALVIVSLLCVTKGLINLWKCGIIQLLMFLALAGRSCDGEYKIDRRHVLSHVEFNLTRMFDNLPQSCSINNTHHYYKGPENTTWGVELTLTNTSVMNRSDENVTSIRSLGFGNITNCDKTGEAGHTLKWLLNELHFTVLHVTRHIGALCRTTAGAGLLIQYNLTTSDKGGEVGRHLIASLAQIIGDNKAAWVGKCYNNCTSSGKCSLTNCEGGTHYKFLVIQNTTWPNHCSYSPMSTVRMIIQKTAYSSVSRKLLGFFTWDISDSSGQHVPGGYCLEQWAIVWAGIKCFDNSVMAKCNKDHNEEFCDTMRLFDFNQNAIKTLQLNVENSLNLMKKSINGLISDSLVIRNSLKQLAKIPYCNYTKFWYVNDTITGKHSLPQCWLVSNGSYLNETHFKNEWLWESQKLYNDMLLKEYEERQGNTPLALADLCFWSLVFFTTTVFFQLIGIPTHRHLIGEGCPKPHRLTSNSLCSCGFYKIPKKPFRWVRKGK

SEQ ID NO: 15527 - protein, 632 aa, unidentified
MVDPPAVSYYTGTGRNDRVKVVTTQSTNPYWAHNPNQGLRRLIDMVVNVIMVTGVIFALINIILGIVIISQSAGSRQDTSKSLDIIQHVDSSVAITKQIVMENLEPKIRSILDSVSFQIPKLLSSLLGPGKTDPPIALPTKASTPVIPTEYPSLNTTTCLRIEESVTQNAAALFNISFDLKTVMYELVTRTGGCVTLPSYSELYTRVRTFSTAIRNPKTCQRAGQETDLNLIPAFIGTDTGILINSCVRQPVIATGDGIYALTYLTMRGTCQDHRHAVRHFEIGLVRRDAWWDPVLTPIHHFTEPGTPVFDGCSLTVQNQTALALCTLTTDGPETDIHNGASLGLALVHFNIRGEFSKHKVDPRNIDTQNQGLHLVTTAGKSAVKKGILYSFGYMVTRSPEPGDSKCVTEECNQNNQEKCNAYSKTTLDPDKPRSMIIFQIDVGAEYFTVDKVVVVPRTQYYQLTSGDLFYTGEENDLLYQLHNKGWYNKPIRGRVTFDGQVTLHEHSRTYDSLSNQRACNPRLGCPSTCELTSMASYFPLDKDFKAAVGVIALRNGMTPIITYSTDDWRNHWKYIKNADLEFSESSLSCYSPNPPLDDYVLCTAVITAKVMSNTNPQLLATSWYQYDKCHT

SEQ ID NO: 15528 - protein, 604 aa, unidentified
MSSPRDKVDAFYKDIPRPRNNRVLLDNERVIIERPLILVGVLAVMFLSLVGLLAIAGVRLQKATTNSIEVNRKLSTNLETTVSIEHHVKDVLTPLFKIIGDEVGLRMPQKLTEIMQFISNKIKFLNPDREYDFNDLHWCVNPPDQVKIDYAQYCNHIAAEELIVTKFKELMNHSLDMSKGRIFPPKNCSGSVITRGQTIKPGLTLVNIYTTRNFEVSFMVTVISGGMYGKTYFLKPPEPDDPFEFQAFRIFEVGLVRDVGSREPVLQMTNFMVIDEDEGLNFCLLSVGELRLAAVCVRGRPVVTKDIGGYKDEPFKVVTLGIIGGGLSNQKTEIYPTIDSSIEKLYITSHRGIIRNSKARWSVPAIRSDDKDKMEKCTQALCKSRPPPSCNSSDWEPLTSNRIPAYAYIALEIKEDSGLELDITSNYGPLIIHGAGMDIYEGPSSNQDWLAIPPLSQSVLGVINKVDFTAGFDIKPHTLTTAVDYESGKCYVPVELSGAKDQDLKLESNLVVLPTKDFGYVTATYDTSRSEHAIVYYVYDTARSSSYFFPFRIKARGEPIYLRIECFPWSRQLWCHHYCMINSTVSNEIVVVDNLVSINMSCSR

SEQ ID NO: 15529 - protein, 150 aa, unidentified; identical to SEQ ID NO: 15386

SEQ ID NO: 15530 - protein, 508 aa, unidentified
MDPRIMYYTVLLTTAARVYGQTIKPGVDSVSDQPTWANPLFTYPVDCPAAKLSKVSPSQLRCPRIFDDENRGLVAYPAVIRSLSVGNNLGDIHTQGEYVHKVLYRTTCSTGFFGGQTIEKALVEMKLAPREVGVYDTTTASALYFPAPRCQWYTDNVHNDLTFYYTTAKSVLRDPYTLGFLDSDFIEGKCSKSPCQTHWSNVVWKGDSGVAACDTGSEIKGHIFVDKTSHHVVKATSYGHHPWGLHRACMITFCGKPWIRTDLGDLIAIEYNGGATLLAFPACKDTTVGMRGSLDDFAYLDDLVKSSESREECLEAHAEIIATNSVTPYLLSKFRSPHPGINDVYAMHDGSIYHGKCMTVAIDEVSKDRRTYRAHQTSAFVAWGHPFGDEWGGFHGLHGNDTPVIPDLEKYVAQYKVSMMDKMDIRPVPHPSVQILYNDTDTADITIRKIDSFDLQSLNWSFWPSLSALGGVPILLALVFFLYCCMNRRPSMPAAPQEIPMYHLASRG

SEQ ID NO: 15531 - protein, 564 aa, unidentified
MDPKSYYCNEDLRSDGGEKSPGGDLYKGIILVSTVISLIIAIISLAFIIDNKINIQSLDPLRGLEDSYLVPIKDKSESISQDIQEGIFPRLNLITAATTTTIPRSIAIQTKDLSDLIMNRCYPSVVNNDTSCDVLAGAIHSNLFSQLDPSTYWTCSSGTPTMNQTVKLLPDNSQIPGSTYSTGCVRIPTFSLGSMIYSYSHNVIYEGCNDHSKSSQYWQLGYISTSKTGEPLQQVSRTLTLNNGLNRKSCSTVAQGRGAYLLCTNVVEDERTDYSTEGIQDLTLDYIDIFGAERSYRYTNNEVDLDRPYAALYPSVGSGTVYNDRILFLGYGGLMTPYGDQAMCQAPECTSATQEGCNSNQLIGYFSGRQIVNCIIEIITVGTEKPIIRVRTIPNSQVWLGAEGRIQTLGGVLYLYIRSSGWHALAQTGIILTLDPIRISWIVNTGYSRPGNGPCSASSRCPAQCITGVYTDIFPLSQNYGYLATVTLLSGVDRVNPVISYGTSTGRVADSQLTSSSQVAAYTTTTCFTFNQKGYCYHIIELSPATLGIFQPVLVVTEIPKICS

SEQ ID NO: 15532 - protein, 479 aa, unidentified
MGQLISFFQDIPIFFEEALNVALAVVTLLAIIKGIVNVWKSGILQLFVFLVLAGRSCSFKVGHHTNFESFTVKLGGVFHELPSLCRVNNSYSLIRLSHNSNQALSVEYVDVHPVLCSSSPTILDNYTQCIKGSPEFDWILGWTIKGLGHDFLRDPRICCEPKKTTNAEFTFQLNLTDSPETHHYRSKIEVGIRHLFGNYITNDSYSKMSVVMRNTTWEGQCSNSHVNTLRFLVKNAGYLVGRKPLAFFSWSLSDPKGNDMPGGYCLERWMLVAGDLKCFGNTAVAKCNLNHDSEFCDMLRLFDFNKNAIEKLNNQTKTAVNMLTHSINSLISDNLLMRNKLKEILKVPYCNYTRFWYINHTKSGEHSLPRCWLVSNGSYLNESDFRNEWILESDHLIAEMLSKEYQDRQGKTPLTLVDLCFWSAIFFTTSLFLHLVGFPTHRHIQGDPCPLPHRLDRNGACRCGRFQKLGKQVTWKRKH

SEQ ID NO: 15533 - protein, 432 aa, unidentified
SSIEPLYTISATGTSLTHARLLSNEIYSISTERGLIHLDIHNVTVRGERPFKTLLTKCDVVESFSEDTCPGGSHLDMARIRRHNRTCKVDSFNRGWGTGCFEWGLGQVATCVEVSCASHTNVSVLVDSIIQAKVSMEIHGHQDTQSIVRDVPTQFQFGDVGTITLTCGVTTDRIAGHYYHIREGVKAGLVLREAVDSWPGMIKMGGFTSGMDKIVRWGITTANEIKIDGLINPQIDWQTSVLRDIRSISFTCEMIFDNISFSSLPLCAANASGTFIQNGYGQDGVVAVSLEEVMEQACSFPLKCKGCTLTCPSLVIAEKSQVGRAHVICGNGTSHVEFGTTVVPVECLVTPVTQAWRLLSHVTGRYTKTGVTGLGSVWEDLLGNLRFSWSWFPSSWLVMAFIGLALFLVFGRVGSFVVFVVIIAVYVRSVSA

SEQ ID NO: 15534 - protein, 496 aa, unidentified; identical to SEQ ID NO: 8708

SEQ ID NO: 15535 - protein, 337 aa, unidentified; identical to SEQ ID NO: 8339

SEQ ID NO: 15536 - protein, 571 aa, unidentified; identical to SEQ ID NO: 8536

SEQ ID NO: 15537 - protein, 416 aa, unidentified; identical to SEQ ID NO: 8502

SEQ ID NO: 15538 - protein, 484 aa, unidentified
TNCVSIQKRDILRGSGSTTWFDVLLEKGSCVTIVADDRPTVDIWLDRITHESPIAGREYCMRVDISGLKIATRCPTLGEAYLSEEHTEDYVCKRGFSDRGWGNGCGLFGKGSIVGCVKTTCKSSGIAKSYSYDIPKVKYVISTEVHKGELISGNVSASVVSATFSSEAEKHSMELEDYGRLEFTCRVVSGSNLGSVRILEIDNHYFNVHEDWLLDLPLPWRIPDGHWHDLGKLIAFKEPHAVKMVVQAYGDQRASLLKSLVKAEEIAKSGNSYYLPGGHVDCRVSLVNLKLKGTTYPYCGDSFVWKRRPTATHHGTVAMEVTYQGTDVPCKVSVIVEKDGQNGGNAGSLITSNPIITAQGSSVFLELEVPLGFSTIKVGAAKQQWRQDGSSIGKAMARASRAFEQTLMTAGSYWQSTDTVTSFSLMRMIRAPLAMLFGDVGFMGKMIISIVCIWFAMNSRNMTLSLVLGVLGFGLLAFTTGVMG

SEQ ID NO: 15539 - protein, 438 aa, unidentified; identical to SEQ ID NO: 9201

SEQ ID NO: 15540 - protein, 502 aa, unidentified
GHCHDPEKFDIIEAGGYTKMTTFLKHDKCFMVRVPEHDVVEITVVKKTIRPTTGCKTFLLGASVNTESRAKCPGAGSATIPKTPGDKTFCHIEHVDRGWDSGCFIFGKGEVVTCAAVTYSKPFYAWMVDSEQITWEVEVNFGGDSNRKKTAEISMDSEYEEFEDPKNTGSKIRLYCKTPRQEWDNYYMVARPGGSLYKVRRELINDLNLPWTDFKYPYVTTTIVRNGESILRFKRPTMTYIPVTVAAGLERLYMDVVLQGPVLKCSGNHCTKEQWSGNSETELPTITEDVGTLKCEIDYSGLKVRVTNVALCTHTSTIVSGPLVTNDIVMIVLRGTGSDTTECKLKVEGKSASSNNWITNYCAPHSRSMSVKPNEQTTVKMTCPNGIIDLRFNGKTTTQVEVKYSRTMKLVSSMMASFKDVTENVMIHESGFETFKKVAKMLTTPVVGFFKSILGLASNWYILIFALLLVYVGVNKQGPVGNIMLALGLICLLTYYFEVVAA

SEQ ID NO: 15541 - protein, 575 aa, unidentified; identical to SEQ ID NO: 8301
  VARIANT 178: note = Any amino acid
  VARIANT 179: note = Any amino acid
  VARIANT 180: note = Any amino acid
  VARIANT 181: note = Any amino acid
  VARIANT 182: note = Any amino acid
  VARIANT 183: note = Any amino acid
  VARIANT 184: note = Any amino acid
  VARIANT 185: note = Any amino acid
  VARIANT 186: note = Any amino acid
  VARIANT 187: note = Any amino acid
  VARIANT 188: note = Any amino acid
  VARIANT 189: note = Any amino acid
  VARIANT 190: note = Any amino acid
  VARIANT 509: note = Any amino acid
  VARIANT 510: note = Any amino acid
  VARIANT 511: note = Any amino acid
  VARIANT 512: note = Any amino acid

SEQ ID NO: 15542 - protein, 438 aa, unidentified; identical to SEQ ID NO: 9201

SEQ ID NO: 15543 - protein, 482 aa, unidentified; identical to SEQ ID NO: 15383

SEQ ID NO: 15544 - protein, 416 aa, unidentified; identical to SEQ ID NO: 8502

SEQ ID NO: 15545 - protein, 293 aa, unidentified; identical to SEQ ID NO: 8158

SEQ ID NO: 15546 - protein, 593 aa, unidentified
MWATSESKAPIPANSTLNLVDVPLDEPQTITKHRKQKRTGRLVFRLLSLVLSLMTVILVLVILASWSQKINACATKEGFNSLDLQISGLVKSINSLITEVNQISITTAINLPIKLSDFGKSIVDQVTQMIRQCNAVCKGPGEKPGIQNIRINIPNNFSTYLELNNTVKSIELQRRPALLARPNPIPKSCSRFPSYSVNFGIHCFAHAITDQSCELSDKTYYRLAIGISDKNLSDPSDVKYIGEAFTPMGLQARGCSVISSIYGCYLLCSKSNQGYEADFQTQGFHQMYILFLSRDLKTTLFNDMISSTTVVWNGLYPGEGAGIWHMGYLIFPLWGGIKIGTPASTSILNSTLDLPLVGPSCKSTLEENNLINKDVLFSPYFGESVMVFGFLSCYMLSNVPTHCQVEVLNSSVLGFGSRSQLMDLKGIVYLYIQSAGWYSYTQLFRLSLQSRGYKLTVKQIRRIPISSTTRPGTAPCDVVHNCPYTCATGLFQAPWIVNGDSILDRDVRNLVFVQAWSGNFNTFQKGLISICNQYTCPLTTLLDNDNSIMRSTTTYCYPSLSEYNLQCQSFIEWGGPVGNPIGILEVHYIIKFK

SEQ ID NO: 15547 - protein, 229 aa, unidentified; identical to SEQ ID NO: 8171

SEQ ID NO: 15548 - protein, 504 aa, unidentified; identical to SEQ ID NO: 8334

SEQ ID NO: 15549 - protein, 496 aa, unidentified; identical to SEQ ID NO: 8708

SEQ ID NO: 15550 - protein, 602 aa, unidentified
MPAENKKVRFENTTSDKGKIPSKVIKSYYGTMDIKKINEGLLDSKILSAFNTVIALLGSIVIIVMNIMIIQNYTRSTDNQAVIKDALQGIQQQIKGLADKIGTEIGPKVSLIDTSSTITIPANIGLLGSKISQSTASINENVNEKCKFTLPPLKIHECNISCPNPLPFREYRPQTEGVSNLVGLPNNICLQKTSNQILKPKLISYTLPVVGQSGTCITDPLLAMDEGYFAYSHLERIGSCSRGVSKQRIIGVGEVLDRGDEVPSLFMTNVWTPPNPNTVYHCSAVYNNEFYYVLCAVSTVGDPILNSTYWSGSLMMTRLAVKPKSNGGGYNQHQLALRSIEKGRYDKVMPYGPSGIKQGDTLYFPAVGFLVRTEFKYNDSNCPITKCQYSKPENCRLSMGIRPNSHYILRSGLLKYNLSDGENPKVVFIEISDQRLSIGSPSKIYDSLGQPVFYQASFSWDTMIKFGDVLTVNPLVVNWRNNTVISRPGQSQCPRFNTCPEICWEGVYNDAFLIDRINWISAGVFLDSNQTAENPVFTVFKDNEILYRAQLASEDTNAQKTITNCFLLKNKIWCISLVEIYDTGDNVIRPKLFAVKIPEQCT

SEQ ID NO: 15551 - protein, 485 aa, unidentified
STCVSVAKRDMIRGDLGTTWVDAFLEKGSCSTLMVEDKPAVDVWLDEVSQSSVIASHEYCMEVAGSNVKSSGSCPTQGEAHLAEEANSDYVCKRGFSDRGWGNGCGLFGKGSIVACIKTTCKNDANIIKSYVYDAPKIQFTVGIEVHKGNLLGPSDNNRIVKATFSAEAGKHSVELTGYGVLEFSCRVVASTDLSDIRLIEIDNHFYNVHEDWLRDLPLPWRLPKGKWKDMERMVVFKDPHAVKWTVQTYGNQRTAIFKALVKANEISKSNNKYILDGGHLSCRIGVNGLKMVGATYSQCTKPFEWIKKPVLTQHGTVVMEVKYTGEGAPCRIPFRVERVDKPMENVGNLVTGNPYASQKDAVVFLEAEVPPGISIIKIGDIDVQWNQPGMTVGKTIELVKRGLERTLISSSAFWNSDEPFHFSNLISIIKIPFDFVFGSLSFITRLILSVVLIWICLNTRNGTMAAATGVVGFTLLALTTGVVG

SEQ ID NO: 15552 - protein, 483 aa, unidentified; identical to SEQ ID NO: 15224

SEQ ID NO: 15553 - protein, 665 aa, unidentified
MDYHSHTTQTGSNETLYQDPLQSQSGSRDTLDGPPSTLQHYSNPPPYSEEDQGIDGPQRSQPLSTPHQYDRYYGVNIQHTRVYNHLGTIYKGLKLAFQILGWVSVIITMIITVTTLKKMSDGNSQDSAMLKSLDENFDAIQEVANLLDNEVRPKLGVTMTQTTFQLPKELSEIKRYLLRLERNCPVCGTEATPQGSKGNASGDTAFCPPCLTRQCSEDSTHDQGPGVEGTSRNHKGKINFPHILQSDDCGRSDNLIVYSINLVPGLSFIQLPSGTKHCIIDVSYTFSDTLAGYLIVGGVDGCQLHNKAIIYLSLGYYKTKMIYPPDYIAIATYTYDLVPNLRDCSIAVNQTSLAAICTSKKTKENQDFSTSGVHPFYIFTLNTDGIFTVTVIEQSQLKLDYQYAALYPATGPGIFIGDHLVFLMWGGLMTKAEGDAYCQASGCNDAHRTSCNIAQMPSAYGHRQLVNGLLMLPIKELGSHLIQPSLETISPKINWAGGHGRLYYNWEINTTYIYIEGKTWRSRPNLGIISWSKPLSIRWIDHSVARRPGARPCDSANDCPEDCLVGGYYDMFPMSSDYKTAITIIPTHHQWPSSPALKLFNTNREVRVVMILRPPNNVKKTTISCIRIMQTNWCLGFIIFKEGNNAWGQIYSYIYQVESTCPNTK

SEQ ID NO: 15554 - protein, 582 aa, unidentified; identical to SEQ ID NO: 8729

SEQ ID NO: 15555 - protein, 484 aa, unidentified; identical to SEQ ID NO: 15280

SEQ ID NO: 15556 - protein, 572 aa, unidentified
MEYWKHTNSINNTNNETETARGKHSSKVTNIIMYTFWTITLTILSVIFIMILTNLIQENNHNKLMLQEIRKEFAAIDTKIQRTSDDIGTSIQSGINTRLLTIQSHVQNYIPLSLTQQMSDLRKFINDLTNKREHQEVPIQRMTHDRGIEPLNPNKFWRCTSGNPSLTSSPKIRLIPGPGLLATSTTVNGCIRIPSLVINHLIYAYTSNLITQGCQDIGKSYQVLQIGIITINSDLVPDLNPRVTHTFNIDDNRRSCSLALLNTDVYQLCSTPKVDERSDYASTGIEDIVLDIVTNNGLIITTRFTNNNITFDKPYAALYPSVGPGIYYKDKVIFLGYGGLEHEENGDVICNTTGCPGKTQRDCNQASYSPWFSNRRMVNSIIVVDKGIDATFSLRVWTIPMSQNYWGSEGRLLLLGDRIYIYTRSTSWHSKLQLGVIDISDYTNIRINWTWHNVLSRPGNDECPWGHSCPDGCITGVYTDAYPLNPSGSVVSSVILDSQKSRENPIITYSTATNRINELAIYNRTLPAAYTTTNCITHYDKGYCFHIVEINHRSLNTFQPMLFKTEVPKNCS

SEQ ID NO: 15557 - protein, 423 aa, unidentified; identical to SEQ ID NO: 9151

SEQ ID NO: 15558 - protein, 501 aa, unidentified; identical to SEQ ID NO: 8222

SEQ ID NO: 15559 - protein, 244 aa, unidentified
DTAGWDTRVTQADLEDERELLHFMEGEHKRLAEAIFKLTYENKVALCPRPGSKGGTVMDVISRKDQRGSGQVVTYALNTLTNIKVQLVRMAESEGILTPELEDLGIEQWLKQNGEDRLSRLLVSGDDCVVNALDERFGRALTWLNTMEKTREDIEAWKPSRAYRTWQEVEFCSHHFHELFLRDGRKLIVPCRDQHELVGRSMVSQGGSSGVAGTACLAKAYAQMWLMSYFHRRDLRTLGFGIMS

SEQ ID NO: 15560 - protein, 512 aa, unidentified
MTLPNMKPKRIVLFLVFLNAWVSNAQVTHKPRPDSIVEYSEEWENPIYTTPSHCFEDTFAPVKPEKLRCPHIFDDQNLGLTASKAKILHMDLKPEDTHFEAKGRLLHKVTYQVLCSTGFFGGRTVTRKVLETPMGDNEAQAYKAVDREFPYFPEPLCFWLRDNVAAERVFHFSTPKTVTVDLYSRKYISPDFVGGQCAKSPCPTHWPNVYWVGETQSPECPSIDTEGGHIFTKKDTHRITKAVVHGHHPWGLTKACQIQFCNEQWIRTDLGDLIRIEPNDGTSSLTLPKCQDNVVQMRGNLDDFSYLNHAIVNMAQRSECLEAHSSIVAQQKVSPYLLSKFRPPHPGLGKAHYLQNNTIMRGDCIYEGVAEISENRTTYRNLKGEWKKWSLSRGGEGYDGMTVGTKIVIPDLEKYQSIYDNGMFIPKLLGEVPHPSIVITYNQTDSIETGIFTDGKLLNMGVNWTLWPSLSGISLFTVASLILIWYCCCRVTPQALNYSIPMHTITSRGVEI

SEQ ID NO: 15561 - protein, 421 aa, unidentified
TDDFTLTSPYLGHCPYCLHATPCFSPIKIENVWDESDDGTIRIQVSAQLGYNQAGTADPTKFRYMSYEQDHDIKEASMDKIAISTSGPCSRLGHKGYFLLARCPPGDSVTVSITSGASATSCTVEKKIRRKFVGREEYLLPPVHGKLIKCHVYDHLKETTAGYITMHRPGPHAYATYVEESSGEVYIRPPSGKNVTYECKCGDYSTGTVNTRTKMPGCTKKKQCIAYKSDQTKWVFNSPDLIRHSDHAVQGKLHIPFKLTATACPVPLAHTPTVEKWFKGVTLHLTASHPTLLTTRKLGPRAEPTSEWIVGTVSRNFSVGREGLEYTWGNHDPVRVWSQESAPGDPHGWPHEIIVHYYHRHPLYTIAVLCGLVLITVIGIASAAACISKARRDCLTPYALAPNAAVPTLLAVLCCIRPTHA

SEQ ID NO: 15562 - protein, 617 aa, unidentified; identical to SEQ ID NO: 8170

SEQ ID NO: 15563 - protein, 572 aa, unidentified; identical to SEQ ID NO: 8527

SEQ ID NO: 15564 - protein, 662 aa, unidentified; identical to SEQ ID NO: 8758

SEQ ID NO: 15565 - protein, 604 aa, unidentified
MMADSKLVSLNNNLSGKIKDQGKVIKNYYGTMDIKKINDGLLDSKILGAFNTVIALLGSIIIIVMNIMIIQNYTRTTDNQALIKESLQSVQQQIKALTDKIGTEIGPKVSLIDTSSTITIPANIGLLGSKISQSTSSINENVNDKCKFTLPPLKIHECNISCPNPLPFREYRPISQGVSDLVGLPNQICLQKTTSTILKPRLISYTLPINTREGVCITDPLLAVDNGFFAYSHLEKIGSCTRGIAKQRIIGVGEVLDRGDKVPSMFMTNVWTPPNPSTIHHCSSTYHEDFYYTLCAVSHVGDPILNSTSWTESLSLIRLAVRPKSDSGDYNQKYIAITKVERGKYDKVMPYGPSGIKQGDTLYFPAVGFLPRTEFQYNDSNCPIIHCKYSKAENCRLSMGVNSKSHYILRSGLLKYNLSLGGDIILQFIEIADNRLTIGSPSKIYNSLGQPVFYQASYSWDTMIKLGDVDTVDPLRVQWRNNSVISRPGQSQCPRFNVCPEVCWEGTYNDAFLIDRLNWVSAGVYLNSNQTAENPVFAVFKDNEILYQVPLAEDDTNAQKTITDCFLLENVIWCISLVEIYDTGDSVIRPKLFAVKIPAQCSES

SEQ ID NO: 15566 - protein, 258 aa, unidentified
DTAGWDTRITMADLEDEGILLDMMSGEHKKLASALFSKAYKVKVALCPRPGPKGGTLMDVISRTDQRGSGQVVTYALNTLTNIKVQLIRMAEAEGVLGATFEDFGIDRWLQEHGEDRVERMLVSGDDCVVNAIDERFGSSLNWLNAMEKVRKDIDLWKPSPSFRNWERVEFCSNHFHEMTMKDGRVIVAPCRGQTELIARGTVNQGGCVGVESTGCLAKAYAQMWLLLYFHRRDLRTLALAVMSAVPSNWIPTGRTTW

SEQ ID NO: 15567 - protein, 692 aa, unidentified
MVLIIKTLNNSIHITFHTILVLIMNIIKRAGVFIGLVYFTVLLIIYGEHIVRSYATEDCMPAGLYYYAEGAAYTNLPVCKDEPKSSYKGTELFPTSPNIDKPLRMTTNIMVHPISSTSDLGPMDVPPDMYPMYSCPNLSNSSPLPLWYGSCINSCQITSSKETMAVTVWAINSTVDIIMGYKLTTFFETKFSHVGPFGGCSISLVGSEPRSAPEALISGWRSKILSQGNIQDAAWYLYNDPECNYFSDIYSSGFFVRIDRIKLTVLIDAVGNLYLSDLVAGSYDSYDKGFATHGNNVWIWDTDRVKVDNNCYFKQTDDTYCDYDNTTGYILCKTIGVSFSSELQTQVESPCAGHLNISTDGVIYRLEGTADTPSTQDRLSSILKNNVNLGMESLISLINDVFTNIESSYCTGMCDLMEVILSNYPTATTVLETPIGPWLPITTNGHTVMTACSSDPNWVIKTPVSYCYSKKMIKVVNKDTMREAWWRIVNSYIILNETCTDENTTSFNLVKERMELRQDITYSFWRGDLIVSYPYNKSRWITYKDEKIQRSSKWFDKLLPLRYNHPITLDNITMELINHTRDIYDVHVYPSQGSTSKRPMSDVIGRVGAAGSNLIKHLVKGIGETFFWVTQHIELICDILIIIVCVVIGYYVVLKPILYITMRGREKQQPVIVMRDEGRSHLFSRSTATNAL

SEQ ID NO: 15568 - protein, 841 aa, unidentified
  VARIANT 785: note = Any amino acid
  VARIANT 786: note = Any amino acid
  VARIANT 787: note = Any amino acid
  VARIANT 788: note = Any amino acid
ATEIRKNYQHLWKGGTLLLGMLMICSAAEQLWVTVYYGVPVWKEATTTLFCASDAKAYDTEVHNVWATHACVPTDPNPQEVKLENVTENFNMWKNNMVEQMHEDIISLWDQSLKPCVELTPLCVTLNCTDLRNATNTTSSSWETMEKGEIKNCSFNITTSIRDKVQKEYALFYNLDVVPIDNASYRLISCNTSVITQACPKVSFEPIPIHYCAPAGFAILKCNDKKFNGTGPCTNVSTVQCTHGIRPVVSTQLLLNGSLAEEEIVIRSENFTNNAKTIIVQLNESVVINCTRPNNNTRKSINIGPGRALYTTGEIIGDIRQAHCNLSKTQWENTLEQIAIKLKEQFGNNKTIIFNPSSGGDPEIVTHSFNCGGEFFYCNSTQLFTWNDTRKLNNTGRNITLPCRIKQIINMWQEVGKAMYAPPIRGQIRCSSNITGLLLTRDGGKDTNGTEIFRPGGGDMRDNWRSELYKYKVVKIEPLGVAPTKAKRRVVQREKRAVGLGALFLGFLGAAGSTMGAASITLTVQARQLLSGIVQQQNNLLRAIEAQQHLLQLTVWGIKQLQARVLAVERYLRDQQLLGIWGCSGKLICTTTVPWNTSWSNKSLNEIWDNMTWMKWEREIDNYTHIIYSLIEQSQNQQEKNEQELLALDKWASLWNWFDITKWLWYIKIFIMIVGGLIGLRIVFVVLSIVNRVRQGYSPLSFQTHLPAQRGPDRPDGIEEEGGERDRDRSGPLVDGSLALIWDDLRSLCLFSYHRLRDLLLIVTRIVELLGRRGWEALKYWWNLXXXXSQELKNSAVNLLNATAIAVAEGTDRVIEVLQAAYRAIRHIPRRIRQGLERILL

SEQ ID NO: 15569 - protein, 866 aa, unidentified; identical to SEQ ID NO: 15320

SEQ ID NO: 15570 - protein, 575 aa, unidentified; identical to SEQ ID NO: 8816
  VARIANT 177: note = Any amino acid
  VARIANT 178: note = Any amino acid
  VARIANT 179: note = Any amino acid
  VARIANT 180: note = Any amino acid
  VARIANT 181: note = Any amino acid
  VARIANT 182: note = Any amino acid
  VARIANT 183: note = Any amino acid
  VARIANT 184: note = Any amino acid
  VARIANT 185: note = Any amino acid
  VARIANT 186: note = Any amino acid
  VARIANT 187: note = Any amino acid
  VARIANT 188: note = Any amino acid

SEQ ID NO: 15571 - protein, 285 aa, unidentified; identical to SEQ ID NO: 8156

SEQ ID NO: 15572 - protein, 496 aa, unidentified; identical to SEQ ID NO: 8708

SEQ ID NO: 15573 - protein, 504 aa, unidentified; identical to SEQ ID NO: 8334

SEQ ID NO: 15574 - protein, 418 aa, unidentified
FTLTSPYLGHCPYCLHATPCFSPIKIENVWDESDDGTIRIQVSAQLGYNQAGTADPTKFRYMSYEQDHDIKEASMDKIAISTSGPCSRLGHKGYFLLARCPPGDSVTVSITSGASATSCTVEKKIRRKFVGREEYLLPPVHGKLIKCHVYDHLKETTAGYITMHRPGPHAYATYVEESSGEVYIRPPSGKNVTYECKCGDYSTGTVNTRTKMPGCTKKKQCIAYKSDQTKWVFNSPDLIRHSDHAVQGKLHIPFKLTATACPVPLAHTPTVEKWFKGVTLHLTASHPTLLTTRKLGPRAEPTSEWIVGTVSRNFSVGREGLEYTWGNHDPVRVWSQESAPGDPHGWPHEIIVHYYHRHPLYTIAVLCGLVLITVIGIASAAACISKARRDCLTPYALAPNAAVPTLLAVLCCIRPTHA

SEQ ID NO: 15575 - protein, 496 aa, unidentified; identical to SEQ ID NO: 8708

SEQ ID NO: 15576 - protein, 632 aa, unidentified
MSHIMNLLVISFVLAGSSWSLLGYQDDFSSKRSGALASNPTYNLPQDKGYGRDMYQPYYICEPDNDGSALTLPSWHYSCKESCMGNHLKRVVNITGARWNYVGISIPVFKIVTNEVCYTSHENVWGYCSQYQISRPVATQKSDVSCITSSMWDNDKSPIGSLYNIVNSNEAECDYFSDITDCNRDYQIFKREGKLIKRSDDSPLELSIVTDGIRTDPASEYLSLDDVSWFWKLPNNDMSPPCGWEKTQKLSCSYTDTTDVIKCNSIGYTYNIQGISKKSTCAGNIYDTDGPFPFFYDAEEALMSTDDACGKAKQGKPDADIAFIEGVNRAFEDLELTYCSATCDLFARQGTPNEDHVLDTPIGTWRYVMRDNLDPALVPCLPTSNWTISDPTTICHGKDHILVVDTATGHSGSWDTKKDYIITGEVCNTNNDEMGDDYDGMRDKILRGETIEIKFWTGDIIRMAPPYDNPEWIKGSVLFRQNPGWFSSVELNKDMIHTRDNITDLLTVMVQNATAEVMYKRLDPKTMKHILFAEIVDGVGNVSGKISGFLTGLFGGFTKAVIIVASLAICYIVLSVLWKVRLVASIFNSAKKKRVRISDILDEEPHRIQQSRPTLSRKKKTRESIQMLLNDI

SEQ ID NO: 15577 - protein, 503 aa, unidentified
MQPSMSFLIGFGTLVLALSVQTFDLQGLSCNTDSTPGLIDLEIRRLCHTPTENVISCEVSYLNHTTISLPAVHTSCLKYHCKTYWGFFGSYSADRIINRYTGTVKGCLNNSAPEDPFECNWFYCCSAITTEICRCSITNVTVAVQTFPPFMYCSFADCSTVSQQELESGKAMLSDGSTLTYTPYILQSEVVNKTLNGTILCNSSSKIVSFDEFRRSYSLANGSYQSSSINVTCVNYTSSCRSRLKRRRRDTQQIEYLVHKLRPTLKDAWEDCEILQSLLLGVFGTGIASASQFLRGWLNHPDIIGYIVNGVGVVWQCHRVNVTFMAWNESTYYPPVDYNGRKYFLNDEGRLQTNTPEARPGLKRVMWFGRYFLGTVGSGVKPRRIRYNKTSHDYHLEEFEASLNMTPQTSIASGHETDPINHAYGTQADLLPYTRSSNITSTDTGSGWVHIGLPSFASLNPLGWLRDLLAWAAWLGGVLYLISLCVSLPASFARRRRLGRWQE

SEQ ID NO: 15578 - protein, 524 aa, unidentified
MVPQALLFVPLLVFPLCFGKFPIYTIPDKLGPWSPIDIHHLSCPNNLVVEDEGCTNLSGFSYMELKVGYISAIKMNGFTCTGVVTEAETYTNFVGYVTTTFKRKHFRPTPDACRAAYNWKMAGDPRYEESLHNPYPDYHWLRTVKTTKESLVIISPSVADLDPYDRSLHSRVFPGGNCSGVAVSSTYCSTNHDYTIWMPENPRLGMSCDIFTNSRGKRASKGSETCGFVDERGLYKSLKGACKLKLCGVLGLRLMDGTWVAMQTSNETKWCPPGQLVNLHDFRSDEIEHLVVEELVKKREECLDALESIMTTKSVSFRRLSHLRKLVPGFGKAYTIFNKTLMEADAHYKSVRTWNEIIPSKGCLRVGGRCHPHVNGVFFNGIILGPDGNVLIPEMQSSLLQQHMELLVSSVIPLMHPLADPSTVFKNGDEAEDFVEVHLPDVHERISGVDLGLPNWGKYVLLSAGALTALMLIIFLMTCWRRVNRSEPTQHNLRGTGREVSVTPQSGKIISSWESYKSGGETGL

SEQ ID NO: 15579 - protein, 416 aa, unidentified; identical to SEQ ID NO: 8502

SEQ ID NO: 15580 - protein, 423 aa, unidentified; identical to SEQ ID NO: 15457

SEQ ID NO: 15581 - protein, 501 aa, unidentified; identical to SEQ ID NO: 8222

SEQ ID NO: 15582 - protein, 430 aa, unidentified; identical to SEQ ID NO: 8534

SEQ ID NO: 15583 - protein, 495 aa, unidentified
MGQFISFMQEIPIFLQEALNIALVAVSLICIVKGLVNLYRCGLFQLMVFLVLAGRSCSEETFKIGMHTKFQEVSLSLSALLTNQSHELPMLCLANKTHLYLKSGRSSFKINIDSVTVLTRSEVNLTSINLTRSIDVFVHSPKLGSCFESDEEWVVAWWIEAIGHRWDQDPGLLCRNKTKTEGKLIQINISRADGNVHYGWRLKNGLDHIYRGREEPCFEGEQCLIKIQPEDWPTDCKADHTNTFRFLSRSQKSIAVGRTLKAFFSWSLTDPLGNEAPGGYCLEKWMLVASELKCFGNTAIAKCNQNHDSEFCDMLRLFDYNKNAIKTLNEETKTRVNVLSHTINALISDNLLMKNKIRELMSVPYCNYTRFWYVNHTLSGQHSLPRCWMIRNNSYLNSSEFRNEWILESDFLISEMLGKEYSERQGRTPITLVDICFWSTVFFTSTLFLHLIGFPTHEHIRGEGCPLPHRLNSMGGCRCGKYLPLKKPTIWHRRH

SEQ ID NO: 15584 - protein, 501 aa, unidentified; identical to SEQ ID NO: 8222

SEQ ID NO: 15585 - protein, 248 aa, unidentified; identical to SEQ ID NO: 8593

SEQ ID NO: 15586 - protein, 504 aa, unidentified; identical to SEQ ID NO: 8334

SEQ ID NO: 15587 - protein, 504 aa, unidentified; identical to SEQ ID NO: 8334

SEQ ID NO: 15588 - protein, 416 aa, unidentified; identical to SEQ ID NO: 8502

SEQ ID NO: 15589 - protein, 491 aa, unidentified; identical to SEQ ID NO: 15514

SEQ ID NO: 15590 - protein, 495 aa, unidentified; identical to SEQ ID NO: 8710

SEQ ID NO: 15591 - protein, 423 aa, unidentified; identical to SEQ ID NO: 15226

SEQ ID NO: 15592 - protein, 136 aa, unidentified
LEESLTSLSEVVLQNRRGLDLLFLKEGGLCAALKEECCFYVDHSGVIKDSMAKLRERLDIRQRERESKQGWFESWFNKSPWLTTLLSTIAGPLIILLLLLTFGPCILNKLVAFIRERINAVQVMVLKQQYQVFQEA

SEQ ID NO: 15593 - protein, 420 aa, unidentified; identical to SEQ ID NO: 9042

SEQ ID NO: 15594 - protein, 571 aa, unidentified
  VARIANT 407: note = Any amino acid
  VARIANT 408: note = Any amino acid
  VARIANT 409: note = Any amino acid
  VARIANT 410: note = Any amino acid
  VARIANT 411: note = Any amino acid
  VARIANT 412: note = Any amino acid
  VARIANT 413: note = Any amino acid
  VARIANT 414: note = Any amino acid
MEDYSNLSLKSIPKRTCRIIFRTATILGICTLIVLCSSILHEIIHLDVSSGLMDSDDSQQGIIQPIIESLKSLIALANQILYNVAIIIPLKIDSIETVIFSALKDMHTGSMSNTNCTPGNLLLHDAAYINGINKFLVLKSYNGTPKYGPLLNIPSFIPSATSPNGCTRIPSFSLIKTHWCYTHNVMLGDCLDFTTSNQYLAMGIIQQSAAAFPIFRTMKTIYLSDGINRKSCSVTAIPGGCVLYCYVATRSEKEDYATTDLAELRLAFYYYNDTFIERVISLPNTTGQWATINPAVGSGIYHLGFILFPVYGGLISGTPSYNKQSSRYFIPKHPNITCAGNSSEQAAAARSSYVIRYHSNRLIQSAVLICPLSDMHTARCNLVMFNNSQVMMGAEGRLYVIDNNLYXXXXXXXXWSASLFYRINTDFSKGIPPIIEAQWVPSYQVPRPGVMPCNATSFCPANCITGVYADVWPLNDPEPTSQNALNPNYRFAGAFLRNESNRTNPTFYTASASALLNTTGFNNTNHKAAYTSSTCFKNTGTQKIYCLIIIEMGSSLLGEFQIIPFLRELIP

SEQ ID NO: 15595 - protein, 410 aa, unidentified
HFTQYKLARPYIADCSNCGHGRCDSPIAIEDIRGDAHAGYIRIQTSAMFGLKSDGVDLAYMSFMNGKTLKAIKIEHLYARTSAPCSLVSYHGYYILAQCPPGDTVTVGFQDGANKHMCTIAHKVEFKPVGREKYRHPPEHGVELPCTKYTHKRADQGHYVEMHQPGLVADHSLLSMSSTKVKITVPSGSQVKYYCKCPDVKEGTTGSDYTTACTNLKQCRAYLIDNKKWVYNSGKLPRGEGETFKGKLHVPFVPVTSKCTATLAPEPLVEHKHRSLILHLHPEHPTLLTTRALGSNARPTRQWIEQPTTVNFTVTGEGFEYTWGNHPPKRVWAQESGEGNPHGWPHEIVIYYYNRYPMTTVIGLCTCVAIIMVSCVTSVWLLCRTRNLCITPYRLAPNAQVPILLAVLCC

SEQ ID NO: 15596 - protein, 337 aa, unidentified; identical to SEQ ID NO: 10217

SEQ ID NO: 15597 - protein, 329 aa, unidentified
MRNPGLGCLTWTGQLNGMGRFQIQLFRNLTLISVCLGSDHHKGITDYCCGPASCYTIVWEISAEVLATGTPYLFRAQPHHRPLQTPAPWSKRLIRTRYIRNSVEDQFVHFATEANYTPLSAQALSIKAIRWHKGQLACEGTPRIGQAGIPETIYAGIKAYGWFIPGKKERVSWNEDPETKNIAIPSSTEVQEWFPMEDVDDRAREPLDGSETHQEIAEFACAMLPPGWCIVRPEGRTYISTGPDTSDEEEDKALAPKILKTHPSICPKHPRHHKIGGRFVSDLLDSPSSSDDEEEARQNLARVLEAALPHPGEDSSDDDPLYLGEPERD

SEQ ID NO: 15598 - protein, 313 aa, unidentified
MAWDNPQNVVTRLVNLGESWKKYLLSPGWKDCGERDLTMLTRELLVPGIGLVQIAATLTKTYVLMCNGRCITGSRTDPDCDPLFCKLLCWKQNIQDPRECNLEEWCLYSLDPEHDPLWDPKMIVRRHRNLLPYCMRPFLIWMNYISHNPLTQQCIMMKTLNMLWRAQADDPSDVASLYPRVKVFKASHFDIFGSASGNSEERVSWAKENSHRGEYSLLPSSDDEEEEMSEREELLCHINQCQQKLFYPGGTTDVLGMESNVWLTKFVNIKFPKGTKVILPDGRKFIACDPELKPLLQELKFLDRATSESSDSE

SEQ ID NO: 15599 - protein, 313 aa, unidentified
MAWDNPQNVVTRLVNLGDPWKKYLLSPGWKDCGERDLTMLTRELLVPGIGLIQVAATAAETYVLMCNGRCITGSRTDPDCDPLFCKLLCWKQNIRDPRECNLEEWCLYSLDPEHDPLWDPKMTVRRHRNLLPYCMRPFLIWMNYISHNPLTQQCIMMKTLNMLWRAQADDPSDVASLHPRVKVFKASHFDIFGSASGNREERVSWAKENSHRGEYSLLPSSDDEEEEMSEREELLCHINQCQQKLFYPGGTTDILGMESNNWLTKFVNTKFPKGTKVILPDGRKFIACDPELKPLLQELKFLDRATSESSDSE

SEQ ID NO: 15600 - protein, 321 aa, unidentified
MMLSPQPWQFQCLVDKYGKKCIMTYFWMPPLGQVTIRLYNNLTVITICQGLDPFVNLNDCGSNLDESDCSEPDVFCCGPLCYKLCYEGHALSFDKLRCWLLHLKGGHPDGASNFTKNDMRVLQLGKVNPYGEKGDPMTQYAYQVKRGVQTIGLSPRALCVKGLRFQQELLCDLRNPRIGEGYMPKGYHAALEKYGPRNGCREERVLWIDNKLITGLEDYYNETGEDYLWRAQQDRTPPWKQPWHEEHTGMKLSSFSTPSDVQEFVDKMLPPGWKVITPQGIEKTSRRKIRTKEMTLEEKQGKWLRKYGEGNIGSGSDSDSD

SEQ ID NO: 15601 - protein, 356 aa, unidentified
MSHVLPVVTPWPMSQDHYAPTLFGILDRYYQGYLKSPATYQTWKFTCQVDPSGKRFMGTQFWVPPLGQVNIQFYKNYQILTCCQAVDPFANIFHGTDEEMFDIDSGPDVWCSPSLCFKVIYEGAMGQKQEQKTWLCRLGHGHRMGACDYRKVDLYAMRQGKENPYGDRGDAALQYAYQVKRGCKAGCLASPVLNYKALQFHRTIMADFTNPRIGKGHLAHGYQAAMEAYGPQRGRNEERVWWNATRNQGKQGGEYYREGGEEPHYPNTPAPHRRTWDERHKVLKLSSFATPSDIQRWATKALPYGWKVVTESGNDYTSRRKIRTLTEMTQDEIRKRWESGYCDPFIDSGSDSDGPF

SEQ ID NO: 15602 - protein, 268 aa, unidentified
MTFIICQKYTAIVICGGDDGLQTEPNLFACSSTTCALIIWDCFIGCKKDTRPWVQSLRKYHELDSRSPSIRHQSNLQALLPPVYGEPGICCLQEYRKFLDTVTGNMLTPHVIRTKCTNWMTGLHLGEELLAHEGKLPITYCRAIHEYGNPQDSIEERVLWENQHKNYPYYDPSCPMDLLDEALAKEDEGIWTGPVPRVTKCMTPTGLQWWANRALPKGYQLVTPRGIKITSRRSKFHPLDVTEEDFCTPQAHEWDPDNETGTDSESED

SEQ ID NO: 15603 - protein, 379 aa, unidentified
MHHAAISTITPIITVNDLTFASQEEIQACGGVQGKGDYYEIPVKSLYIPVLSPTPLSGHSLRQVICTLWRLYQSYYNQNCKPVPPLRWRERRRGNWQSETLPIPPLGCVTWLAWEDTTVIIICGGDDGFKITEEGQCCSSTTCAMIVYPCKITSNQLCNPFIRSLRCRHPFSFECIPLRHENSLRDLYKPPVYEERGKDVKWEYRKDVVEYYSGNALTPDVIRWKSTKFQKVLHVIEKLSFTEGRLPMSYARAKEEWGSPKGRSGERVLWTKKYKKDYYDPDFPFDELDEEQEWETESWFSMIPRLTKSSTGETIQSWLSQAVPAGFKLTRPNGDKYVSKRSVFHPLDIEKKDRWNPRAYDWCMCNESDPSGEDSDEYQ

SEQ ID NO: 15604 - protein, 355 aa, unidentified
MSPVLPVVTPWPFSQDHYAPTLYGILLQYYKYSQNNEKIPRVWQFTCLEDPSGKRYMGTRIWVPPLGQVTIQFYKNFVVLTVCQAVDPWANWFHGSEEEMYDIESEPDVWCSAALCFKVIYEGNINQKQEMKSWLCRLGHGHKDGVSEFKRVDLFAMRKGKVNPYKDKGDPWLQYAYQVKRETKAANLSDQALGWKALNFHRALMCDLTNARIGEGHVANGYHMAIEAYGPQRGSSEERVWWKTTSTLGKDEEYYRSEGEEECFPNSPAPHRRTWTERHKVLALSPFATPSDIQKWVTRALPYKWKVITSDGDDYVSMRTVKTLKELTQDEIKCRWEKGNSNPFYDSGSDSDGPF

SEQ ID NO: 15605 - protein, 376 aa, unidentified
MTQSALDLTHSFPTLVQNLCYASQEEIQATAGAKGKGKYLEVDPPQYCLPILSPTPLSGRNLRECIQAIWGLYQSWYKHCKVNVPDLKWRRTKTGVLCSETLPVPPLGSVTLLAWKDTTIMIICAGDDGFHTNEEGEVCSSTGCAQIIWPCKVTNQGDCQPYIYRLKRRHPLCYENNSLRHETSLQNLPICPYGEKGQCPLWEYRKDILSYFSGNPLTPEVLKKKCGDFAFSLYLVERLNLKDGQLPKSYFRAKLAWGSPKGSLVERVLWNKENKVPYYDPGYPFDEEDEGQGELDFDSCFSILPRITKTNTKETLQLWINKAVPAGFKLVTPDGSIIESKRSKFHPLDIENEENPKCPYCPLDHAGYTSSESDDA

SEQ ID NO: 15606 - protein, 376 aa, unidentified
MTQSALDLTHSFLTLVQSLCYASQEEIQATAGAKGKGKYLEVDPPQYCLPILSPTPLSGRNLRECIQAVWGLYQSWYKRCKVNVPDLRWRRSKTGVLCSETLPVPPLGSVTFLAWKDTTIMIVCSGDDGFHANEEGEVCSSTGCAQIIWPCKINSQGDCQPYIYRLRRRHPLCYESNSLRHETSLQNLPICPYGEKGQCPLWEYRKDVLSYFSGNPLTPEVLKKKCGEFTFSLYLVERLNLKEGSLPNSYFRAKLAWGSPKGSLVERVLWGKENKAPYYDPGYPFDEEDEGQAELDFDSCFSILPRITKTNTKETIQTWLNKAVPAGFKLMTPDGSVIESKRSKFHPLDVENEDNPKCPYCPLDHAGYTSSESDDE

SEQ ID NO: 15607 - protein, 481 aa, unidentified
MDSYQEEESVASTSGIQNLQTLSELVGPENAGEGELVIAEEPEENPRRPKRYTKREVKCVSYHAYRELEEKHPQHIKLQDWIPTPEEMITQKVQNQDLGTILSFDVTCLKSITSLGRNDPGNDPSIMSHVLPVVTPWPMSQDHYAPTLFGILDHYYKEYLKNPATFQTWKFTCQVDPSGKRFMGTQFWVPPLGQVNIQFYKNYQILTCCQAVDPFANIFHGTDDEMYDIDSGPDVWCTPSLCFKVIYEGAMSQKQEQKSWLCRLGHGHRMGAYEYRKIDLYAMKKGKENPYGERGDVALQYAYQVKRGCKAGCLASQVLNFKALQFHRTLMADLTNPRIGEGHLPHGYQAAMEAYGPQRGSSEERVWWNATRNQGRDGEYYREGGEEPHYPNTPAPHKKTWDERHKVLKLSSFATPSDIQRWATRALPYGWKVVTEAGDDYTSRRKIRTLTDMTQDEIRQRWERGYCDPFIDSGSDSDGPL

SEQ ID NO: 15608 - protein, 500 aa, unidentified
MATWEEKKELTHLHQEGDDPLTELSILLDLDNMDPNEGPDQNPGGEKIHLQLSNTPGNTSEKTYQFGFMDKEEQDPDLKMRDWVPEPDKMILENLSSPELGLILSDDIEKCKSSLRLGPNAPDGVWPLANGPILPVITPWPLCQDHAAPSVRTILEAYWKGYKEQDLEPPKWLWLCQEDLSGNKCTMTQFLVPPLGQVTIRLFKNATVVNICQSVDPWENENPMGGRAGPVYRYECRIPCDPAYCFKVIWEGNIWDKPDQACWLIHLKEGHKFGANELSQSDIKLLEQSRPYPYGRIGECPKLQYAVQVKMRTAKAPLSSKVRAIKALNFHRWNICQPENPGIGEGFSPSGYTQALKAYGPQRGSVEERVWLTATKMIKPQEDAYWKDYWKYGYFPLVPNKQDPGWTRHLTKFKISRFSTPADIQKITDELLPKGACIMTTDGTKYISTRKVHLVNEGTLEEYKARCKEIEEKYGGHLSSDSDDYSEDTPATETTEVEED

SEQ ID NO: 15609 - protein, 497 aa, unidentified
MASWEDQEELRELLHHLPEDDPPADLSHLLNLDEMEPKVLGGQNPGDEKLRQQVIKPPSIHPSTVTWHFGYKDKEDQQPEIKMRDWVPDPSKMSKSTCMRLILSSKELGSQSVALILAEDMKHSESILQLGNGAPRKGFPLTSSPLLPVVTPWPLSQDHVAPTLYSLLVAYYKSFQNQKLEPPKWLWQCLEDPSGRKCMVTQFLVPPLGQVMISCYRNLTSIIICQAVDPWENNNEIDWKKDPMARPRIRCDHALCFKVVYEGTPWRPHDQKCWFIRLTEGHKHGMEELSSGDWKTLQESRPYPYGPVGEDPNLQYAVSVKMKVTGGPLTSTVLALKALCFHRVNICNMDNPGLGEGHPPLGYSHALKAYGPQYGSCEERVWQAATKCIGPGEGDYWCEYDHRGYFPIIPNKLSPTWVRHAAPYGIQRLATPYDLQMFANELLPPGFSINTPSGACYISSRRLHYGNEGTLQEYQENCDRIKRGYEDISSSDSSDED

SEQ ID NO: 15610 - protein, 403 aa, unidentified
MNDAYLPFLASKELGSQSVALILAEDMKHSESILQLGNGAPRKGFPLTSSPLLPVVTPWPLSQDHVAPTLYSLLVAYYKSFQNQKLEPPKWLWQCLEDPSGRKCMVTQFLVPPLGQVMISCYRNLTSIIICQAVDPWENNNETDWKRDPMARPRIRCDHALCFKVVYEGTPWRTHDQKSWLIRLTEGHKHGMEELSPGDWKILQESRPYPYGPVGEDPNLQYAVSVKMKVTGGPLTSTVLALKALCFHRVNICNMDNPGLGEGHPPLGYSHALKAYGPQYGSCEERVWQAATKCIGPGEGDYWCEYDHRGYFPIIPNKLSPTWVRHAAPYGIQRLATPYDLQMFANELLPPGYSINTPSGTCYVSNRRLHYGNEGTLQEYQENCDRIKRGYEDISSSDSSDED

SEQ ID NO: 15611 - protein, 487 aa, unidentified
MASWEAQEELRELLHHLPEDDPPADLTHLLELDEMEPKVLCGENPGDEKLKKQVIKTPPMHPSTVTWHFGYKQKEDQQDNIKMRDWVPDPSKMTSKELDSQNVAVILADDMKHSESILQLGSGAPRKGFPLTSSPLLPMVTPWPFSQDHAAPTLYSLLVAYYKSFQSQKLDPPKWLWQCLGDPSGRKCMVTQFLLPPLGQVRISCYRNLTSIVICQAVDPWENNNEADWRKNPMARPRIKCDHALCFKVVYEGTLWRPHDQKCWLIRLTEGHKYGMEELSPGDWKILQESRPYPYGPIGEDPNLQYAVGVKMKVIGGPLTSTVLALKALSFHRVNICNMDNPSLGEGHAPLGYSHALKAYGPQYGSCEERVWQTATKCIGPEEENYWCEYDHRGFFPMVPNKLSPTWVRHAAPYCIQRFATPYDLQYFANELLPPGFSITTPKGVSYTSDRRLHYGNEGTLQEYNENCDKVKRGYDEISSSDYSDED

SEQ ID NO: 15612 - protein, 480 aa, unidentified
MDTYEEEESVASTSGVQDLQTLSELVGPEAAGEGEDTLSDTEEVSRRSRKNTKRGAKMITFHAYKEIEDKNPQNLKLHNWIPTPEEMINKKVQNQDLGTILSFGVKHLKGITSLGRNDPGRDPSAMSPVLPVVTPWPFSQDHYAPTLYGILLQYYKYSQNNEKIPRVWQFTCLEDPSGKRYMGTRIWVPPLGQVTIQFYKNFVVLTVCQAVDPWANWFHGSEEEMYDIESEPDVWCSAALCFKVIYEGNINQKQEMKSWLCRLGHGHKDGVSEFKRVDLFAMRKGKVNPYKDKGDPWLQYAYQVKRETKAANLSDQALGWKALNFHRALMCDLTNARIGEGHVANGYHMAIEAYGPQRGSSEERVWWKTTSTLGKDEEYYRSEGEEECFPNSPAPHRRTWTERHKVLALSPFATPSDIQKWVTRALPYKWKVITSDGDDYVSMRTVKTLKELTQDEIKCRWEKGNSNPFYDSGSDSDGPF

SEQ ID NO: 15613 - protein, 482 aa, unidentified
MDSYEKEESVASTSGIQDLQTLSELVGPENAGEGELTIAEEPEENPRRPRRYTKREVKCVSYHAYKEIEDKHPQHIKLQDWIPTPEEMIAQKVQNQDLGTILSFDVTCLKSITSLGRNDPGDDPSIMSHVLPVVTPWPMSQDHYAPTLFGILDRYYQGYLKSPATYQTWKFTCQVDPSGKRFMGTQFWVPPLGQVNIQFYKNYQILTCCQAVDPFANIFHGTDEEMFDIDSGPDVWCSPSLCFKVIYEGAMGQKQEQKTWLCRLGHGHRMGACDYRKVDLYAMRQGKENPYGDRGDAALQYAYQVKRGCKAGCLASPVLNYKALQFHRTIMADFTNPRIGEGHLAHGYQAAMEAYGPQRGSNEERVWWNATRNQGKQGGEYYREGGEEPHYPNTPAPHRRTWDERHKVLKLSSFATPSDIQRWATKALPYGWKVVTESGNDYTSRRKIRTLTEMTQDEIRKRWESGYCDPFIDSGSDSDGPF

SEQ ID NO: 15614 - protein, 485 aa, unidentified; identical to SEQ ID NO: 15551

SEQ ID NO: 15615 - protein, 501 aa, unidentified; identical to SEQ ID NO: 8222

SEQ ID NO: 15616 - protein, 482 aa, unidentified; identical to SEQ ID NO: 15383

SEQ ID NO: 15617 - protein, 484 aa, unidentified; identical to SEQ ID NO: 15538

SEQ ID NO: 15618 - protein, 484 aa, unidentified; identical to SEQ ID NO: 15280

SEQ ID NO: 15619 - protein, 504 aa, unidentified; identical to SEQ ID NO: 8334

SEQ ID NO: 15620 - protein, 430 aa, unidentified; identical to SEQ ID NO: 8534

SEQ ID NO: 15621 - protein, 499 aa, unidentified; identical to SEQ ID NO: 15424

SEQ ID NO: 15622 - protein, 501 aa, unidentified; identical to SEQ ID NO: 15454

SEQ ID NO: 15623 - protein, 431 aa, unidentified; identical to SEQ ID NO: 15277

SEQ ID NO: 15624 - protein, 432 aa, unidentified; identical to SEQ ID NO: 15533

SEQ ID NO: 15625 - protein, 429 aa, unidentified; identical to SEQ ID NO: 15209

SEQ ID NO: 15626 - protein, 431 aa, unidentified; identical to SEQ ID NO: 15377

SEQ ID NO: 15627 - protein, 496 aa, unidentified; identical to SEQ ID NO: 8708

SEQ ID NO: 15628 - protein, 505 aa, unidentified; identical to SEQ ID NO: 15354

SEQ ID NO: 15629 - protein, 502 aa, unidentified; identical to SEQ ID NO: 15540

SEQ ID NO: 15630 - protein, 442 aa, unidentified
YEHATTMPSQVGIPFNTIVNRAGYAPLAISITPTKIQIIPTLNLEYITCHYKTGLDSPAVKCCGTQECSEVTRPDEKCKVFTGVYPFMWGGAYCFCDTENSQVSKAYVMKSDDCAADHAQAYKAHTAAAQAFLNITVADQSTTTIVYVNGETPVNFNGIRLTAGPLSTAWTPFDRKIVQYAEEVYNYDFPEYGAGTAGAFGDIQARTTTSTDLYANTNLVLQRPKSGTVHVPYTQAPSGFEQWKKDKPPSLKYTAPFGCEIKVNPIRAENCAVGSIPLSFDIPDALFTRVSETPTLSNAECTLNECVYSSDFGGIASVKYSATKAGKCAVHIPSGTATVREATVDLVEQGSLTVHFSTANIHPEFRLQICTTYVTCKGDCHPPKDHIVTHPQYHAQTFTAAVSKTAWTWITSLLGGSAVLVVIGLILAIIVATYVLTGQRRY

SEQ ID NO: 15631 - protein, 442 aa, unidentified
YEHATTMPNQAGISYNTIVNRAGYAPLPISITPTKIKLIPTVNLEYVTCHYKTGMDSPTIKCCGSQECTPTYRPDEQCKVFAGVYPFMWGGAYCFCDTENTQISKAYVMKSEDCLADHAAAYKAHTASVQALLNITVGEHSTVTTVYVNGETPVNFNGVKLTAGPLSTAWTPFDRKIVQYAGEIYNYDFPEYGAGQPGAFGDIQLRTVSSSDLYANTNLVLQRPKAGAIHVPYTQAPSGFEQWKKDKAPSLKFTAPFGCEIYTNPIRAENCAVGSIPLAFDIPDALFTRVSETPTLSAAECTLNECVYSSDFGGIATVKYSASKSGKCAVHVPSGTATLKEASVELAEQGSVTIHFSTANIHPEFRLQICTSFVTCKGDCHPPKDHIVTHPQYHAQTFTAAVSKTAWTWLTSLLGGSAVIIIIGLVLATLVAMYVLTNQKHN

SEQ ID NO: 15632 - protein, 439 aa, unidentified
YEHATTVPNVPGVPYKALVERAGYAPLNLEVTVVSSELIPSTNKEYVTCKFHTIIPSPQVKCCGSLECQASRKADYTCRVFGGVYPFMWGGAQCFCDSENTQLSEAYVEFAPDCTADHAVALKVHTAALKVGLQIVYGNTSTRLDTFVNGVTPGSSRDLKVIAGPISAAFTPFDHKVVIRKGKVYNYDFPEYGAMKPGVFGDIQASSLDSTDIVARTDIRLLKPSVKSIHVPYTQAASGYEMWKNNSGRPLQDTAPFGCKIEVDPLRAVDCAYGHIPLSIDIPDAAFVRTSEAPTVLEMSCTVTACIYSADFGGSLTLQYKADKEGNCPAHSHSSTAVLKEATTHVVHSGSVTLHFSTSSPQANFIVSLCGKKTTCDAECKPPSDHIIGEPHKVNQEFQAAVSKTSWNWLFAMLGGASSLIVVGLLVLACSSMIINTRR

SEQ ID NO: 15633 - protein, 441 aa, unidentified
YEHTAVMPNKVGIPYKALVERPGYAPVHLQIQLVTTKIIPSANLEYITCKYKTKVPSPVVKCCGSTQCSAKSHPDYQCQVFTGVYPFMWGGAYCFCDTENTQMSEVYIERAEECSVDQAKAYKVHTGTVQAVVNITYGSVSWRSADVYVNGETPAKIGDAKLTIGPLSSAWSPFDSKVVVYGHEVYNYDFPEYGTGKAGSFGDLQSRTPTSNDLYANTNLKLQRPQPGVVHTPYTQAPSGFERWKKDRGAPLNDIAPFGCTIALDPLRAENCAVGNIPLSIDIPDAAFTRIAETPTVSDLECKVTECTYASDFGGIATISYKASKSGNCPIHSPSGIAVIKENDVTLADSGAFTFHFSTASIHPAFKMQVCTSVVTCKGDCKPPKDHIVDYPAQHTETYTSAVSATAWSWLKVLVGSTSAFIVLGLIATAVVALVLFTHRH

SEQ ID NO: 15634 - protein, 442 aa, unidentified
FEHATTMPNQVGMPFNTIVNRPGYAPLAISVTPTKVQLVPTLNLEYITCHYKTGLDSPAINCCGTQECSPATRPDEHCKVFTGVYPFMWGGAYCFCDTENTQVSKAYVMKSDDCTQNYASAYKAHTASVQAQLNVTVGDHFTTATIYVNGETPINFNGVKLVAGPLSTAWSPFDRKIVQYAGEVYNYDFPEYGAGHPGAFGDIQARTTSSADLYANTNLVLQRPKSGSIHVPYTQAPSGFSQWVKDKPPSLKYTAPFGCEVHVNPVRAENCAVGSIPLSFDIPDALFTRVSETPTLSTAECTLNECVYSSDFGGIATVKYAASKTGKCAVHIPSGTATLRESIVEITPEGTQTFHFSTASIHPDFKIQICTTMVHCSGDCHPPKDHIVTQPQRHVQTYTAAVSKTAWTWLTSLLGGSALIIIIGLVLATLVAMYVLTNQKHN

SEQ ID NO: 15635 - protein, 442 aa, unidentified
YEHATTMPNQVGIPYNTVVNRAGYAPLAISIIPTKIRLIPTLNLEYITCHYKTGLDSPFIKCCGTQECPKVNRPDEQCKVFTGVYPFMWGGAYCFCDSENTQISRAYVMKSDDCSADHALAYKAHTASVQAFLNITVGEQSTTAVVYVNGETPVNFNGIKLVAGPLSTAWTPFDRKVVQYAGEIYNYDFPEYGAGHAGAFGDLQARTITSNDLYANTNLVLQRPNTGTIHVPYTQAPSGFEQWKKDKPPSLKYTAPFGCEIHVNPVRAENCAVGFIPLAFDIPDALFTRVSETPTLSSAECSLNECTYSTDFGGIATVKYSASKSGKCAVHVPSGTATLKESLVEVVEQGSMTLHFSTASIHPEFKLQICTKVLTCKGDCHPPKDHIVTHPQHHAQTFTAAVSKTAWTWLTSLLGGSAVIIIIGLVLATVVAMYVLTNQKHN

SEQ ID NO: 15636 - protein, 441 aa, unidentified
YEHATTMPNQVGIPYNTIVNRAGYAPLAISVTPTKVKLIPTLNLEYITCHYKTGLDSPAINCCGSQECTAARRPDEQCQVFTGVYPFMWGGAYCFCDSENTQVSRAYVMRSDDCASDHAAAYKAHTASVQAFLNVTVGGRFTTVAVYVNGETPIDFNGVKMTAGPLSTAWTPFDRKIVQYAGEVYNYDFPEYGAGRAGAFGDIQARSISSTDLFANTNLVLQRPKSGTIHVPYTQAPSGFEQWKRDRPPSLRFTAPFGCDVLVNPVRAENCAVGSIPLTFDIPDALFTRVSDTPTLSNAECTLNECVYSSDFGGIASVKYSASKAGKCAVHVPSGTATLKESIVDLTEEGTLTVHFSTASIHPDFRLQICTTFVTCRGDCHPPKDHIVTHPQYHSQSFSSAVSKTAWTWLTSLLGGSAVVLVVGLSLAAIVAIYIFTQKHK

SEQ ID NO: 15637 - protein, 462 aa, unidentified
YEHTVVVPMDPRAPSYEAVINRNGYDPLKLTIAVNFTVISPTTALEYWTCAGVPVVEPPHVGCCTSVSCPSDLSTLHAFTGKAVSDVHCDVHTNVYPLLWGAAHCFCSTENTQVSAVAATVSEFCAQDSERAEAFSVHSSSVTAEILVTLGEVVTAVHVYVDGVTSARGTDLKIVAGPITTDYSPFDRKVVRIGEEVYNYDWPPYGAGRPGTFGDIQARSTNYVKPNDLYGDIGIEVLQPTNDHVHVAYTYTTSGLLRWLQDAPKPLSVTAPHGCKISANPLLALDCGVGAVPMSINIPDAKFTRKLKDPKPSALKCVVDSCEYGVDYGGAATITYEGHEAGKCGIHSLTPGVPLRTSVVEVVAGANTVKTTFSSPTPEVTLEVEICSAIVKCASECTPPKEHVVAARPRHGSDTGGYISGPAMRWAGRIVGNPSGPVSSSLAVTYCVVKKCRSKRIRIVKS

SEQ ID NO: 15638 - protein, 442 aa, unidentified
YEHATTMPNQAGMPFNTVVNRAGYAPLVISITPTKVRLIPTLNLEYVTCHYKTGLDSPSIKCCGTQECPKVNRPDEQCKVFTGVYPFMWGGAYCFCDSENTQLSRAYVTKSDDCSADHALAYKAHTASVQAFLNITVGEQSTTAVVYVNGETPISFNGIRLVAGPLSTAWTPFDRKVVQYAGEIYNYDFPEYGAGHAGAFGDLQARTTTSNDLYANTNLVLQRPTAGTIHVPYTQAPSGFEQWKKDKPPSLKYTAPFGCEIYVNPVRAENCAVGSIPLAFDIPDALFTRVSETPTLSNAECSLNECVYSSDFGGIATVKYTASKSGKCAVHIPSGTATLKESLVDVVEQGSLTLHFSTANIHPEFKLQICTTHLTCKGDCHPPKDHIVTHPQLHAQTFTAAVSKTAWTWLTSLLGGSAVIIIIGLVLATVVAMYVLTNQRHN

SEQ ID NO: 15639 - protein, 439 aa, unidentified
FEHATTVPNVPGIPYKALVERAGYAPLNLEITVVSSELTPSTNKEYVTCKFHTVIPSPQVKCCGSLECKASSKADYTCRVFGGVYPFMWGGAQCFCDSENTQLSEAYVEFAPDCTIDHAVALKVHTAALKVGLRIVYGNTTAHLDTFVNGVTPGSSRDLKVIAGPISAAFSPFDHKVVIRKGLVYNYDFPEYGAMKPGAFGDIQASSLDATDIVARTDIRLLKPSVKNIHVPYTQAVSGYEMWKNNSGRPLQETAPFGCKIEVEPLRASNCAYGHIPISIDIPDAAFVRSSESPTILEVSCTVADCIYSADFGGSLTLQYKADREGHCPVHSHSTTAVLKEATTHVTAVGSITLHFSTSSPQANFIVSLCGKKSTCNAECKPPADHIIGEPHKVDQEFQAAVSKTSWNWLLALFGGASSLIVVGLIVLVCSSMLINTRR

SEQ ID NO: 15640 - protein, 422 aa, unidentified; identical to SEQ ID NO: 9256

SEQ ID NO: 15641 - protein, 423 aa, unidentified; identical to SEQ ID NO: 15226

SEQ ID NO: 15642 - protein, 423 aa, unidentified; identical to SEQ ID NO: 15457

SEQ ID NO: 15643 - protein, 420 aa, unidentified; identical to SEQ ID NO: 9042

SEQ ID NO: 15644 - protein, 423 aa, unidentified; identical to SEQ ID NO: 15229

SEQ ID NO: 15645 - protein, 422 aa, unidentified; identical to SEQ ID NO: 8501

SEQ ID NO: 15646 - protein, 422 aa, unidentified; identical to SEQ ID NO: 15228

SEQ ID NO: 15647 - protein, 438 aa, unidentified; identical to SEQ ID NO: 9201

SEQ ID NO: 15648 - protein, 422 aa, unidentified; identical to SEQ ID NO: 15230

SEQ ID NO: 15649 - protein, 423 aa, unidentified; identical to SEQ ID NO: 9151

SEQ ID NO: 15650 - protein, 587 aa, unidentified
MNFNHHFTWSLVIISQIFQVQAGFGDPREALLEIQQKHGKPCDCAGGYVSSPPTNSLTTVSCSTYTAYSVTNSLKWQCVSTPTTASPTHIGSCPSQCNSQSYDSVHATCYNHYQQCTIGNKTYLTATMIRDKSPSSGDGNVPTILGNNQNLIIAGCPENKKGQVVCWNSQPSVHMSDGGGPQDKVREIIVNKKFEELHKSLFPELSYHPLALPEARGKEKIDAHTFDLLATVHSLLNVSSQRQLAEDCWLCLRSGDPVPLALPYDNTSCSNSTFFFNCSNCSCLITPPFLVQPFNFTHSVCLYADYQNNSFDIDVGLAGFTNCSSYINISKPSSPLCAPNSSVFVCGNNKAYTYLPTNWTGSCVLATLLPDIDIIPGSEPVPIPAIDHFLGRPKRAIQFIPLVIGLGITTAVSTGTAGLGVSLTQYTKLSHQLISDVQAISSTIQDLQDQVDSLAEVVLQNRRGLDLLTAEQGGICLALQEKCCFYANKSGIVRDKIKNLQDDLEKRRKQLIDNPFWTGFHGLLPYVMPLLGPLLCLLLVLSFGPIIFNKLMTFIKHQIESIQAKPIQVHYHRLEQEDHGGSYLNLT

SEQ ID NO: 15651 - protein, 688 aa, unidentified
MPKHQSGSLTDSSDLSLSGKDRRPRLALRRKRRREMRKITKKVRRMTLDPIKEKTAWQQLQALISEAEEVLKTSQTPQTSLTLFLALLSVLGPLPVTGESYWAYLPKPPILHPVGWGSTDPIRVLTNQTMYLGGSPGFHGFRNMSGNVHFEGKSDTLPICFSFSFSTPTGCFQVDKQVFLSDTPTVDNNKPGGKGDKRRMWELWLTTLGNSGANTKLVPIKKKLPPKYPHCQIAFKKDAFWEGDESAPPRWLPCAFPDQGVSFSPKGALGLLWDFSLPSPSIDQSEQIKSKKDLLGNYTPPVNKEVHRWYEAGWVEPTWFWENSPKDPNDRDFTALVPHTELFRLVAASRHLILKRPGFQEHEMIPTSACVTYPYAILLGLPQLIDIEKRGSTFHISCSSCRLTNCLDSSAYDYAAIMVKRPPYVLLPVDIGDEPWFDDSAIQTFRYATDLIRAKRFVAAIILGISALIAIITSFAVATTALVKEMQTATFVNNLHRNVTLALSEQRIIDLKLEARLNALEEVVLELGQDVANLKTRMSTKCHANYDFICVTPLPYNASESWERTRAHLLGIWNDNEISYNIQELTNLISDMSKQHIDAVDLSGLAQSFANGVKALNPLDWTQYFIFIGAGALLLVIVLMIFPIVFQCFAKSLNQVQSDLNVLLLKKKKGGNAAPAAEMVELPRVSYT

SEQ ID NO: 15652 - protein, 575 aa, unidentified
MLCILILLLHPRLCPVTKGGLGKPSGDIYTALFGAPCDCKGGTQTNNYATPTYTQVTDCGDKNAYLTYDTNWNGVSSPKWLCVRKPPSIPVINGRPGPCPSECTNNIKSQMHSSCYSSFSQCTQGNNTYFTAILQRTKSTSETNPVTSGLQPHGVLQAGCDGTVGKSVCWNQQAPIHVSDGGGPQDAVRELYVQKQIELVIQSQFPKLSYHPLARSKPRGPDIDAQMLDILSATHQALNISNPSLAQNCWLCLNQGTSMPLAFPVNISSFNASQNNCTPSLPFRVQPMPSQVYPCFFKGAQNNSFDIPVGVANFVNCSSSSNHSEALCPGPGQAFVCGNNLAFTALPANWTGSCVLAALLPDIDIISGDDPVPIPTFDYIAGRQKRAVTLIPLLVGLGVSTAVATGTAGLGVAVQSYTKLSHQLINDVQALSSTINDLQDQLDSLAEVVLQNRRGLDLLTAEQGGICLALQERCCFYANKSGIVRDKIKNLQEDLEKRRKALADNLFLTGLNGLLPYLLPFLGPLFAIILFFSFAPWILRRVTALIRDQLNSLLGKPIQIHYHQLATRDLEYGRL

SEQ ID NO: 15653 - protein, 618 aa, unidentified
MFVFFHRMPKRRAGSRRGWYARRRNSLTHQMHHMTLSEPTSELPTQRQIEALMRYAQNEAHVQPPVTPTNILIMLLLLLQRIQNGAAAAFWAYIPDPPTIQSLGWDKEVVPVYVNDTSLLGGKSDIHISPQQANISFYGLTTQYPMCFSYQSQHPHCIQVSADISYPRVTISGIDEKTGKRSYRDGTGPLDIPFCDKHLSIGIGIDTLRTLCRARVASVYNINNADATLLWDWAPGGTPDFPEYRGQHPPIFSVNTAQVYQTELWKLLAAFGHGNSLYLQPNISGSKYGNVGVTGFLYPRACVPYPFMLIQGHMEITLSLNIYHLNCSNCILTNCIRGVAKGEQVIIVKQPAFVMLPVEITEAWYDETALELLQRINTALSRTERSVSLIVLGIVSLITLIATAVTASVSLAQSIQAAHTVDSLSYNVTKVMGTQEDIDRKIEDRLSALYDVVRVLGEQVQSISFRMKIQCHANYKWICVTKKAYNASDFPWDKVKKHLQGIWFNTNVSLDLLQLHNEILNIENSPKATLNIADTVDNFLQNLFSNFPSLHSLWRSIIAVGAVLTVVLILICLAPCLIRSIVKEFLHMRVLIHKNMLQHRHLMELLKNKERGAAGDCP

SEQ ID NO: 15654 - protein, 617 aa, unidentified
MPKHRAGFRKGWYARQRNSLTYQMQRMTLNEATNGLPTQRQVEALMRHAWNEAHVQPPATPIKILMMLLLLLQRIQNGAAAAFWAYIPDPPMIQSLGWDREIVPVYVNDTGLLGGKSDIHISPQQANISFYGLTTQYPMCFSYQSQHPHCIQVSADISYPRVTISGIDEKTGKRSYRNGTGPLDIPFCDKNLSISIGIDTPWTLCRARIASVYNINNANTTLLWDWAPGGTPDFPEYRGQHPPILSVNTAPIFQTELWKLLAAFGHGNSLYLQPNVSGSKYGDVGVTGFLYPRACVPYPFMLIQGHMEITLSLNIYHLNCSNCILTNCIRGVAKGEQVIIVKQPAFVMLPVEITEEWYDETALELLQRINTALSRPKRGLSLIILGIVSLITLIATAVTASVSLAQSIQAAHTVDSLSYNVTKVMGTQEDIDKKIEDRLSALYDVVRVLGEQVQSINFRMKIQCHANYKWICVTKKLYNTSDYPWDKVEKHLQGIWFNTNVSLDLLQLHNEILDIENSPKATLNIADTVNNFLQNLFSNFPSLHSLWQSIIVIAIIVFIVIVVILLVPCLTRDLIKDFLQMRIELIHMKYRYMLQYQKLMELVKKGEGSCGGQPAEG

SEQ ID NO: 15655 - protein, 582 aa, unidentified
MNFEHKLIWSLMVISQILPIYAGFGDPREALTHIQNKHGKPCECKGGYVNRPPSSHVASISCGSHTAYQPTNNLKWQCVSTPKTTSGGHMGQCPSACSDKSYDSVHSTCYSSYQQCTIGNKTYFTATITGERTATIGVSNVPTVIGSGQNLISAGCPKDELGKTACWSATPPVHVSDGGGPQDKVREILVQKKFEELHKNLFPELSYHPLALPKARGKEKIDAQTVDILTAVHNLLNLTRPDLAQDCWLCLQIGNPVPLALPSNYTYENLTSFNCSKNCSCPIVSPFLVQPFNFTESVCLYAPYQNNSYDIDVGLAAFINCSSTHNVSTPLCAPNGSVFACGNNQAYTYLPTNWTGRCVLVTLLPDIDIIPGSEPVPVPAIDHFIGRTKRAVQFIPLLVGLGITTAVSTGAAGLGHSITQYTKLSRQLISDVLAISSTIQDLQDQVDSLAEVVLQNRRGLDLLTAEQGGICLALQEKCCFYTNKSGVVRDKIKRLQDDLEKRRQQLIDNPFWTSFHGLLPYILPLLGPLLCLLLIISFGPLILNKLMAFIKHQIEAIQAKPIQVHYHRLEQEERGGSYLQIT

SEQ ID NO: 15656 - protein, 576 aa, unidentified
MKLIHIAIWSLVIFFQVSLSRAGFGDPREALAHIQNKHGKPCDCGGGYTQTQPTTYVTSISCGSHTAYSQVGSLKWLCIKAPSTPSGQHVGHCPQDCNTQSYESMHSSCYTSYQQCTLGNKTYFTAAIIKNRSPSVGQSVLGSSHNLITAGCHDTGKTACWNTHPPVHVSDGGGPQDKVREIIVEKKLEEIQKSLFPELSYHPLALPETRGKEMIDPQTFEILTTVHSLLNATKPDLAQDCWLCLRSGTPVPLALPYNNISLLNFTCSSNYSYLVTSPFLVQPFNFSESDCLYAPYQNNSFDIDVGTAQFTNCTNTHNRSSSTPLCAYNGSVFVCGNNKAYTYLPTNWTGLCAVATLIPDIDIIPGDEPVPVPAIDYFISRPKRAVQFIPLLVGLGITTAVSTGAAGLGHSITQYTKLSHQLISDVQAISSTIQDLQDQVDSLAEVVLQNRRGLDLLTAEQGGICLALQEKCCFYTNKSGVVRDKIKRLQDDLEKRRQQLIESPFWTGLNGLLPYLLPLLGPLLCLLLVLTFGPLILNKLMAFIRQQIESIQAKPIQVHYHRLEQEDRCGSYLRIT

SEQ ID NO: 15657 - protein, 488 aa, unidentified
MGKFLATLILFFQFCPLIFGDYSPSCCTLTIGVSSYHSKPCNPAQPVCSWTLDLLALSADQALQPPCPNLVSYSSYHATYSLYLFPHWTKKPNRNGGGYYSASYSDPCSLKCPYLGCQSWTCPYTGAVSSPYWKFQHDVNFTQEVSRLNINLHFSKCGFPFSLLVDAPGYDPIWFLNTEPSQLPPTAPPLLPHSNLDHILEPSIPWKSKLLTLVQLTLQSTNYTCIVCIDRASLSTWHVLYSPNVSVPSSSSTPLLYPSLALPAPHLTLPFNWTHCFDPQIQAIVSSPCHNSLILPPFSLSPVPTLGSRSRRAVPVAVWLVSALAMGAGVAGGITGSMSLASGKSLLHEVDKDISQLTQAIVKNHKNLLKIAQYAAQNRRGLDLLFWEQGGLCKALQEQCRFPNITNSHVPILQERPPLENRVLTGWGLNWDLGLSQWAREALQTGITLVALLLLVILAGPCILRQLRHLPSRVRYPHYSLIKPESSL

SEQ ID NO: 15658 - protein, 488 aa, unidentified
MGKFLATLILFFQFCPLILSDYSPSCCTLTIGVSSYHSKPCNPAQPVCSWTLDLLALSADQALQPPCPNLVSYSSYHATYSLYLFPHWIKKPNRNGGGYYSASYSDPCSLKCPYLGCQSWTCPYTGAVSSPYWKFQQDVNFTQEVSRLNINLHFSKCGFPFSLLVDAPGYDPIWFLNTEPSQLPPTAPPLLPHSNLDHILEPSIPWKSKLLTLVQLTLQSTNYTCIVCIDRASLSTWHVLYSPNVSVPSSSSTPLLYPSLALPAPHLTLPFNWTHCFDPQIQAIVSSPCHNSLILPPFSLSPVPTLGSRSRRAVPVAVWLVSALAMGAGMAGGITGSMSLASGRSLLHEVDKDISQLTQAIVKNHKNLLKIAQYAAQNRRGLDLLFWEQGGLCKALQEQCCFLNITNSHVSILQERPPLENRVLTGWGLNWDLGLSQWAREALQTGITLVALLLLVILAGPCILRQLRHLPSRVRYPHYSLINPESSL

SEQ ID NO: 15659 - protein, 1160 aa, unidentified
MDTPGSLQVIAIISLLLVGGASQPATFLEKALPTDGPSLETIEHKTEMVNTTRSEEQSPVRPSKTRQQLIDETPEICANAWVIRLITEFPTELGNMSQKQKTIAIQVHNTTMTMEETVFSLVSHVNKKNYEIHNVSGICTKYQLVPGNFTCSTRKCISQTKEKRIISTTVKDTYEVYLPFAWSQKPTGGDKYPEPQIGYNTGTGRLNQWNKDEFVIKQCRKKRGKRQITVPNSTLSPTGTTDFTKFTPNPISPNSTALNELEQKTTPIGTEQPFNNEKWQNLIFGNIVTKMDPQCEAELFQQFNISDKTVQVEFKVTSLPGQNISCQAIYNTEHGINIENKNCVISLIKENRKIKAHAYITRTGSYEWYAQQVTSKGIIQEVRNLVTIVECECPIVKPLPQGGIIPLTMPMRVLTNPSPILIHSALKFDLSKFGLSPCSFSPMEWQTYITKPLKRAMHGFEVHQRKKRDLGIGLHSTLNSWWNGANSLGLTVESADRQKYDQKILKVLQNLAVQQRTDVKNQQTLGKALETPIYTITLQLADSLTAAILKHEQQQNVGITCKDIAILTVTQIATYLRDIQHEHLPVWFIEQITNQILLPVGQVIMPEITAPPILNPLIGWNQSVLVIGLTHQLTITTVQQPLYKAANMGNFQDWTPFPPFILANKTHGFSIDCPIMRNSFLCHTLPTPVKLSEWERSTSTIYQTSPQVWITPEGKACLNHRNITVQDRTCLINKPGCFIPKHPWSAGKQTIVPTQYIQQNFVPDTIDTEDNQTRVLQKEMIEAISKAKRDYGVLKQGQIALIRHHEAITTILGQEATYSIKETQALISSIEQEAWYNNLFSWYDGSVWSQLQLIIVVITCTIPLLWVLNTCLFFKLRRAIRRERDNNIVVEYQAQTRGRRTHMTEPITKKQRAKLLRHAKTNRRLPRSLRATPAVSAFEMVTFDPQEETVEINRIDPSHENNDHGGPMNMAPIISADSYALPTPYITIMLDRELLNQGMRKVITLLNDPAREVFNKAYNLVTTNHFTLAYGCDESAGWVNQHAEYMGKPVIVTLAGLVITPVGLAWIPLPQQEPLEKLFMVPNSMPHVTVAMADYHETKEMGKIVKDINNEELLLVKPQLFKWGPEGFFVACPLVIRGVVTGHSLLHIACPATAVQAEGT

SEQ ID NO: 15660 - protein, 1317 aa, unidentified
MGPSGFLQAVTFLLLIAAGRARTGFHPEHYGFGEEAPYTVTSPQFQRLCTLAWLYHAAEKHPTLQQEEIEVQAARLYEDTGEGYAVIFIIKDVAYPMSERSGHCSMIRPDAKGTFECSPVECKEVPLRIHTCTAKQASFLLFQPDYQSLAEEKEKLPSPSLTNSLPPGSTLNETQIRCSVSWVIQLASQHKHIGHKHSDGTVTITIEKAMHRSSMDGGKVQAVVNGVQYETTTRVGACAYFKLGTGTYTYDGITRWYLTPYPEYGVDPHMKKLVLKKVRRTRRDTSAITTILGVRSMDVVWTCAVKLAEYQAITQLSAVIVEETCFIYWVQKDASGADQDYRVAEETSCCLRSDSSDSCCSSTPETYEPTHYVNVPCEETFRGKIKHLPPYSPEREWAHGACSYSWFPRGGYVQSIRVEDYCCLDLLPPVPTTEPPPSTTSIGKSTASPLIKTKRAVVTLAPSTTSTTIAAKITPIEKTTSTTVGTTGTVTVAATTTTSTVKTSTDSSPDPYETFDGEQWEKLIMGLTKTQIKATCIGEIKEKTMIPEDLTQLEFKLTGRGDKVVECQVVYNPAYGTSYINTSCSIQLNRTKSVVSVYVPYIKVGEYDWHHLITTSGGLSGNKYTLIVENCTCPNLSPLLLGGIVATSNPRPVLYDPSPILVHTTLTYDLKAFKDTKLCGFSNTEWNTYISRPINTAIGVFKRPRKMKRDLGLHSSLNSWWNFENTLGLGLEAHNRQEYDERMLNILTDISTQQALDVKNQLSIGKALTVPSYRVSLSLTSKVTEAIMAHEKDQNFRNHCYNMVMMAVSSITLNLRDIEHDHLPWWLLSGIQTKLKLPKGMKLVPSHQSPPVVTPQIGWNSTTLIVGLTHQLQAATELSALMRGQNMGRFQDWTPIPAVVMFNATHVLPTECPLVQGVFVCDELPAMIPLTQWESNTTTIYKHTPQIWLTPEGQVCINVKRISYQGLQCNLKQAGCFGPTHFWEAGRLNIIPTQLAQVNFTYDLPNEDKNQTDKLQEALDKAIMAAEKEYGNLHDVQLALVKDHGIKAKLLSQKALQSVSDTEAVLIKLDTERWLNSFFSWYDGGWLSKVQLLVAALTLSVPLLWVVTLCLACRLKKKIGRQGNQQNTMIVRTDSYPMSSYTPVPLRTPLRRDMRSMPYISIDLSASFMTERLVQTFPRFTGQMKDWFNLATLVKIHPHVTLAYGQEEVAEWRELHPFILGHSVPVTVTGIIVGKLGSAWVLNVNQHSVQDLYEVPGSIPHISIAIAEGHEQKELGWHLSQLQHLDMVPLSPGVFSWGPDTIFMTSAFVCQGIVAEN

SEQ ID NO: 15661 - protein, 1346 aa, unidentified
MDSSRLLQIAAIIICAAGRARGTLTPQLYGLGEEAPPTNSSPRLQDLCTLAWLFHAATEHPNLGENQEITLSEGQIYEASGEGYSALIMINNLQFQVKEKTGHCSMVSPETVGTYECNHLGCRKPLPEDKRCTAAHARFLLFNPEIPDNYVFTTSPPTTTLSASPPRSEELVKCSISWVIQFILENPHLGKMRQGKLEKNLRITEPLHLFDGKVGRVRAKIDGVVFDISAKVGPCARSALFKGTYFCDGNNNCFMENDPDTKVKIHQARMNLKRPRKGRKRYRIRDKRMVQTTLPQALTLKQLDNVWNCVFTISEFQAVKNLQAEIENETCFIYWTQTIQGKLVSYRTTEDPKCCIRHSRISGCCKSTPMEMPRVILENPCTKSLIAKGAKIPPYVPEEEWTRNVCIFSWYPRAGFSQALAVPQKCCDKLRGVLPSPPPITVSTTGVKIMDGISSGDYEEYIPARTSLPVKTAPKQVTESTLPLTSVTTLSTTTFPLPAPAPPTIEERTKRSETIVLTPGPTNTEETSYNETLEYNDFSDPHEVFDEDLWNRLTMGNIKTQIKMTCVGQISEDLYLPTDVIQAEVKLTGRGDDKIECQVVYSPKNGLAYVNTSCQIEFQITTEKIKIKVPKIKEGQYDWHHKTTSSAGVTGNKYTLIIENCTCPQLTQLPLGGIVVTSAPLTILYHPSSILVYTALHFDLKVFKDQSHCAFTDTDWNAYILKPLAQAIGALRPRNKRDLGIHSSLNSWWNLENSMGLGLESYQRQDYDERMLNLLADISKQQALDTRNQLSLGKALTTPAYKISINLARAITKATLAHEKDQNLKGHCRHMAGQISTQIQMDLRDISHAHLPWWLLEGIQEKLKLPKGLKLVPSHYSPTLLAPQIGWNSSTLVIGLTHQLQAAKQLPKMMKGRNMGRFQQWTPLPPTVFVNTTHVLPIDCPEQNGMFICDEIPLMVPLDTWEKNTTVLYRHTPQVWLTPSGQACTNVKQISYQGLKCPLPMPGCFGPTHYWRAGDLNIVPVQQAQINVSYELPEHNQNQTDELEQALDKAITMAEREFGDVLEIQMALVHDHETKAKLLEGKALKSIQDTEAVLFKLDTEKWLNSFYSWYDGGWLSRIQLIVACLTLTVPILWLMNLVLCCYLKKKIRKPARQHTIVVQPDTNHLPMTTYKSIPALNRVLPFTDNVPYIAVNLSKHLMAERLVFTLPRFSPEMKEMFNKGTLTTRDPHVTLAYGKEECARWKEQNPFTIGHGIAVTISGIVTSPVGTMWVLNVQQPDLFDIFEVPGSVPHISVSVSPDHEPKDLGIYLAQLQHHEMHPVSPGLFRWGKNAWFLTANFAAQGIITEN

SEQ ID NO: 15662 - protein, 675 aa, unidentified
MACSTLPKSPKDKIDPRDLLIPLILFLSLKGARSAAPGSSPHQVYNITWEVTNGDRETVWAISGNHPLWTWWPVLTPDLCMLALSGPPHWGLEYQAPYSSPPGPPCCSGSSGSSAGCSRDCDEPLTSLTPRCNTAWNRLKLDQVTHKSSEGFYVCPGSHRPREAKSCGGPDSFYCASWGCETTGRVYWKPSSSWDYITVDNNLTTSQAVQVCKDNKWCNPLAIQFTNAGKQVTSWTTGHYWGLRLYVSGRDPGLTFGIRLRYQNLGPRVPIGPNPVLADQLSLPRPNPLPKPAKSPPASNSTPTLISPSPTPTQPPPAGTGDRLLNLVQGAYQALNLTNPDKTQECWLCLVSGPPYYEGVAVLGTYSNHTSAPANCSVASQHKLTLSEVTGRGLCIGTVPKTHQALCNTTLKIDKGSYYLVAPTGTTWACNTGLTPCLSATVLNRTTDYCVLVELWPRVTYHPPSYVYSQFEKSYRHKREPVSLTLALLLGGLTMGGIAAGVGTGTTALVATQQFQQLHAAVQDDLKEVEKSITNLEKSLTSLSEVVLQNRRGLDLLFLKEGGLCAALKEECCFYADHTGLVRDSMAKLRERLTQRQKLFESSQGWFEGLFNRSPWFTTLISTIMGPLIILLLILLFGPCILNRLVQFVKDRISVVQALVLTQQYHQLKPLEYEP

SEQ ID NO: 15663 - protein, 676 aa, unidentified
MACSTLSKSPKDKIDPRDLLIPLILFLSLKGARSAAPGSSPHQVYNITWEVTNGDRETVWAISGNHPLWTWWPVLTPDLCMLALSGPPHWGLEYQAPYSSPPGPPCCSGSSGNVAGCARDCNEPLTSLTPRCNTAWNRLKLDQVTHKSSEGFYVCPGSHRPREAKSCGGPDSFYCASWGCETTGRVYWKPSSSWDYITVDNNLTSNQAVQVCKDNKWCNPLAIRFTNAGKQVTSWTTGHYWGLRLYVSGQDPGLTFGIRLSYQNLGPRIPIGPNPVLADQLSFPLPNPLPKPAKSPPASSSTPTLISPSPTPTQPPPAGTGDRLLNLVQGAYQALNLTNPDKTQECWLCLVSGPPYYEGVAVLGTYSNHTSAPANCSVASQHKLTLSEVTGRGLCIGTVPKTHQALCNTTLKAGKGSYYLVAPTGTMWACNTGLTPCLSATVLNRTTDYCVLVELWPRVTYHPPSYVYSQFEKSHRHKREPVSLTLALLLGGLTMGGIAAGVGTGTTALVATQQFQQLHAAVQDDLKEVEKSITNLEKSLTSLSEVVLQNRRGLDLLFLKEGGLCAALKEECCFYADHTGLVRDSMAKLRERLSQRQKLFESSQGWFEGWFNRSPWFTTLISTIMGPLIILLLILLFGPCILNRLVQFVKDRISVVQALVLTQQYHQLKPLEYEPQ

SEQ ID NO: 15664 - protein, 676 aa, unidentified
MACSTLSKSPKDKIDPRDLLIPLILFLSLKGARSAAPGSSPHQVYNITWEVTNGDRETVWAISGNHPLWTWWPDLTPDLCMLALSGPPHWGLEYRAPYSSPPGPPCCSGSSGNRAGCARDCDEPLTSLTPRCNTAWNRLKLDQVTHKSSGGFYVCPGSHRPRKAKSCGGPDSFYCASWGCETTGRAYWKPSSSWDYITVDNNLTTNQAAQVCKDNKWCNPLAIQFTNAGKQVTSWTIGHYWGLRLYVSGQDPGLTFGIRLKYQNLGPRVPIGPNPVLADQLSFPLPNPLPKPAKSPSASNSTPTLISPSPAPTQPPPAGTGDRLLNLVQGAYQALNLTNPDKTQECWLCLVSAPPYYEGVAVLGTYSNHTSAPANCSAGSQHKLTLSEVTGQGLCIGTVPKTHQALCNTTLKTGKGSYYLVAPAGTMWACNTGLTPCLSATVLNRTTDYCVLVELWPRVTYHPPSYVYSQFEKSYRHKREPVSLTLALLLGGLTMGGIAAGVGTGTTALVATQQFQQLHAAVQDDLKEVEKSITNLEKSLTSLSEVVLQNRRGLDLLFLKEGGLCAALKEECCFYADHTGLVRDSMAKLRERLTQRQKLFESSQGWFEGLFNRSPWFTTLISTIMGPLIILLLILLFGPCILNRLVQFVKDRISVVQALVLTQQYHQLKPLEYEPQ

SEQ ID NO: 15665 - protein, 644 aa, unidentified
MEGPAFSKPLKDKINPWGPLIVIGILVRAGASVQRDSPHQVFNVTWRVTNLMTGQTANATSLLGTMTDTFPKLYFDLCDLVGDHWDDPEPDIGDGCRSPGGRKRTRLYDFYVCPGHTVPIGCGGPGEGYCGKWGCETTGQAYWKPSSSWDLISLKRGNTPKDQGPCYDSSVSSGVQGATPGGRCNPLVLEFTDAGKKASWDAPKVWGLRLYRSTGADPVTRFSLTRQVLNVGPRVPIGPNPVITEQLPPSQPVQIMLPRPPHPPPSGAASMVPGAPPPSQQPGTGDRLLNLVKGAYQALNLTSPDRTQECWLCLVSGPPYYEGVAVLGTYSNHTSAPANCSVASQHKLTLSEVTGQGLCVGAVPKTHQALCNTTQKASDGSYYLAAPAGTIWACNTGLTPCLSTTVLNLTTDYCVLVELWPKVTYHSPGYVYDQFERKTKYKREPVSLTLALLLGGLTMGGIAAGVGTGTTALVATKQFEQLQAAIHTDLGALEKSVSALEKSLTSLSEVVLQNRRGLDLLFLKEGGLCAALKEECCFYADHTGVVRDSMAKLRERLNQRQKLFESGQGWFEGLFNRSPWFTTLISTIMGPLIVLLLILLLGPCILNRLVQFVKDRISVVQALVLTQQYHQLKSIDPEEVESRE

SEQ ID NO: 15666 - protein, 669 aa, unidentified
MESTTLSKPFKNQVNPWGPLIVLLILGGVNPVALGNSPHQVFNLSWEVTNGDRETVWAITGNHPLWTWWPDLTPDLCMLALHGPSYWGLEYRAPFSPPPGPPCCSGSSDSTPGCSRDCEEPLTSYTPRCNTAWNRLKLSKVTHAHNEGFYVCPGPHRPRWARSCGGPESFYCASWGCETTGRASWKPSSSWDYITVSNNLTSDQATPVCKGNEWCNSLTIRFTSFGKQATSWVTGHWWGLRLYVSGHDPGLIFGIRLKITDSGPRVPIGPNPVLSDRRPPSRPRPTRSPPPSNSTPTETPLTLPEPPPAGVENRLLNLVKGAYQALNLTSPDKTQECWLCLVSGPPYYEGVAVLGTYSNHTSAPANCSVASQHKLTLSEVTGQGLCIGAVPKTHQVLCNTTQKTSDGSYYLAAPTGTTWACSTGLTPCISTTILDLTTDYCVLVELWPRVTYHSPSYVYHQFERRAKYKREPVSLTLALLLGGLTMGGIAAGVGTGTTALVATQQFQQLQAAMHDDLKEVEKSITNLEKSLTSLSEVVLQNRRGLDLLFLKEGGLCAALKEECCFYADHTGLVRDSMAKLRERLSQRQKLFESQQGWFEGLFNKSPWFTTLISTIMGPLIILLLILLFGPCILNRLVQFIKDRISVVQALVLTQQYHQLKTIGDCKSRE

SEQ ID NO: 15667 - protein, 654 aa, unidentified
MARSTLSKPPKDKINPWKSLMVMGVLLRVGMAESPHQVFNVTWRVTNLMTGRTANATSLLGTVQDAFPRLYFDLCDLVGEEWDPSDQEPYVGYGCKYPAGRQRTRTFDFYVCPGHTVKSGCGGPGEGYCGKWGCETTGQAYWKPTSSWDLISLKRGNTPWDTGCSKVACGPCYDLSKVSNSFQGATRGGRCNPLVLEFTDAGKKANWDGPKSWGLRLYRTGTDPITMFSLTRQVLNVGPRVPIGPNPVLPDQRLPSSPVEAIPAPQPPSPLNTSYPPSTASTPSTSPTSPSAPQPPPGTGDRLLALVKGAYQALNLTNPDKTQECWLCLVSGPPYYEGVAVVGTYTNHSTAPANCTATSQHKLTLSEVTGQGLCMGAVPKTHQALCNTTQSAGSGSYYLAAPTGTMWACSTGLTPCLSTTVLNLTTDYCVLVELWPRVIYHSPDYMYGQLEQRTKYKREPVSLTLALLLGGLTMGGIAAGIGTGTTALIKTQQFEQLHAAIQTDLNEVEKSITNLEKSLTSLSEVVLQNRRGLDLLFLKEGGLCAALKEECCFYADHTGLVRDSMAKLRERLNQRQKLFESGQGWFEGLFNRSPWFTTLISTIMGPLIVLLLILLFGPCILNRLVQFVKDRISVVQALVLTQQYHQLKPIEYEP

SEQ ID NO: 15668 - protein, 645 aa, unidentified
MEGPAFSKPLKDKINPWGPLIVMGILVRAGASVQRDSPHQVFNVTWRITNLMTGQTANATSLLGTMTDTFPKLYFDLCDLVGDYWDDPESSIGHGCRSPGGRKRTRTFDFYVCPGHTVLTGCGGPREGYCGKWGCETTGQAYWKPSSSWDLISLKRGNTPKGQGPCYDSSVVSSSIQGATPGGRCNPLVLEFTDAGKRASWDAPKAWGLRLYRSTGTDPVTLFSLTRQVLNVGPRVPIGPNPVITEQLPPSQPVQIMLPRPPHPPPSGAASMVPGAPPPSQQPGTGDRLLNLVEGAYQALNLTSPDKTQECWLCLVSGPPYYEGVAVLGTYSNHTSAPANCSVTSQHKLTLSEVTGQGLCVGAVPKTHQALCNTTQKTSDGSYYLASPAGTIWACSTGLTPCLSTTVLNLTTDYCVLVELWPKVTYHSPDYVYGQFEKKTKYKREPVSLTLALLLGGLTMGGIAAGVGTGTTALVATRQFEQLQAAIHTDLGALEKSVSALEKSLTSLSEVVLQNRRGLDLLFLKEGGLCAALKEECCFYADHTGVVRDSMAKLRERLNQRQKLFESGQGWFEGLFNRSPWFTTLISTIMGPLIVLLLILLLGPCILNRLVQFVKDRISVVQALVLTQQYHQLKSIEPEEVESRE

SEQ ID NO: 15669 - protein, 644 aa, unidentified
MEGPAFSKPLKDKINPWGPLIVIGILVRAGASVQRDSPHQVFNVTWRVTNLMTGQTANATSLLGTMTDTFPKLYFDLCDLVGDHWDNPEPDIGDGCRSPGGRKRTRLYDFYVCPGHTVPIGCGGPGEGYCGKWGCETTGQAYWKPSSSWDLISLKRGNTPKDQGPCYDSSVSSGVQGATPGGRCNPLVLEFTDAGKKASWDAPKVWGLRLYRSTGADPVTRFSLTRQVLNVGPRVPIGPNPVITEQLPPSQPVQIMLPRPPHPPPSGAASMVPGAPPPSQQPGTGDRLLNLVKGTYQALNLTSPDRTQECWLCLVSGPPYYEGVAVLGTYSNHTSAPANCSVASQHKLTLSEVTGQGLCVGAVPKTHQALCNTTQKASDGSYYLAAPAGTIWACNTGLTPCLSTTVLNLTTDYCVLVELWPKVTYHSPGYVYDQFERKTKYKRGPVSLTLALLLGGLTMGGIAAGVGTGTTALVATKQFEQLQAAIHTDLGALEKSVSALEKSLTSLSEVVLQNRRGLDLLFLKEGGLCAALKEECCFYADHTGVVRDSMAKLRERLNQRQKLFESGQEWFEGLFNRSPWFTTLISTIMGPLIVLLLILLLGPCILNRLVQFVKDRISVVQALVLTQQYHQLKSIDPEEVESRE

SEQ ID NO: 15670 - protein, 676 aa, unidentified
MACSTLSESPKDKIDPRDLLIPLILFLSLKGARSAAHGSSPHQVYNITWEVTNGDRETVWAISGNHPLWTWWPVLTPDLCMLALHGPPHWGLEYQAPYSSPPGPPCCSGSGGSSPGCSRDCNEPLTSLTPRCNTAWNRLKLDQVTHKSSEGFYVCPGSHRPREAKSCGGPDSFYCASWGCETTGRAYWKPSSSWDYITVDNNLTTNQAVQVCKDNKWCNPLAIQFTDAGRQVTSWITGHYWGLRLYVSGQDPGLTFGIRLKYQNLGPRVPIGPNPVLADQLSFPLPNPLPKPAKSPPVSNSTPTMISPSPTPTQPPPAGTGDRLLNLVQGAYQALNLTNPDKTQECWLCLVSGPPYYEGVAVLGTYSNHTSAPTNCSVASQHKLTLSEVTGRGLCIGTVPKTHQALCNTTLKTNKGSYYLVAPAGTTWACNTGLTPCLSATVLNRTTDYCVLVELWPRVTYHPPSYVYSQFEKSYRHKREPVSLTLALLLGGLTMGGIAAGVGTGTTALVATQQFQQLHAAVQDDFKEVEKSITNLEKSLTSLSEVVLQNRRGLDLLFLKEGGLCAALKEECCFYADHTGLVRDSMAKLRERLTQRQKLFESSQGWFEGLFNRSPWFTTLISTIMGPLIILLLILLFGPCILNRLVQFVKDRISVVQALVLTQQYYQLKPLEYEPQ

SEQ ID NO: 15671 - protein, 673 aa, unidentified
MKKPTKTTGLWKPLITLLSFACVAGAPSITLDLGNHNPHAPVQQSWEVLNEKGDVVWVATAVHPPWTWWPDLTPDICKLAAGSPNWDLPDHTDLNNPPSEQKCVPNGVGSTTGCSGQFYRANLRAAQFYVCPGQGQKGKLQQECRGASDYFCGKWTCETTGEAYWKPSADWDLITVKRGSGYDKPNQGERNPYKYLDSGCALKNYSPPGPCKGKYCNPLLIKFTEKGKQARLSWLKGNRWGWRVYIPIRDPGFIFTIRLTVRDLAVTSIGPNKVLTEQAPPVAPAPPRVPAVPAPPTSRPYTVGPSLETTLASPPLLDTENRLVSLVQGAFLVLNRTNPNMTQSCWLCYASNPPYYEGIAQTRTYNITSDHSQCLWGENRKLTLTAVSGNGLCLGQVPQDKWHLCNQTQNIRPNKGGQYLVPPIDTVWACNTGLTPCISMSVFNSSKDFCILVQLIPRLLYHDDSSFLDKFEHRVRWKREPITLTLAVLLGLGVAAAGVGTGTAALIQTPRYFEELRTAMDTDLRAIEHSITKLEESLTSLSEVVLQNRRGLDLLFLKEGGLCAALKEECCFYVDHSGVIKDSMAKLRERLDIRQRERESKQGWFESWFNKSPWLTTLLSTIAGPLIILLLLLTFGPCILNKLVAFIRERINAVQVMVLKQQYQVFQEAENSL

SEQ ID NO: 15672 - protein, 669 aa, unidentified
  VARIANT 94: note = Any amino acid
  VARIANT 191: note = Any amino acid
MLLTSSLHHPRHQMSPGSWKRLIILLSCVFGGGGTSLQNKNPHQPMTLTWQVLSQTGDVVWVTEAVQPLWTWWPSLKPDVCALAAGLESWDIPXSDVSASKRIRPLDSNYNNANKQISWGAIGCSYPRARTRIANSPFYVCPRDGRTLSEARRCGGLESLYCKEWGCETTGNVHWQPRSSWDLITVKWGRXRQWEQNMLSVCEQTGWCNPLKIDFTEKGKHSRDWIKGRTWGLRFNVAGHPGVQLTIRLKVTSMPAVAVGPDPVLAEQRPPSKPLPPPSREAPPTSLPPAASGQAPTVRERTVTLSTPPPTTGDRLFGLVQGAFLALNATNPGATESCWLCLAMGPPYYEGIASLGEVAYTSDHTRCRWGTQGKLTLTEVSGHGLCIGKVPSTHQHLCNQTLPINSSKDHQYLLPFNYSWWACSTGLTPCLSTSVFNQSRDFCIQIQLIPRIYYHPEGTLLQAYDNSHPRLKREPVSLTLAVLLGLGIAAGIGTGSTALIKGPMDLQQGLTSLQIAMDADLRAIQDSISKLENSLTSLSEVALQNRRGLDLLFLKEGGLCAALKEECCFYVDHSGAVRDSMRKLKERLDKRQLERQKNQNWYEGWFNSSPWFTTLLSTIAGPLLLLLLLLILGPCIINRLVQFINNRVSAVKILVLRQKYQTLDNEDNL

SEQ ID NO: 15673 - protein, 948 aa, unidentified
MDMGAKHMQRTGEGNWVEVKMEEQEREEEPLLHTRQQGKYKPQVSEQILNGDTNTCLTYAWIFLWGIQLTLWILLLLQWPSMGCKAEDYITLISDPYGFQPVRNVSGVPVTCVTKKFAKWGCQPIGAYPNPEIEYRNISSDILKEVYQEDWPWNTYHWPLWQMENVKQWLKENEKDYKRKLNTTKEDLDELLAGKIRGRFCVPYPFALLKCTEWCWYPAAIDDESGRAKNIKINCTNARAVSCTEEMPLASIHRAYWGKRERESMQFMNIRACQGSKLRCQRRPGGCMEGYPIPIGAEIIPESMKYLRGKKSQYGGIKDRNGELNLPLTVRVWVKLANNSAWINGAPPHWKDRIKGSKGINGTLWGELKSIHHLGFAVSYDGKWCNFTKHIRIGQEVFPYHYKPSWNCSAAKWTQYPTWQVTRYLDMVEHMTGECVQRPERHNITVGNGTITGNCSVTNWDGCNCSRSGNHLYNSSSGGLLVIICRQNKTITGIMGTNINWTTMMGILKNCSGCGNATLDRTGTGALGNVKNENCSLPHINESNKWTCAPRWRGGMSDSLYIAGGKQFWTRVKAQYSCESNLEELDGMMHQQILLQKYQVIRVRAYTYGMIDMPSSHNQRSTRRKRELGHRRKKRGIGLVIMLVTMAIVAAAGASLGVANAIQQSYTKAAVQTLANATAAQQDVLEATYAMVQHVAKGVRILEARVARVEAITDRIMLYQELDCWHYHQYCVTSTRAEVAKYINWTRFKDNCTWQQWERELQGHDENLTMLLRESARMTQLAQEQARRIPDVWEALQQVFDWSGWFSWLKYIPLIVIGILGCIIIRIMICVCQPLIQVYRTLSTPRYQKVTVIMETRADVGGENAQDFGNGFEELEISREPQKVTIKKAWSNAWELWETSPWEERWKKNLLKPLILPLTMGIWINGLLGERHKNKKERVDCETWEKGD

SEQ ID NO: 15674 - protein, 909 aa, unidentified
MDRRLRKQWMEGVQAYKGKVNIQVSLWVKVIIGASMVGSGSVGEEYITMVSDPYGFKPIWDVTNVPVTCVTKNFTQWGCQPEGAYPDPQKEYRNMSTDILEEVYNRTWPWRTYHWPLWQMDNMRRWAEQNLQDNKTRPQIEQLLAGQIRGKFCVPYPYAMLRCEQWCWYKAEEEIRIDCTRAVAVSCTNELPLAGLKRVYWEEKDRQDMEFMNIKACKGANLRCRNETVNPAGCVEGYPIPEGVEIIPESFAELREEKSPYGVIKDAQGKVVNPLTVRVWVKLANLTGWVNGTPPYWESRLNGSTGVNGTRWYGTKALTHLGYNISSDPEAGICNLTGKIQIGNKEFALQYSPGWNCSKNWTGHPVWHVYRYLDMVEDKTSRCMQRPQRKNITLDAQGVIGNCSKENWDGCQCNKSGNWIQNSTQGNVMIVVCRETTTLVEVIEGDLNWTTVNEIMRTECNSSDQCNGTGIEALQNKGGGTLGGVAKVNCTLPYLNETNQWTCKPRQRGNRTDSVYIGARRPYARIKAQYSCESSLGGLDVMMHQQIMLQRYQIVQVRAYTYGVIEMPTGYETPTIRRRRRETRSKRKKRGVGLVIVLVIMAIIAAAGASLGVANAIQQSETRTAVQELANATAVQQQVLEAAYAMVQHVARGIRILEARVARVEAIVDRMMLYQEIDCWHYHGYCVTSTKSEVAQYVNWTRYKNNCTWQQWEREIEEHEGNLTKLLRQAALETHLAGRDARRIPDVWKALQQTFNWSGWGAWVKYVPWIIMGIIGIIGVRFVMCMLSMCAQSFRQMKNLEYQIIDLDLREKGIDYAEGEGGDVAGTAGFANCVLEDSPSLTQIWRIQYQTWRRSPLTIAERARTLLILPLAGLEQWWRTSGWSGDRLKKKKKRVDCEGQESRPHWTET

SEQ ID NO: 15675 - protein, 966 aa, unidentified
MDAGARYMRLTGKENWVEVTMDGEKERKREGFTAGQQGKYNPQVSKNIGNRNTNDCFAYKGIFLWRISLTMWILLGINMCVSAEDYITLISDPYGFSPIKNVSGVPVTCVTKEFAKWGCQPLGAYPDPEIEYRNVSQEVVKEVYQENWPWNTYHWPLWQMENVRYWLKENMQENQQRKNNTKEGIEELLAGTIRGRFCVPYPFALLKCTKWCWYTAAINNESGKAGKIKINCTEARAVSCTEDMPLASIQRAYWDEKDRESMAFMNIKACDSNLRCQKRPGGCMEGYPIPVGAEIIPESMKYLRGAKSQYGGIKDKNGELKLPLTLRVWVKLANVSEWVNGTPPDWQDRINGSKGINGTLWGELNSMHHLGFALSQNGKWCNYTGEIKLGQETFQYHYKPNWNCTGNWTQYPVWQVIRNLDMVEHMTGECVQRPQRHNITVGNGTITGNCSTTNWDGCNCSRSGNYLYNSSEGGLLLILCRQNSTLTRILGTNTNWTTMWGIYKNCSGCENATLDNTGEGTLGGVANKNCSLPHKNESNKWTCAPRQRDGKTDSLYIAGGKKFWTRIKAQFSCESNIGQLDGMLHQQILLQKYQVIKVRAYTYGVIEMPENYAKTRIINRKKRELSHKRKKRGVGLVIMLVIMAIVAAAGASLGVANAIQQSYTKAAVQTLANATAAQQDVLEATYAMVQHVAKGVRILEARVARVEAITDRIMLYQELDCWHYHQYCITSTKTEVAKYINWTRFKDNCTWQQWERGLQGYDTNLTILLKESAAMTQLAEEQARRIPEVWESLKDVFDWSGWFSWLKYIPIIVVGLLGCILIRAVICVCQPLVEIYRTLSTPTYQRVTVIMETRADVAGENQDFGDGLEESDNSETSERVTVQKAWSRAWELWQNSPWKEPWKRGLLRLLVLPLTMGIWINGWLGEHHKNKKRKGGLETWHKKGTDIGLGQIPVDHLWCYKKSKSL

SEQ ID NO: 15676 - protein, 856 aa, unidentified
MAEGFAANRQWIGPEEAEELLDFDIATQMSEEGPLNPGVNPFRVPGITEKEKQNYCNILQPKLQDLRNEIQEVKLEEGNAGKFRRARFLRYSDERVLSLVHAFIGYCIYLGNRNKLGSLRHDIDIEAPQEECYNNREKGTTDNIKYGRRCCLGTVTLYLILFTGVIVYSQTAGAQVVWRLPPLVVPVEESEIIFWDCWAPEEPACQDFLGAMIHLKAKTNISIREGPTLGNWAREIWATLFKKATRQCRRGRIWKRWNETITGPSGCANNTCYNVSVIVPDYQCYLDRVDTWLQGKINISLCLTGGKMLYNKVTKQLSYCTDPLQIPLINYTFGPNQTCMWNTSQIQDPEIPKCGWWNQMAYYNSCKWEEAKVKFHCQRTQSQPGSWFRAISSWKQRNRWEWRPDFKSKKVKISLPCNSTKNLTFAMRSSGDYGEVTGAWIEFGCHRNKSNLHTEARFRIRCRWNVGSDTSLIDTCGNTPNVSGANPVDCTMYSNKMYNCSLQNGFTMKVDDLIVHFNMTKAVEMYNIAGNWSCTSDLPSSWGYMNCNCTNSSSSYSGTKMACPSNRGILRNWYNPVAGLRQSLEQYQVVKQPDYLLVPEEVMEYKPRRKRAAIHVMLALATVLSIAGAGTGATAIGMVTQYHQVLATHQEAIEKVTGALKINNLRLVTLEHQVLVIGLKVEAMEKFLYTAFAMQELGCNQNQFFCKIPLELWTRYNMTINQTIWNHGNITLGEWYNQTKDLQQKFYEIIMDIEQNNVQGKTGIQQLQKWEDWVRWIGNIPQYLKGLLGGILGIGLGVLLLILCLPTLVDCIRNCIHKILGYTVIAMPEVEGEEIQPQMELRRNGRQCGMSEKEEE

SEQ ID NO: 15677 - protein, 854 aa, unidentified
MAEGFAANRQWIGPEEAEELLDFDKATQMNEEGPLNPGVNPFRVPAVTEADKQEYCKILQPRLQEIRNEIQEVKLEEGNAGKFRRARFLRYSDESILSLIHLFIGYCTYLVNRRRLGSLRHDINIEAPQEEQYSSREQGTTENIKYGRRCLIGTASLYLLLFIGVAIYLGTTNAQIVWRLPPLVVPVEESEIIFWDCWAPEEPACQDFLGAMIHLKASTNISIQEGPTLGNWAREIWGTLFKKATRHCRRNKIWKRWNETITGPVGCANNTCYNISVIIPDYQCYLDRVDTWLQGKVNISLCLTGGKMLYNRDTKQLSYCTDPLQIPLINYTFGPNQTCMWNTSQIQDPEIPKCGWWNQIAYYNSCRWESTNVKFYCQRTQSQPGTWIRTISSWRQKNRWEWRPDFESEKVKISLQCNSTHNLTFAMRSSGDYGEVMGAWIEFGCHRNKSRFHTEARFRIRCRWNVGDNTSLIDTCGKNLNVSGANPVDCTMYANKMYNCSLQNGFTMKVDDLIMHFNMTKAVEMYNIAGNWSCKSDLPQNWGYMNCNCTNGTSNDNKMACPEDKGILRNWYNPVAGLRQALEKYQVVKQPEYIVVPTEVMTYKYKQKRAAIHIMLALATVLSIAGAGTGATAIGMVTQYQQVLATHQEALDKITEALKINNLRLVTLEHQMLVIGLKVEAIEKFLYTAFAMQELGCNQNQFFCEIPKELWLRYNMTLNQTIWNHGNITLGEWYNQTKYLQQKFYEIIMDIEQNNVQGKQGLQKLQNWQDWMGWIGKIPQYLKGLLGGILGIGLGILLLILCLPTLVDCIRNCISKVLGYTVIAMPEIDDEEETVQMELRKNGRQCGMSEKEEE

SEQ ID NO: 15678 - protein, 843 aa, unidentified
MRATEIRKNYQHLWKGGTLLLGMLMICSAAEQLWVTVYYGVPVWKEATTTLFCASDAKAYDTEVHNVWATHACVPTDPNPQEVKLENVTENFNMWKNNMVEQMHEDIISLWDQSLKPCVELTPLCVTLNCTDLRNATNTTSSSWETMEKGEIKNCSFNITTSIRDKVQKEYALFYNLDVVPIDNASYRLISCNTSVITQACPKVSFEPIPIHYCAPAGFAILKCNDKKFNGTGPCTNVSTVQCTHGIRPVVSTQLLLNGSLAEEEIVIRSENFTNNAKTIIVQLNESVVINCTRPNNNTRKSINIGPGRALYTTGEIIGDIRQAHCNLSKTQWENTLEQIAIKLKEQFGNNKTIIFNPSSGGDPEIVTHSFNCGGEFFYCNSTQLFTWNDTRKLNNTGRNITLPCRIKQIINMWQEVGKAMYAPPIRGQIRCSSNITGLLLTRDGGKDTNGTEIFRPGGGDMRDNWRSELYKYKVVKIEPLGVAPTKAKRRVVQREKRAVGLGALFLGFLGAAGSTMGAASITLTVQARQLLSGIVQQQNNLLRAIEAQQHLLQLTVWGIKQLQARVLAVERYLRDQQLLGIWGCSGKLICTTTVPWNTSWSNKSLNEIWDNMTWMKWEREIDNYTHIIYSLIEQSQNQQEKNEQELLALDKWASLWNWFDITKWLWYIKIFIMIVGGLIGLRIVFVVLSIVNRVRQGYSPLSFQTHLPAQRGPDRPDGIEEEGGERDRDRSGPLVDGSLALIWDDLRSLCLFSYHRLRDLLLIVTRIVELLGRRGWEALKYWWNLLQYWSQELKNSAVNLLNATAIAVAEGTDRVIEVLQAAYRAIRHIPRRIRQGLERILL

SEQ ID NO: 15679 - protein, 860 aa, unidentified
MEPGRNQLFVVILLTSACLVYCSQYVTVFYGIPAWKNASIPLFCATKNRDTWGTIQCLPDNDDYQEIILNVTEAFDAWNNTVTEQAVEDVWHLFETSIKPCVKLTPLCVAMNCSRVQGNTTTPNPRTSSSTTSRPPTSAASIINETSNCIENNTCAGLGYEEMMQCEFNMKGLEQDKKRRYKDTWYLEDVVCDNTTAGTCYMRHCNTSIIKESCDKHYWDAMRFRYCAPPGFALLRCNDTNYSGFEPKCTKVVAASCTRMMETQTSTWFGFNGTRAENRTYIYWHGRDNRTIISLNKYYNLTMRCKRPGNKTVLPITLMSGLVFHSQPINTRPRQAWCRFGGRWREAMQEVKQTLVQHPRYKGINDTGKINFTKPGAGSDPEVAFMWTNCRGEFLYCNMTWFLNWVEDKNQTRRNYCHIKQIINTWHKVGKNVYLPPREGELACESTVTSIIANIDIDKNRTHTNITFSAEVAELYRLELGDYKLIEITPIGFAPTDQRRYSSTPVRNKRGVFVLGFLGFLATAGSAMGARSLTLSAQSRTLLAGIVQQQQQLLDVVKRQQEMLRLTVWGTKNLQARVTAIEKYLKHQAQLNSWGCAFRQVCHTTVPWVNDSLSPDWKNMTWQEWEKQVRYLEANISQSLEEAQIQQEKNMYELQKLNSWDILGNWFDLTSWVKYIQYGVHIVVGIIALRIAIYVVQLLSRFRKGYRPVFSSPPGYLQQIHIHKDRGQPANEGTEEDVGGDSGYDLWPWPINYVQFLIHLLTRLLIGLYNICRDLLSKNSPTRRLISQSLTAIRDWLRLKAAQLQYGCEWIQEAFQAFARTTRETLAGAWGWLWEAARRIGRGILAVPRRIRQGAELALL

SEQ ID NO: 15680 - protein, 781 aa, unidentified
MMEEGRKEEPEERGEKSTMRDLLQRAVDKGHLTAREALDRWTLEDHGEIHPWIILFCFAGAIGVIGGWGLRGELNVCMLVVLVVLVPIYWGIGEAARNIDSLDWKWIRKVFIVIIFVLVGLLGGCSAQGQHVAMLLSPPGIRLPSTVDIPWFCISNAPIPDCVHWTVQKPDQKHQQIENVMELQEVLDNATFFEVPDLFDRVYLELARLDANSTGVPVNIPPTGISQVKGDCSTGDIQGMNETLSTRGTLGERTFLSIRPGGWFTNTTVWFCVHWPFGFIQRKENLSEGSAQVRNCLDPINVTEPRVANYSYCPLEYKGKNYINKGLKCVGGRVDLSSNPEQHTDLLACGTFCQNFRNCDMVSRDILIGYHPSQQKQHIYINHTFWEQANTQWILVQVPNYGFVPVPDTERPWKGGKPRGKRAVGMVIFLLVLAIMAMTASVTAAATLVKQHATAQVVGRLSTNLTYITKIQNQYLHLFQNLNTRVNNLHHRVTYLEFLAEVHEVQTGLGCVPRGRYCHFDWRPEEVGLNMTLWNSTTWQQWMSYYDQIEENIWNLKYNWSEALEKGKSNTDGLEPDVFRYLADLSSSFTWGSWVDKLVWLAYILLAYFAFKVLQCIMSNLGAQTRYQLLNAQEDTDPAGDGDQPDDHRSGDTPRSGVPSGGWSQKLSEGKKIGCLILRTEWQNWRNDLRTLRWLTLGGKILQLPLSLLVLLVRILLHILSPTFQNQRGWTVGRKGTGGDDRELSPELEYLSWTGSSQEMVEMRDLKEEDIPEEGIRPVEM

SEQ ID NO: 15681 - protein, 797 aa, unidentified
  VARIANT 84: note = Any amino acid
  VARIANT 85: note = Any amino acid
  VARIANT 447: note = Any amino acid
  VARIANT 448: note = Any amino acid
  VARIANT 580: note = Any amino acid
  VARIANT 663: note = Any amino acid
  VARIANT 664: note = Any amino acid
  VARIANT 687: note = Any amino acid
  VARIANT 764: note = Any amino acid
MRVMGIQRNYSQWWIWSMLGFWMLMICNGMWVTVYYGVPVWKEAKTTLFCASDAKAYEKEVHNVWATHACVPTDPNPQEMVLKXXVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNVKTIIVHLNESVKIECTRPNNKTRTSIRIGPGQAFYATGQVIGDIREAYCNINESKWNETLQRVSKKLKEYFPHKNITFQPSSGGDLEITTHHFNCGGEFFYCNTSSLFNRTYMANSTDMANSTETNSTRTITIHCRIKQIINMWQEVGRAMYAPPIAGNITCISNITGLLLTRDGGKXXNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGXMWGCSGKLICTTNVYWNSSWSNKTYGDIWDNMTWMQWEREISNYTEIIYELLEESQNQQEKNEQDLLALDRWNSLWNWFNITXXWLWYIKIFIMIVGGLIGLRIIFXAVLSLVNRVRQGYSPLSLQTLLPTPRGPARPEGIEEEGGEQGRDRSIRLLTGLSELIWDDLRNLCLFSYHHLRDLIXLIAARIVQLLGRRGWEALKYLWNILQYWIQELK

SEQ ID NO: 15682 - protein, 982 aa, unidentified
MASKESKPSRTTWRDMEPPLRETWNQVLQELVKRQQQEEEEQQGLVSGKKKSWVSIDLLGTEGKDIKKVNIWEPCEKWFAQVVWGVLWVLQIVLWGCLMWEVRKGNQCQAEEVIALVSDPGGFQRVQHVETVPVTCVTKNFTQWGCQPEGAYPDPELEYRNISREILEEVYKQDWPWNTYHWPLWQMENMRQWMKENEKEYKERTNKTKEDIDDLVAGRIRGRFCVPYPYALLRCEEWCWYPESINQETGHAEKIKINCTKAKAVSCTEKMPLAAVQRVYWEKEDEESMKFLNIKACNISLRCQDEGKSPGGCVQGYPIPKGAEIIPEAMKYLRGKKSRYGGIKDKNGELKLPLSVRVWVRMANLSGWVNGTPPYWSARINGSTGINGTRWYGVGTLHHLGYNISSNPEGGICNFTGELWIGGDRFPYYYKPSWNCSQNWTGHPVWHVFRYLDMTEHMTSRCIQRPKRHNITVGNGTITGNCSVTNWDGCNCTRSGNHLYNSTSGGLLVIICRQNSTITGIMGTNTNWTTMWNIYQNCSRCNNSSLDRTGSGTLGTVNNLKCSLPHRNESNKWTCKSQRDSYIAGRDFWGKVKAKYSCESNLGGLDSMMHQQMLLQRYQVIRVRAYTYGVVEMPQSYMEERGENRRSRRNLQRKKRGIGLVIVLAIMAIIAAAGAGLGVANAVQQSYTRTAVQSLANATAAQQEVLEASYAMVQHIAKGIRILEARVARVEALVDMMVYQELDCWHYQHYCVTSTRSEVANYVNWTRFKDNCTWQQWEEEIEQHEGNLSLLLREAALQVHIAQRDARRIPDAWKAIQEAFNWSSWFSWLKYIPWIIMGIVGLMCFRILMCVISMCLQAYKQVKQIRYTQVTVVIEAPVELEEKQKRNGDGTNGCASLEHERRTSHRSFIQIWRATWWAWKTSPWRHNWRTMPYITLLPILVIWQWMEENGWNGENQHKKKKERVDCQDREQMPTLENDYVEL

SEQ ID NO: 15683 - protein, 1130 aa, unidentified
MKLVLLFSLSVLLGTSVGRILEIPETNQTRTVQVRKGQLVQLTCPQLPPPQGTGVLIWGRNKRTGGGALDFNGVLTVPVGDNENTYQCMWCQNTTSKNAPRQKRSLRNQPTEWHLHMCGPPGDYICMWTNKKPVCTTYHEGQDTYSLGTHRKVLPKVTEACAVGQPPQIPGTYVASSKGWTMFNKFEVHSYPANVTQIKTNRTLHDVTLWWCHDNSIWRCTQMGFIHPHQGRRIQLGDGTRFRDGLYVIVSNHGDHHTVQHYMLGSGYTVPVSTATRVQMQKIGPGEWKIATSMVGLCLDEWEIECTGFCSGPPPCSLSITQQQDTVGGSYDSWNGCFVKSIHTPVMALNLWWRRSCKGLPEATGMVKIYYPDQFEIAPWMRPQPRQPKLILPFTVAPKYRRQRRGLNPSTTPDYYTNEDYSGSGGWEINDEWEYIPPTVKPTTPSVEFIQKVTTPRQDKLTTVLSRNKRGVNIASSGNSWKAEIDKIRKQKWQKCYFSGKLRIKGTDYEEIDTCPKPLIGPLSGFIPTGVTKTLKTGVTWTTAVVKIDLQQWVDILNSTCKDTLIGKHWIKVIQRLLREYQKTGVTFNLPQVQSLPNWETKNKDNPGHHIPKSRRKRIRRGLGEALGLGNFADNRWKDLQIAGLGVEQQKLMGLTREATFEAWNALKGISNELIKWEEDMVATLRQLLLQIKGTNTTLCSAMGPLMATNIQQIMFALQHGNLPEMSYSNPVLKEIAKQYNGQMLGVPVETTGNNLGIMLSLPTGGENIGRAVAVYDMGVRHNRTLYLDPNARWIHNHTEKSNPKGWVTIVDLSKCVETTGTIYCNEHGFRDRKFTKGPSELVRHLAGNTWCLNSGTWSSLKNETLYVSGRNCSFSLTSRRRPVCFHLNSTAQWRGHVLPFVGNSQEAPNTEIWEGLIEEAIREHNKVQDILTKLEQQHQNWKQNTDNALQNMKDAIDSMDNNMLTFRYEYTQYGLFIVCLLAFLFAVIFGWLCGVTVRLREVFTILSVKIHALKSQAHQLAMLRGLRDPETGEQDRQAPAYREPPTCQEWARRRGGRPPIVTFLIDRETGERHDGQIFQPIRNRSNQVHRPQPPRPTAPNPDNQRPIREPRPGEPEHGDFLQGASWMWQ

SEQ ID NO: 15684 - protein, 655 aa, unidentified
MEPYPVGYRRVSSGPMTPTPPAWSPRTRDNDLDDLVDGLRRLGLRHRTRRRRRPTRATQNSVNVTWGQVKRLTSDALTLVDVRHLPRTPDNVFLAILALLTVQVSPVSLASHWAYVPDPPFLRPVTWEDPPVFVFLNDTRVLGPPENSFITPQVATDYNFRGRAVDLPLCFSNKKHDWSYCLPVERDNLYTEGQAPTGMTREYQQWIDRQYILTIMGPSDFGHPAEGHPHPPKFPPCRALAAKNQQFLEFPPWLQCIHPHPVLHTMARTNHYVYDWGVANPLGTTEIQRMTSPGGWVARILSTETGGTQPYLWRLMAATAPIRYKHGNSTLDFSITACVPPPYLLVVGLVHVNPVSQREDEGDGYEIVCSKCNLTNCLSPADGIWDVILVHQPAFVMIPVNISGPWYQHTGVQILGEIKEMLARPRRFVGLLVAGIAALVAIVATATTAAVALTQEIHTAQYVNQLAKNISIALGAQERIDRKIEQRLDVLEQTVLLIGDQLTALKVRANLPCHAEYDSICVTPKLYNSSSLSWDKVRTHLLGIWQHTNFSLDIGVLHDEIMAIANAQPPLQKPAELAQEIFSSLESWFSHFHGLSIVYSVVTAVVAILIILCLLPVGIRLLCSSLRAMRVSIHELRLKSKEGGDVGGRVPKGMA

SEQ ID NO: 15685 - protein, 605 aa, unidentified
MDQGLWMWTSPNLLLPQISIPLTLTLFVLIPLLERVEGGFGPPPGNLQQQLFGTPCDCQGGTRSVAPTSYTSTTDCGVKTAYLESTRQAGGHGHFSIPKWVCVQKPKVIPPPSGQNPVSCPSNCNFTETVHSSCYTQTSICTKDGKSYYQATLEKTKNKTSGGRVSIPVPGILGTSVGTLNTRGGEAGCSGTVGKPSCWSTTAPIGVSDGGGPTDAVKHIQVLKAVKPDIPKIKYHPLVLPKSKTPDLDVNTFDILQTTFSLLNYSNPKLASDCWLCMTTGTVMPMAIPVNFTTSSNMSCRSGLPFRIQPLGSFPSCVMSDADNGSLAVDLGRVTFAGCSDLTNFSFPTSSLCPPNGTVFVCGGSYAYSRLPANWTGICSVALLIPDITIVDGEEPLPVPSLDTFVGRHRRAIQALPLLLGLGISTAVGAGTAGVATGTQSLKLSQQIIDDVQTLSGTIKDLQDQIDSLAEVVLQNRRGLDLLTANQGGICLALQERCCFYANKSGIVRTKIKELQENLENRRKQLLENPLWTGLNGLLPYLLPLLGPLLGLLLIAVLGPCIANRITQFIKDQINILTSKPIQVHYQRLQSDESAPDVYLRPIRR

SEQ ID NO: 15686 - protein, 1786 aa, unidentified; identical to SEQ ID NO: 15202

SEQ ID NO: 15687 - protein, 585 aa, unidentified
MSSKKILIWGLALFIHITQVLAGFGDPREALTLIHQKHGKPCDCAGGIVSSPPTAYVASVSCSTHTAYQVTTSLKWQCVNFPTRSNGASAGICACEVILPSVHATCYSSYQTCKSNGTTYNTAKLLSARNPTMGQSNVPSVLGNSHNLISSGCDKNNVGKQVCWSVTPPVHMSDGGGPQDQAREILVHKKLEELQKALFPELSYHPLALPKARGKEKIDAQTLDLLATVHSLLNESRPDLTDGCWLCLRSGTPIPLAIPTQNLSLANASDLSQFNRAPNDTQLITPPFLVQPFNFTFSPCLYASYQNNSYDIDVSLVRFTNCTFALNVSSPSTPLCAPNGSVFICGNNQAYTYLPHNWTGSCALATLLPDIDIVPGDQPVPVPTIDHLAGRSKRAVQFIPLLVGLGITTAVSTGTASLGYTVTQVTKLSRQLITDVQAISSTIQDLQDQVDSLAEVVLQNRRGLDLLTAEQGGICLALQEKCCFYANKSGIVRDKIKRLQDDLEKRRKQLIDNPFWTGFNGLLPYIVPLLGPLLCLLLVITIGPIIFNRLVAFIKTQIEAIQAKSIQVHYHRLEMEDRGEPYLSI

SEQ ID NO: 15688 - protein, 771 aa, unidentified
MVLMGALQPGLPSPVAIPLGYFKIIIDLKDCFFTIPLHPDDQKRFAFSLPSINFKEPMKRYQWRVLPQGMANSPTLCQKYVATAIQRIRIAWKQMYIIHYMDDILVAGKDGQQVLQCYAQLEKELIKAGLCIASEKVQLQDPYTYLGFQINGPKITNQKAIIRKDKLHTLNDFQKLLGDINWLRPYLKLTTGELRPLFDILKGDPNPNSPRLLTTEALTALQKVETAIAEQFVTHINYTQPLTFLIFNTALTPTGLFWQRDPIMWVHLSASPKKVLVPYYDAIADLIILGRNNSKKYFGIEPSTIIQPYSKSQVDWLLQNTETWPVTLASFTGSLDNHYPPNKLIQFCKLHSFIFPQIISNKPLDDALLVFTDGSSTGVAAYTVRDTTIKFHTTLKSAQLVELQALIAALSAFPDQRLNIYTDSAYLAHSIPMLETVAQIKHVSEAAELFTQCQQLICNRSLPCYIGHVRAHSGLPGPIARGNQVTDLATKLLAANINTNLDSAQAAHALHHLNAQTLRLMFKISREQARQIVKQCPTCVTYLPVPHLGVNPRGLFPNMIWQMDVTHYSDFGNLKFIHVSIDTFSGFLLATLQSGEATKHVIAHLLHCFSIIGQPQQIKTDNGPGYTSKNFQEFCSKLQIKHITGIPYNPQGQGIVERAHLSLKTTIEKIKKGEWYPTKGTPRNILNHALFILNFLNLDDQNKSAADRFWHRDPKKQFAMVKWKDPLDNTWHGPDPVLIWGRGSVCVYSQTHEAARWLPERLVRQVSDNND

SEQ ID NO: 15689 - protein, 486 aa, unidentified
MGNVFFLLLFSLTHFPLAQQSRCTLTVGISSYHSSPCSPTQPVCTWNLDLNSLTTDQRLHPPCPNLITYSGFHKTYSLYLFPHWIKKPNRQGLGYYSPSYNDPCSLQCPYLGCQSWTCPYTGPVSSPSWKFHSDVNFTQEVSQVSLRLHFSKCGSSMTLLVDAPGYDPLWFITSEPTQPPPTPPPLVHDSDLEHVLTPSTSWTTKMLKFIQLTLQSTNYSCMVCVDRSSLSSWHVLYTPNISIPQQTSSRTILFPSLALPAPPFQPFPWTHCYQPRLHAITTDNCNNSIILPPFSLAPVPPPATRRRRAVPIAVWLVSALAAGTGIAGGVTGSLSLASSKSLLFEVDKDISHLTQAIVKNHQNILRVAQYAAQNRRGLDLLFWEQGGLCKAIQEQCCFLNISNTHVSVLQERPPLEKRVITGWGLNWDLGLSQWAREALQTSITILALLLLVILFGPCILRQIQALPQRLQNRHSQYALINPETML

SEQ ID NO: 15690 - protein, 671 aa, unidentified
MKPPAGMVFLWVLTSLGAGIGAKIVKEGNPHQVYTLTWQIYSQSGEVVWEVQGNHALNTWWPALTPDFCQLAAGLDTWDIPDRSPKNLETSMEGTSQQLTPQGCSKPWKRCALTERDFYVCPRDNRDRATAHRCGGYEEYFCSAWGCETTGDAYWQPTSTWDLITITRNYTKPDSCDDRVERERKTSRHWRDPLSLPLKITFTDSGKRALGWQTGYTWGLRWYLPGKDRGIILKIKLKIDTITQTVGPNLVLADQKTPVQLAIPVQPPRAPTQTPRVNPVNSTLSPSLGYPAPAPGPRPPYPTSPSRPGTGDRLLNLVQGVYLTLNLTAPNQTQDCWLCLTAKPPYYQGVAIIGNFTNHTNAPLRCSTTPRHGLTLTEVTGYGLCIGKIPPSHQNLCSQTVPSVGQGPYYLTAPNGTYWVCNTGLTPCISLQILNDTADYCILIELWPKIFYHDSEYIYGHYEPGGRFRRDPVSLTVALLLGGLTMGSLAAGIGTGTAALIETNQFKQLQIAMHSDIQALEESISALERSLISLSEVVLQNRRGLDLLFLQEGGLCAALKEECCFYADHTGIVRDSMAKLRERFKQRQKLFESQQGWFEGWYNKSPWFTTLVSSLMVPLILLLLILMFGPCILNHLLQFIRERLSVIQALVLTQQYHQLRQFDAERPDAIE

SEQ ID NO: 15691 - protein, 642 aa, unidentified
MESPTHPKPSKDKTFSWNLVFLVGILFQIDMGMANPSPHQVYNVTWTITNVQTNSRANATSMLGTLTDAYPTLYVDLCDLVGDTWEPIVLDPNNVKHGARYSSSKYGCKTTDRKKQQQTYPFYVCPGHAPSMGPKGTYCGGAQDGFCAAWGCETTGETYWRPTSSWDYITVKKGVTQDNSCKGKCNPLVLQFTQKGRQASWDGPKMWGLRLYRSGYDPIALFSVSRQVMTITPPQAMGPNLVLPDQKPPSRQSQTKSKATTQRPQITSSTPRSVAPATMGPKRIGTGDRLINLVQGTYLALNATDPNKTKDCWLCLVSRPPYYEGIAVLGNYSNQTNPPPSCLSTPQHKLTISEVSGQGLCIGTVPKTHQALCKKTQKGHKGTHYLAAPSGTYWACNTGLTPCISMAVLNWTSDFCVLIELWPRVTYHQPEYIYTHFDKAVRFRREPISLTVALMLGGLTVGGIAAGVGTGTKALLETAQFRQLQIAMHTDIQALEESISALEKSLTSLSEVVLQNRRGLDILFLQEGGLCAALKEECCFYADHTGLVRDNMAKLRERLKQRQQLFDSQQGWFEGWFNKSPWFTTLISSIMGPLLILLLILLLGPCILNRLVQFVKDRISVVQALILTQQYQQIQQYESDRP

SEQ ID NO: 15692 - protein, 668 aa, unidentified
MLLTSSLHHPRHQMSPGSWKRLIILLSCVFGGGGTSLQNKNPHQPMTLTWQVLSQTGDVVWVTEAVQPLWTWWPSLKPDVCALAAGLESWDIPESDVSASKRIRPLDSNYNNANKQISWGAIGCSYPRARTRIANSPFYVCPRDGRTLSEARRCGELESLYCKEWGCETTGNVHWQPRSSWDLITVKWGRNRQWEQNMLSVCEQTGWCNPLKIDFTEKGKHSRDWIKGRTWGLRFNVAGHPGVQLTIRLKVTSMPAVAVGPDPVLAEQRPPSKPLPPPSREAPPTSLPPAASGQAPTVRERTVTLSTPPPTTGDRLFGLVQGAFLALNATNPGATESCWLCLAMGPPYYEGIASLGEVAYTSDHTRCRWGTQGKLTLTEVSGHGLCIGKVPSTHQHLCNQTLPINSSKDHQYLLPFNYSWWACSTGLTPCLSTSVFNQSRDFCIQIQLIPRIYYHPEGTLLQAYDNSHPRLKREPVSLTLAVLLGLGIAAGIGTGSTALIKGPMDLQQGLTSLQIAMDADLRAIQDSISKLENSLTSLSEVALQNRRGLDLLFLKEGGLCAALKEECCFYVDHSGAVRDSMRKLKERLDKRQLERQKNQNWYEGWFNSSPWFTTLLSTIAGPLLLLLLLLILGPCIINRLVQFINDRVSAVKILLRQKYQTLDNEDNL

SEQ ID NO: 15693 - protein, 669 aa, unidentified
MESTTLSKPFKNQVNPWGPLIVLLILRGVNPVTLGNSPHQVFNLTWEVTNGDRETVWAITGNHPLWTWWPDLTPDLCMLALHGPSYWGLEYRAPFSPPPGPPCCSGSSDSTPGCSRDCEEPLTSYTPRCNTAWNRLKLSKVTHAHNGGFYVCPGPHRPRWARSCGGPESFYCASWGCETTGRASWKPSSSWDYITVSNNLTSDQATPVCKGNKWCNSLTIRFTSFGKQATSWVTGHWWGLRLYVSGHDPGLIFGIRLKITDSGPRVPIGPNPVLSDRRPPSRPRPTRSPPPSNSTPTETPLTLPEPPPAGVENRLLNLVKGAYQALNLTSPDKTQECWLCLVSGPPYYEGVAVLGTYSNHTSAPANCSVASQHKLTLSEVTGQGLCIGAVPKTHQVLCNTTQKTSDGSYYLAAPTGTTWACSTGLTPCISTTILDLTTDYCVLVELWPRVTYHSPSYVYHQFERRAKYKREPVSLTLALLLGGLTMGGIAAGVGTGTTALVATQQFQQLQAAMHDDLKEVEKSITNLEKSLTSLSEVVLQNRRGLDLLFLKEGGLCAALKEECCFYADHTGLVRDSMAKLRERLSQRQKLFESQQGWFEGLFNKSPWFTTLISTIMGPLIILLLILLFGPCILNRLVQFIKDRISVVQALVLTQQYHQLKIIEDCKSRE

SEQ ID NO: 15694 - protein, 859 aa, unidentified
MVSIAFYGGIPGGISTPITQQSEKSKCEENTMFQPYCYNNDSKNSMAESKEARDQEMNLKEESKEEKRRNDWWKIGMFLLCLAGTTGGILWWYEGLPQQHYIGLVAIGGRLNGSGQSNAIECWGSFPGCRPFQNYFSYETNRSMHMDNNTATLLEAYHREITFIYKSSCTDSDHCQEYQCKKVNLNSSDSSNSVRVEDVTNTAEYWGFKWLECNQTENFKTILVPENEMVNINDTDTWIPKGCNETWARVKRCPIDILYGIHPIRLCVQPPFFLVQEKGIADTSRIGNCGPTIFLGVLEDNKGVVRGDYTACNVRRLNINRKDYTGIYQVPIFYTCTFTNITSCNNEPIISVIMYETNQVQYLLCNNNNSNNYNCVVQSFGVIGQAHLELPRPNKRIRNQSFNQYNCSINNKTELETWKLVKTSGVTPLPISSEANTGLIRHKRDFGISAIVAAIVAATAIAASATMSYVALTEVNKIMEVQNHTFEVENSTLNGMDLIERQIKILYAMILQTHADVQLLKERQQVEETFNLIGCIERTHVFCHTGHPWNMSWGHLNESTQWDDWVSKMEDLNQEILTTLHGARNNLAQSMITFNTPDSIAQFGKDLWSHIGNWIPGLGASIIKYIVMFLLIYLLLTSSPKILRALWKVTSGAGSSGSRYLKKKFHHKHASREDTWDQAQHNIHLAGVTGGSGDKYYKQKYSRNDWNGESEEYNRRPKSWVKSIEAFGESYISEKTKGEISQPGAAINEHKNGSGGNNPHQGSLDLEIRSEGGNIYDCCIKAQEGTLAIPCCGFPLWLFWGLVIIVGRIAGYGLRGLAVIIRICIRGLNLIFEIIRKMLDYIGRALNPGTSHVSMPQYV

SEQ ID NO: 15695 - protein, 990 aa, unidentified
MAPPMTLQQWLQWRYNLETTNLLQMNPKMESVCLPDFDPPGDEEVSLRIRCKYWIYLCCATSTRIMAWIVFILTVLSILLISVLIAVFRLQWKGAIESPGPILVWNNSNSINAQPTTPPHYSRLRRAIHLAQKPVQVNFTSIPQGLFLEPHPKPIISKERVLGLSQVVMVDSSTLTQKLNLEGEAKSLLIKTINEELISLQDVVLNFDLPLGDPHTQEEYIAKRCYQHFGHCYVVHIPGGKEWPTREIIQDQCPLNNSWLTALHYDYLPAWDYYNQPPPRQLSLKDFRKYNISNNGSRYEAYRLPLQDKIGAVAFCSPTLYSSWWNYTQSSREREELFRRKLETFLNPQTGCLNPEALPGTWHTLGKGEWFRDLTTYDFCKKPEAVFGLNKTYYSWSLWEGDCGRQGNDTQDYPPECRNYEKKDGVHVYGCRYWRTYSQTAHTPDNLSCYLSEDYCLFQPKWDSAEIRSDLGYLAYLGAFPSPICIEARNLTDQDYKVTSIYAECVKQGKQYDIIDVTRQLTSKLTRRGVFLGDLPADRAFSLLTDFSLPASYQNKTQDGRRKVCSSKRTRRSINNWRRLQITGQSMNQAITTLSKLSDLNDENLAAGIHLLQDHIVTLMEATLHDVSLLGHMTSIQHLHTHLATFKNLLIGNRVDWSVLENKWIQEELKYTDEVMNVIRRTARSITYDVQNVKNTSDSTMWEIYIYYELILPERIWIRNWQVANLGHLTHNSGYLTHVTIHHPYEIVNQDCEELTFLHLVDCHEQDYLICEEVMEVEPCGNLTGSDCPVLAENIQAPYVYLHPLKNGSYLLMASHTDCSLPPYEPVVVTVNDSLECYGKPLKRPLTSHTEIKLFAPQIPQLRVRLPHLVGIIAKLKSLKIKVTSTWESIKDQIHRSEQELLRLDLHEGDYSDWILQLGNALEDVWPVAASAVSTIGTLLEKAAGTLFGNVFSILAYAKPVIIGIILIILLLLVIRILRWLAVERRRKQE

SEQ ID NO: 15696 - protein, 986 aa, unidentified
MTPPMTLPEWMQWRYRQNVNKIREAIPDVQIDLPVYNPDMTKPLPLCLRIKYWMYLLCATSPRVMAWLLFVCVLISVMIIAVIVTVFRMQWKAAIDVPGPVLFWNHTDVLTHVPPVGPHVTRLRRAVHLADRAVNINITHIPQGVFLEPFPKPIIDKERVLGISQIVMIDSGSIAQSMNLDLYMKHLLVDMINEEMVALSNVVLPFELPVGDPSTQDQYIHKRCYQQFAHCYIVWQPGRRVWPTSEIIQDQCPLPDHPYRPLGYMQQNAYDLYLQPPRYGLQNVNLTSLYGIARIGAYRVLYPEQYNATIFCSDQLYGNWWYLNRTSEQKEETYRKKMLNLTENNSSILKDRALPPTWTPKGQARLFRELNPLDFCTKPEAVMLLNQSYYTWSLWEGDCYVYSRNISFPPECINYTRIANKTAHPYACRHWRLLSTNNEGKDEIKCSEYGCLFYPKYDQFELANDFGFLAYQKMFPSPICIQNYSLSTEPYKVQSLYQECIQKGTSYDLEDVINQLLRVLQNNGIDLGKVPASRAFTPFYNQMPVSYKKRDVTKRKSCGRRKRGDNFRKLQTSGLSMNQAISTLAKISDLNDENLAAGIHLLQEHIVTLMEATVHDISMLEAAHGLQILHTHLSTLRLLLTENRVDWNLIDSTWIQQQLQADEALMNVIRRTARSMTYRVIQQINRPDMTLWELGIYYELIIPKKVWLTNWKIQNIGHLIKNAGHLARVELQHPYEIVNQDCEQLTYLELKGCQELDYLVCEEILQHEPCGNQTGSDCPVTAQKIKDPYVWIYPLKNGSYLIMSSHTDCAIPPYEPVLVTVNDTVRCFGTTLKKPLRTSLETFTFQPHIPQLQVRLPHLVGLIAKIKGLKIEITSTWENIKDQIKRSEAELLRLDLHEGDYAEWTKQLGKALEDIWPAAAQTVSKIGDFLGKIADGIFGTTFSLLTYAKPVIIGIVVIVLLILIIRILSWLAALGPRRRRREDKGE

SEQ ID NO: 15697 - protein, 982 aa, unidentified
MEQEHVMTLKEWMEWNAHKQLQKLQSTHPELHVDIPEDIPLVPEKVPLKMRMRYRCYTLCATSTRIMFWILFFLLCFSIVTLSTIISILRYQWKEAITHPGPVLSWQVTNSHVTMGGNTSSSSRRRRDIQYHKLPVEVNISGIPQGLFFAPQPKPIFHKERTLGLSQVILIDSDTITQGHIKQQKAYLVSTINEEMEQLQKTVLPFDLPIKDPLTQKEYIEKRCFQKYGHCYVIAFNGNKVWPSQDLIQDQCPLPPRFGNNLKYRNHTIWKYYIPLPFKVSSNWTRVESYGNIRIGSFKVPDEFRQNATHGIFCSDALYSNWYPRDLPSSVQQSFAQAYITKVLMKRKKQPTLRDIAFPKELSPVGSGMLFRPINPYDICNMPRAVLLLNKTYYTFSLWEGDCGYYQHNLTLHPACKNFNRTRQDHPYACRFWRNKYDSESVQCYNNDMCYYRPLYDGTENTEDWGWLAYTDSFPSPICIEEKRIWKKNYTLSSVLAECVNQAMEYGIDEVLSKLDLIFGNLTHQSADEAFIPVNNFTWPRYEKQNKQQKTSCERKKGRRQRRSVSTENLRRIQEAGLGLANAITTVAKISDLNDQKLAKGVHLLRDHVVTLMEANLDDIVSLGEGIQIEHIHNHLTSLKLLTLENRIDWRFINDSWIQEELGVSDNIMKVIRKTARCIPYNVKQTRNLNTSTAWEIYLYYEIIIPTTIYTQNWNIKNLGHLVRNAGYLSKVWIQQPFEVLNQECGTNIYLHMEECVDQDYIICEEVMELPPCGNGTGSDCPVLTKPLTDEYLEIEPLKNGSYLVLSSTTDCGIPAYVPVVITVNDTISCFDKEFKRPLKQELKVTKYAPSVPQLELRVPRLTSLIAKIKGIQIEITSSWETIKEQVARAKAELLRLDLHEGDYPEWLQLLGEATKDVWPTISNFVSGIGNFIKDTAGGIFGTAFSFLGYVKPVLLGFVIIFCIILIIKIIGWLQNTRKKDQ

SEQ ID NO: 15698 - protein, 982 aa, unidentified
MEQEHVMTLKEWMEWNAHKQLQKLQLTHPELHVDIPEDIHLVPEKVPLKMRMRYRCYTLCATSTRIMFWILFFLLCFSIVTLSTIISILRYQWKEAITHPGPVLSWQVTNSHVTVGGNTSSSFRRRRDIQYHKLPVEVNISGIPQGLFFAPQPKPILHKERTLGLSQVILIDSDTITQGHIKQQKAYLVSTINEEMEQLQKTVLPFDLPTKDPLTQKEYIEKRCFQKYGHCYVIAFNGNKVWPSQDLIQDQCPLPPRFGNNLKYRNHTIWKYYIPLPFKVPSNWTRINSYGNIRIGSFKVPDEFRQNATHGIFCSDALYSDWYPRDLPSSVQQSFAQAYIAKVLMKRKKQPTLRNIAFPKELSPVGSGMLFRPFNPYDICNMPRAVLLLNKTYYTFSLWEGDCGYYQHNLTLHPACKNFNRTRQDHPYACRFWRNKYDSESVQCYNNDMCYYRPLYDGTENTEDWGWLAYTNSFPSPICIEEKRVWKKNYTLSSVLAECVNQAMEYGIDEVLSKLDVIFGNLTHQSVDEAFIPVNNFTWPKYEKQNKQQKTSCEGRKNRRQRRSVSTENLRRMQEAGLGLANAITTVAKISDLNDQKLAKGVHLLRDHVVTLMEANLDDIVSLGEGIQIEHIHNHLTSLKLLTLENRIDWRFINDSWIQEELGVSDNIMKVIRKTARCIPYNVKQTRNLNTSTAWEIYLYYEIIIPTTIYTQNWNIKNLGHLVRNAGYLSKVWIQQPFEVLNQECGTNIYLHMEECVDQDYIICEEVTELPPCGNGTGSDCPVLTKPLTDEYLEIEPLKNGSYLVLSSTTDCGIPAYVPVVITVNDTISCFDKEFKRPLKQELRVTKYAPSVPQLELRVPRLTSLIAKIKGIQIEITSSWETIKEQVARAKAELLRLDLHEGDYPEWLQLLGEATKDVWPTISNFVSGVGNFIKDTAGGIFGTAFSFLGYVKPVLLGFVIIFCIILIIKVIGWLQTTRKKDQ

SEQ ID NO: 15699 - protein, 989 aa, unidentified
MAPPMTLQQWLVWDRMQKANEALKSTTAVSEEEKEHLILEIQNEEIIPTKVDRVKYLLYTCCATTTRTLAWLFLFCVLLIVVLVTCFITIARIQWNQDIQVYGPVIDWNISHQAIYKPLLMKRLARSIRTHYPIPKNVEVNMTSIPQGVYYEPHPEPIIVKERVLGLSQVIMINSETVANSANLTQEAKVLLADMVNEELQGLADVMIDFEIPLGDPRDQDQYIHRKCFQEFAHCYLVKYKDPKGWPSEKLIVDQCPIPGVHIPSIYKYQAIWDYYIPFQMMRPENWKAEDVYGQARIESYYVPKIFQNNNISHVLFCSDRLYNKWYTTENTLLQNEELLIIKLTNLTKKDAQLKERALPPSWSTEGKSLLFREANTLDICNIPEAILLLNTTYYNFSLWEGDCGYDGKNITNMLTSCKDFYTQASKSKHPYACRFWRYKTEKEETKCYDNKDKTRCLYFPKWDTAEELYDFGFLAYLGHFPSPICIKEHKIKEVKYSVYSLYQECINKASTYGIGNVVEGIKELLNSTGTPVNEMPNARAFVGLVNPDFPPLYKNKTSQERESCFNRRNRRSLDNNYVKLRSMGYSLTGAVQTLSKISDINDENLQQGLYLLRDHLVTLMEATLHDISLMEGMLAVQHLHTHLNHFKTMLLERRIDWTFINSDWLQQQLQQPTDHMKIIKRTARSLVYYVEQTSNSPTATSWEVGIYYEIIIPKHIYLNNWQIKNIGHLIHSAGQLTHVTIDHPYEILNRECEETKYLHLEQCIKQDYVICDIVERVQPCGNTTGTTDCAVYAKAIKSPYTEILPLKNGSYLVLSDSTSCNILPYIPSIVTVNETVECFGVLFKKPLTAERKTDYTPHIPPLRLRLPHLLGIIAKLKNIKIEVTSTQENIKDQIERAKAELLRLDIHEGDSPAWIKQLAAATEDVWPTLATGLKSIGNFLSDAAQGIFGTAFGILGYVKPILIGVGIILLIVVIFKIISWIPIKRKSQ

SEQ ID NO: 15700 - protein, 985 aa, unidentified
MAPPMTLQQWIIWNKMNKAHEALQNTTTVTDQQKEQIILEIQNEEIQPTRKDRFKYLLYTCCATSTRVLAWIFLVCVSLIIVLVSCFVTISRIQWNKDIQVLGPVIDWNVTQRAVYQPLQTRRIARSLRMQHPVPKYVEVNMTSIPQGVYYEPHPEPIVVTERVLGLSQVLMINSENIANNANLTQEVKKLLTEMVNEEMQSLSNVMIDFEIPLGDPRDQEQYIHRKCYQEFAHCYLVKYKEPKSWPTDGLIADQCPLPPLHGSSPYPYQAIWDYYARVENIRPEKWTSKQKYGDARIGSFFIPKGIRNKNVTHVLFCSDIMYSKWFNNLNTLQQNEVELTKRLLNLTNGNKLKNRALPSEWANGGLNRLFRNSTLLDVCNKPEMIILLNRTYSSFSLWEGDCNITKDTIDDKVPECKNHSKNKRNDHPYACRFWRYKEGKEEVKCFTADKQRCLYYPEYSNPEALFDFGFLASQRNFPAPICIEQQQIRDQDYEVYSLYQECKIASKVHGIDTVLFSLKNFLNYTGIPVNEMPNARAFVGLVDPKFPPSYPNVTREHYTSCNNRKRRSVDNNYAKLRSMGYALTGAVQTLSQISDINDEKLQQGIYLLRDHVITLMEATLHDISVMEGMFAVQHLHTHLNHLKTMLLERRIDWTYMSSAWLQQQLQKSDDEMKVIKRIARSLVYYVKQTYNSPTATAWEIGLYYELVIPKHIYLNNWNVVNIGHLVKSAGQLTHVTIAHPYEIINKECVETVYLHLEDCRRQDYVICDVVKIVQPCGNSSDTSDCPVWAEAVKEPFVQVNPLKNGSYLVLASSTDCQIPPYVPSIVTVNETTSCYGLDFKKPLVAEERLSFEPRLPNLQLRLPHLVGIIAKIKGIKIEVTSSGESIKEQIERAKAELLRLDIHEGDTPAWIQQLAAATRDVWPAAASALQGIGNFLSGAAQGIFGTAFSILGYLKPILIGVGVILLIILIFKIVSWIPTKKKNQ

SEQ ID NO: 15701 - protein, 988 aa, unidentified
MAPPMTLQQWIIWNKMNKAHEALQNTTTVTEQQKEQIILDIQNEEVQPTRRDKFRYLLYTCCATSSRVLAWIFLVCILLIIVLVSCFVTISRIQWNKDIQVLGPVIDWNVTQRAVYQPLQTRRIARSLRMQHPVPKYVEVNMTSIPQGVYYEPHPEPIVVKERVLGLSQILMINSENIANNANLTQEVKKLLTEMVNEEMQSLSDVMIDFEIPLGDPRDQEQYIHRKCYQEFANCYLVKYKEPKPWPKEGLIADQCPLPGYHAGLTYNRQSIWDYYIKVESIRPANWTTKSKYGQARLGSFYIPSSLRQINVSHVLFCSDQLYSKWYNIENTIEQNERFLLNKLNNLTSGTSVLKKRALPKDWSSQGKNALFREINVLDICSKPESVILLNTSYYSFSLWEGDCNFTKDMISQLVPECDGFYNNSKWMHMHPYACRFWRSKNEKEETKCRDGETKRCLYYPLWDSPESTYDFGYLAYQKNFPSPICIEQQKIRDQDYEVYSLYQECKIASKAYGIDTVLFSLKNFLNYTGTPVNEMPNARAFVGLIDPKFPPSYPNVTREHYTSCNNRKRRSVDNNYAKLRSMGYALTGAVQTLSQISDINDENLQQGIYLLRDHVITLMEATLHDISVMEGMFAVQHLHTHLNHLKTMLLERRIDWTYMSSTWLQQQLQKSDDEMKVIKRIARSLVYYVKQTHSSPTATAWEIGLYYELVIPKHIYLNNWNVVNIGHLVKSAGQLTHVTIAHPYEIINKECVETIYLHLEDCTRQDYVICDVVKIVQPCGNSSDTSDCPVWAEAVKEPFVQVNPLKNGSYLVLASSTDCQIPPYVPSIVTVNETTSCFGLDFKRPLVAEERLSFEPRLPNLQLRLPHLVGIIAKIKGIKIEVTSSGESIKEQIERAKAELLRLDIHEGDTPAWIQQLAAATKDVWPAAASALQGIGNFLSGTAQGIFGTAFSLLGYLKPILIGVGVILLVILIFKIVSWIPTKKKNQ

SEQ ID NO: 15702 - protein, 979 aa, unidentified
MAPPMNLQQWLLWKKMNDAHMALEHVSTLTEEQKQQVILEIQQEDVIPTRMDKVKYLAYACCATSTRVMCWLLLICVLLIIVFVSCFITIARLQWNKDIVTLGPVIDWNVTHQATYQQLKAARLTRSLRVQHPSISYVSLNISSLPQGIIYVPHPEPIILKERVLGISQVLMINSENIANAANLTQETKVLLTDMINEELQDLSDQMIDFELPLGDPRDQEQYIHHKCYQEFAHCYLVKYKNPSPWKQEGLIADQCPLPGIHDPTYYKPQSIWDYYLKIKNIRPQGWTSKQYYGTARMGSFYIPKSVRNDSFSHVLFCSDQLYGKWYNIDNNIKLNEELLITKLWNLTIKSKLKARALPKEWNKQGNSRIFRSLQPLDICNRPEAVILLNTTYYTYSLWEGDCNYTTAHIANLSECKEVNRLRHPYSCRFWRYKEGKEEVKCLGHEKIRCLYYSEYSSPEAQFDFGFLSYLNSFPGLKCIENQTVREPEYEIYSLYMECMNAAKIHGIESVLFALKTFLNFTGTPVNEMPTARAFVGLADPKFPPVYPNITKEQKTCEKARKRRSTNIEKLRSMGYSLTGAVQTLSQISDINDENLQQGVYLLRDHIVTLMEAALHDITIMEGMLAIQHVHTHLNHLKTMLLLRKIDWTFIRSNWIQEQLQKSEDEMKIIRRTAKSLVYYVTQTSSSPTATSWEIGIYYEITIPKHIYLNNWQVINIGHLVESAGHLTLVKVKHPYEIINKECNYEQYLHLEECISQDYVICDIVQVVSPCGNSTVSSDCPVTAIKVKEPYIQISALKNGSYLVLSSRKDCSIPAYVPSVVTVNETVQCFGVEFRKPLYSETKLSFEPQVPHLKLRLPHLVGIIANLQNLEIEVTSTQESIKDQIERARSQLLRLDIHEGDFPAWIKQLASATRDVWPAAATVLQGIGNFLTNTAQGIFGTTVSILSYAKPILIGIGVILLIAFLFKIVSWLPGKKKRN

SEQ ID NO: 15703 - protein, 981 aa, unidentified
MAPPMTLEQWLLWKKMNQAHQALENVTVLTEEQKQQVIVDIQQEEVIPTRMDKLKYLAYSCCATSTRVLCWIVLICVLLLVVFISCFVTMSRIQWNKDIAVLGPVIDWNVSQQAVIQQIRAKRLARSLRVEHATEAYVEINMTSIPQGVLYVPHPEPIILKERVLGLSQVIMINSENIANTANLTQETKVLLADMINEEMSDLANQMIDFEIPLGDPRDQKQYQHQKCYQEFAHCYLVKYKKPMSWKSEGIIVDQCPLPGLHSPTYYQYQAIWDYYLKIYNIRPKDWKSKDYFGTARMGSFYIPSELRNSTYTHVLFCSDQLYGKWYNAKNTVRENEEILVTKLYNLTNGSKLKNRSLPKEWNKQGSNRLFRSFQPLDICNRPEAVILLNTTYYTYSLWEGDCNYTQQHIQNLSECKNLNRLKHPYACRFWRYKEGQEEVKCLGNEQKNCLYYSEYSSPEAQFDFGFLAYLNSFPGLRCIENQTIRDPDYEVYSLYMECMNASDKYGIDSALLALKTFLNFTGQSVNEMPLARAFVGLTDPKFPPTYPNVTRETSGCNNNKRQRRSINNYERIRSMGYALTGAVQTLSQISDINDERLQQGVYLLRDHVVTLMEAALHDVSIMEGMLAIQHVHTHLNHLKTMLLMKRIDWTFIKSDWIQQQLQKSEDEMKLIRRTAKSLVYYVTQTSSSPTATSWEIGIYYEITIPKHIYLNNWQVINVGHLVESAGHLTHVKVKHPYEIINRECSNTQYLHLEECIREDYVICDIVQIVQPCGNETELSDCPVTALKIKSPYIQVSPLKNGSYLILSSTKDCSIPAYVPSVVTVNETVKCFGVEFHKPLYAETKTSYEPQVPHLKLRLPHLTGIIASLQSLEIEITSTQENIKDQIERAKAQLLRLDIHEGDFPDWLKQVASATKDVWPAAASFLQGVGNFLSNTAQGIFGSAVSLLSYAKPILVGIGVILLIALLFKIISWLPGKIKKN

SEQ ID NO: 15704 - protein, 989 aa, unidentified
MAPPMTLEQWLLWKKMNQAHQALENVTVLTEEQKQQVIVDIQQEEVIPTRMDKLKYLAYSCCATSTRVLCWIVLICILLLVVFISCFVTMSRIQWNKDIAVLGPVIDWNVSQQAVIQQIRAKRLARSLRVEHATEAYVEINMTSIPQGVLYIPHPEPIILKERVLGLSQVIMINSENIANTANLTQETKVLLADMINEEMNDLANQMIDFEIPLGDPRDQKQYQHQKCYQEFAHCYLIKYKTAKGWSSSTVIADQCPLPGNHPTVQYAHQSIWDYYIPFEQIKPEGWTSKTYYEDARVGGFYIPKRLRNNSYTHVLLCSDQIYGKWYNIDLTTQERERLLVQKLINLTKGNTSQLKDRAMPTEWNKQGKANLFRQINPLDVCNRPEMVFLLNSSYYEFSLWEGDCGFTRQNATQANPLCKDFYNNSKWKNLHPYACRFWRYKQEKEETKCSNGEKKRCLYYPQWDSPEALYDFGFLAYLNAFPSPICIKNQTIRDPEYEVYSLYMECMNASDRYGIDSALLALKTFLNFTGQSVNEMPLARAFVGLTDPKFPPTYPNVTRETSGCNNNRRQRRSINNYEKIRSMGYALTGAVQTLSQISDINDERLQQGVYLLRDHVVTLMEAALHDVSIMEGMLAIQHVHTHLNHLKTMLLMRKIDWTFIRSDWIQQQLQKSEDEMKLIRRTAKSLVYYVTQTSSSPTATSWEIGIYYEITIPKHIYLNNWQVINVGHLVESAGHLTHVKVKHPYEIINRECSNTQYLHLEECIREDYVICDIVQIVQPCGNETELSDCPVTALKIKSPYIQVSPLKNGSYLILSSTKDCSIPAYVPSVVTVNETVKCFGVEFHKPLYAETKTSYEPQVPHLKLRLPHLTGIIASLQSLEIEITSTQENIKDQIERAKAQLLRLDIHEGDFPDWLKQVASATKDVWPAAASFLQGVGNFLSNTAQGIFGSAVSLLSYAKPILVGIGVILLIALLFKIISWLPGKIKKN

SEQ ID NO: 15705 - protein, 986 aa, unidentified
MAPPLTLQEWMLWNKKRNLETWTNNSSALTSEAKQMLLDEAEDINNLGKPTLKHRFSYLCYLACATTTRIVGWIVFVCLLIAVICITCFVTMARMQWKQAIITHGAVIDWNQTTHKIIPVALRSKRSPRDLVRIVEEKWIEINATGIPQGVYLTPHPKPIIVKERILGLSQIVLINSESIASSMEIKQEHKSLLTKIINEEMKSLRDVMLDFELPLDDPKTQKEYIQQRCFQEFKDCYLVKYNTPNKPWPTDYVLQDMCPLPGGEYPPQNAWNYYLKIQNIRPKDWTSGKYYGSARMGGFWVPPKLKQQNFTHVLFCSNKLYGKWYNSTNTVELNENLLLKRLTNLFMNNESSSQLKNRAMPREWHSSGQNALFRNITRIDYCMLPEAVILLNTTKTDYSLWEGDCNIYTNNVTKHPACANFDYKDRPKLHPYTCRHWRLKEQEQTKCLGEQTNKCIYYPAYSSPEYLWDFGWLAYNGNFPSPVCEQQEKIREPKYELYSLYGECMRATEQLSLEQVLLGLHGFIRFQHDPITQMPKERAFIGLDSPKWPPIYPNVTGETRASCPSKRQRRDVDNNWNKLQKAGYAITNSVKQIAQISDLNDESIVSGLYLLRDHVVTLMEATLHDVSALEDSIAIQHFHTHLMQLKLLLMENRVDWSYIDTQWIKTQLQLNDEDMKVLRRTARALVYNIDHIEDTKTSTIWEIAMYYEIIVPSVIYSTNWNVQNVGHLIASAGSLTLVKVKHPYEIINQECGIIKYLHIENCQETDYVICDTIEEVQPCGNQTGSDCPVLAEPVPDGFHVIESLKNGSYIYMSHYQDCSLTPYIPQVVTVNATIKCLGRNLKPPLSQTEAETNLVLTPQVPRLKIQLPHLVGVITKLKGIQVKITSTWETIKDQIDRAQAELLRLDLHEGDSANWLKQLSKATEDIWPAAAATFGKVGDFLSGTFGGLFGTLGYIKPIIVGIVILLLIVIVCKILSWLPSKRKTQ

SEQ ID NO: 15706 - protein, 980 aa, unidentified
MARPMTLHEWLKWKKTNAVRQLTENLQSLPPEQKELLIQEIEEEDVPTPSWTQKCSYMCYLACATTTRIMGWIIFTLIIASVILVTCFVVMARIQWRNAITVPGIILDWNSTSHEVFPMPQNKRRSARDLIRILEENIVEINTTSLPQGILFEPHPKPIIGKERVLGLSQVILINSESIATSLEIKQEHKHILVEMIKEELLSLQNVMLNFDLPLGDPKTQQEYISQRCFQEFKHCYLVAYNETQKPWPTDDVVQDMCPLPGNGYSPQNAWDYYLEIKNIRPENWTSKDYFGSARMGGFWVPPWLRQNNYTHVLFCSDQLYEKWYIPYGLTEENDVKLMNKLKTLLNGTNKLKARALSAYWHPQGQNKLFRNITRLDYCKYPEAVILLNTTKSDYSLWEGDCNIWAHNITVHPACKNFNFSEKSKVHPYTCRHWRFKEGPEQTKCLEDKTQCLYYSEYSSPSYLQDFGWLAYQGHFPSPICEKETKIRMPGYTVYSLFGECLNAAQQHGIERALIGLHAFMNFTKTPLQEVNKERAFIGLDSPKWPPTYPNITIFSVDKCKTEKRKKREIHNWGKLQAVGFTITNTVSKIARIIDLNNEHLVSGLYLLKDHLVTLMESTLHDISILGNAVAIQHFHTHLTQLKLLLMENRMDWTFIDSSWIQDQLKLSDEDMKILRRASRALVYKVEEIGEGVTSTIWEIGIYYEIIIPRVIYSTNWKIMNLGHLVYSADNLVQINVEQPYEILNVECGKSTYLHIDKCEEQDYVICEVIQEKQPCGNQSGSDCPVKARTIEKGYTYIQPLKNGSYVVMSHFQDCHIKPYIPQIVTVNATVKCLGEVFQPPLVPGNSSTEVLPVTTSLKLQLPHLVGIITKLKGFQVQITSTWESIKGQVEQAQAELLRLDLHEGDSGQWIKQLASASKDIWPAAATVLGKIGDFLGGTAGSIFGIFGYLKPIFIGLTILILIVLVFKILSWLPTKRKAQ

SEQ ID NO: 15707 - protein, 989 aa, unidentified
MAPPMTLEQWLLWKKMSQAHQALENVTTLTEEQKQQVIIDIQHEDVVPTRMDKLKYLAYSCCATSTRVLCWIVLVCVLLLVVFISCFVTMSRIQWNKDIAVFGPVIDWNVSQQAVIQQIRAKRLARSIRVEHATETYVEVNMTSIPQGVLYVPHPEPIILKERVLGLSQVIMINSENIANTANLTQETKVLLADMINEEMNDLANQMIDFEIPLGDPRDQKQYQHQKCFQEFAHCYLVKYKTTKGWPSSTVIADQCPLPGNHPTVQYAHQNIWDYYVPFEQIRPEGWNSKSYYEDARIGGFYIPKWLRNNSYTHVLFCSDQIYGKWYNIDLTAQERENLLVRKLINLAKGNSSQLKDRAMPAEWDKQGKADLFRQINTLDVCNRPEMVFLLNSSYYEFSLWEGDCGFTRQNVTQANSLCKDFYNNSKWQKLHPYSCRFWRYKQEKEETKCSNGEKKKCLYYPQWDTPEALYDFGFLAYLNSFPSPICIKNQTIREPEYEISSLYLECMNASDRHGIDSALLALKTFLNFTGQSVNEMPLARAFVGLTDPKFPPTYPNITRESSGCNNNKRKRRSVNNYERLRSMGYALTGAVQTLSQISDINDERLQHGVYLLRDHVVTLMEAALHDVSIMEGMLAIQHVHTHLNHLKTMLLMRKIDWTFIRSDWIQQQLQKTDDEMKLIRRTARSLVYYVTQTSSSPTATSWEIGIYYEIVIPKHIYLNNWQVINVGHLLESAGHLTHVKVKHPYEIINKECSDTQYLHLEECIREDYVICDIVQIVQPCGNATELSDCPVTALKVKTPYIQVSPLKNGSYLVLSSTKDCSIPAYVPSVVTVNETVKCFGVEFHKPLYAETKTSYEPQVPHLKLRLPHLTGIIASLQSLEIEVTSTQENIKDQIERAKAQLLRLDIHEGDFPDWLKQVASATRDVWPAAASFIQGVGNFLSNTAQGIFGSAVSLLFYAKPILIGIGVILLIALLFKIISWLPGKLKKN

SEQ ID NO: 15708 - protein, 988 aa, unidentified
MAPPMTLQQWIIWNKMNKAHEALQNSTTVTDQQKEQIILEIQNEEVRPTRKDKIRYLLYTCCATSSRVLAWMLLVCVLLIVVLVSCFLTISRIQWNRDIQVLGPVIDWNVTQRAVYQPLQTRRIARSLRMQHPVPKYIEVNMTSIPQGVYYEPHPEPIVVTERVLGLSQVLMINSENIANNANLTQEVKKLLAEVVNEEMQSLSDVMIDFEIPLGDPRDQEQYIHRKCYQEFAHCYLVKYKTPKSWPTEGLIADQCPLPGYHAGLSYKPQSIWDYYIKVEITRPANWSSQAVYGQARLGSFYVPKGIRQNNYSHVLFCSDQLYSKWYNIENSIEQNEKFLLNKLDNLTTGSSLLKKRALPKEWSSQGKNALFKEINVLDVCSKPELVILLNTSYYSFSLWEGDCNFTKNMISQLVPECEGFYNNSKWMHMHPYACRFWRSKNEKEETKCRPGEKEKCLYYPYQDSLESTYDFGFLAYQKNFPAPICIEQQEIRDKDYEVYSLYQECKLASKVHGIDTVLFSLKNFLNHTGRPVNEMPNARAFVGLVDPKFPPSYPNVTREHYTSCNNRKRRSTDNNYAKLKSMGYALTGAVQTLSQISDINDENLQQGIYLLRDHVITLMEATLHDISVMEGMFAVQHLHTHLNHLKTMLLERRIDWTYMSSAWLQQQLQKSDDEMKVIKRIAKSLVYYVKQTYNSPTATAWEIGLYYELTIPKHVYLNNWNVVNIGHLVQSAGQLTHVTIAHPYEIINKECTETKYLHLKDCRRQDYVICDVVEIVQPCGNSTDTSDCPVWAEAVKEPFVQVNPLKNGSYLVLASSTDCQIPPYVPSIVTVNETTSCYGLNFKKPLVAEERLGFEPRLPNLQLRLPHLVGIIAKIKGLKIEVTSSGESIKDQIERAKAELLRLDIHEGDTPAWIQQLAAATKDVWPAAASALQGIGNFLSGAAHGIFGTAFSLLGYLKPILIGVGVILLIILIFKIVSWIPTKKKSQ

SEQ ID NO: 15709 - protein, 987 aa, unidentified
MAPPMSLQQWIIWNKMHQAHQALQNSTLVTEEQKEQIILEIQNEDVIPTRMDRVKYFLYTCCATSSRVLAWMLLACILFIIIIVSCFITLSRIQWNKDIQVLGPVIDWNVTQRAVYQPLQLRRIARALRAQHPVPKYVEVNMTSIPQGVFYQPHPEPIIHTERVLGLSQVLMINSENVANSANLSQETKVLLTEMINEEMQSLSDVMIDFEIPLGDPRDQEQYIHRKCYQEFAHCYLVKYKTPQPWPNEGLIVDQCPLPGLADVSFYPYQAIWDYYAKIENIRPANWTSSKLYGKARIGSYYIPKRLRNMNNTHILFCSDVLYSKWYNLQNSILQNENELTKRLSNLTIGNKLKNRALPYEWAKGGLNRLFRNISVLDVCSRPEMVLLLNKTYYTFSLWEGDCNITRYNINETVPECKDFPHRRFNDHPYSCRLWRYKEGKEEVKCLTSDHTRCLYYPEYSNPEALFDFGFLSYMKNFPGPQCIESTVIRQQDYEVYSLYQECKLASKIHGIDSVLFSLKNFLNYTGKPVNEMPNARAFVGLIDPKFPPTYPNITRDQYQGCNINQRRKREVNNNYSKLRSMGYALTGAVQTLAQISDINDQNLQQGIYLLRDHIVTLMEATLHDISIMEGMFAVQHVHTHLNHLRTMLMERRIDWTYMSSSWLQTQLQKSDDEMKVIKRTARSLVYYVKQTYNSLTATAWEIGLYYELIIPRHIYLNNWQVVNIGHLIKSAGQLTHVTVSHPYEIINRECSNTLYLHLEECRRLDYVICDVVKIVQPCGNSSDSSDCPVWAEPVKEPHVQISPLKSGSYLVLASSTDCQIPPYVPSVVTVNETTQCFGVTFKKPLVAEEKTSLEPQLPHLQLRLPHLVGIIAKIKGIKIEVTSSGESIKDQLERAKAELLRLDIHEGDTPAWIRQLAAATEDVWPAAASALKGIGNFLTGAAQGLFGTAFSILGYLKPILIGIGIIILVILIFKILRWIPMKKKSQ

SEQ ID NO: 15710 - protein, 983 aa, unidentified
MAPPMSLTEWILWNKKRNMTIMTSNLTGITPDQKKALLDEIDEEEPFIKPTIQQRLSYTCYLACATTTRIMIWILFCVIVLTVALIICFTTAARIQWRHAIITPGPVIDWNSTIHKVIPAQQRARRFARDLIKVTEERYVEVNATGIPQGVILLPHPKPIIQKNRVLGLSQILLINSESLASIFNIKQEHKSILTEIIQEEMRSLQDITLNFDLPIGNPKTQHEYIQSRCFQEFKDCYLVKYQDNNKPWPTDDVLADMCPLPGGEGLPQNAWDYYLEISNIRPENWTSATYFGQARMGGFWVPPKLKQRNFTHVIFCSDQLYGQWYNASNSKKTNEELLLSKLDKLLNNTNKLRSRALPAEWNTQGQNRLFRNLSRIDYCKLPEAVVLLNSTKYDYSLWEGDCEIYRNNVTKHPSCKNFNYSTKFKVHPYTCRHWRYIEGEEKTDCFTADKTRCLYYSYYSSPSFLWDFGWLAYNNHFPSPVCVKETKIREAKYEVYSLYGECIQATKTYTIDQVLVGLHGFLSFYKTPVQDLPKERAFLGLDNPKWPPRYPNMTNEQKIRCIDQNKRTRRDATNWQKLQKAGYAITNAVTQIAKITDLNNEAIVSGIYLLKDHIVTLMEATLHDVSALGNVVTIQHFHTHLAQFKLLLVENRIDWNYIDSRWIQDQLGLDEADMKILRRTARALIYNVEEIDFRPTSTTWEIALYYEIIVPGKVYSTNWEVHNIGHLVDSAGSLTLVTIQHPYTIVNQECGETKYLHMEECTEQDYKICEQVTEVLPCGNLTGSDCPVLAKTVKPGYVHIESLRNGSYIYMAHYQDCGIKPYVPQIVTVNATVKCLGYEIQPPLQFEETTSSLTPQVPSLKLRLPHLVGILAKLKNIQIQVTSTWESIKDQVEKSQTELLRLDIHEGDTPAWIKQLAESTKDIWPTTANIFGKVGEFLSGTFGGLFGTLGYIKPIILGIVILLLIVIVVKIISWLPSKKKQN

SEQ ID NO: 15711 - protein, 983 aa, unidentified
MAPPMSLTEWILWNKKRNMTIMTSNLTGITPDQKKALLDEIDEEELFIKPTIQQRLSYTCYLACATTTRIMIWILFCVIVLAVALITCFTTAARIQWRHAIITPGPVIDWNSTIHEIIPAQQRTRRFARDLIRVTEEKYVEVNATGIPQGIILLPHPKPIIQKNRVLGLSQILLINSESLASIFNIKQEHKSVLTEIIQEEMRNLQDVTLNFDLPIGDPKTQHEYVQSRCFQEFKDCYLVKYQENNKPWPTDDVIADMCPLPGGESLPQNAWDYYLEISNIRPQNWTSATYFGQARMGGFWVPPKLKQQNFTHVLFCSDQLYGQWYNLSNSKETNERLLMNKLDKLLNNTNKLRNRALPVDWNTQGQNRLFRNLSRLDYCKLPEAVVLLNSTKYDYSLWEGDCGIYRNNVTEHPSCKNFNYSTKFKVHPYTCRHWRFIEGEEKTDCFTADKTNCLYYSYYSSPSYLWDFGWLAYNNHFPSPICVKETKIREAKYEVYSLYGECMQATKAYTIDQVLVGLHGFLNFQKTPVQDMPKERAFIGLDNPKWPPYYPNMTIEQKIKCKDRNKRNRRDTNNWQKLQKAGYAITNAVTQIAKITDLNNEAIVSGIYLLRNHIVTLMEATLHDVSALGDAVTIQHFHTHLAQFKLLLIENRVDWNYISSKWIQEQLNLDDADMKILRRTAKALVYNVEELDSRPTSTTWEIALYYEIIIPGQVYSTNWEVHNIGHLVDSAGSLTLVTVQHPYTIVNQECGETKYLHIEECTEQDYIICEQVTEVLPCGNQTNSDCPVLAKTVNPGYVHIEPLKNGSYIYMAHYQDCGIKPYVPQIVTVNATVKCLGHEIQPPLQFEETASSLTPQVPSLKLRLPHLVGVIVKLKNIQIQVTSTWESIKDQVERSQTELLRLDIHEGDTPAWIRQLAESTKDIWPAAANIFGKVGEFLSGALGGLFGTLGYIKPIILGIVILLLIVVVVKIISWLPSKKKQN

SEQ ID NO: 15712 - protein, 988 aa, unidentified
MAPPMTLQQWIIWKKMNKAHEALQNTTTVTEQQKEQIILDIQNEEVQPTRRDKFRYLLYTCCATSSRVLAWMFLVCILLIIVLVSCFVTISRIQWNKDIQVLGPVIDWNVTQRAVYQPLQTRRIARSLRMQHPVPKYVEVNMTSIPQGVYYEPHPEPIVVKERVLGLSQILMINSENIANNANLTQEVKKLLTEMVNEEMQSLSDVMIDFEIPLGDPRDQEQYIHRKCYQEFANCYLVKYKEPKPWPKEGLIADQCPLPGYHAGLTYNRQSIWDYYIKVESIRPANWTTKSKYGQARLGSFYIPSSLRQINVSHVLFCSDQLYSKWYNIENTIEQNERFLLNKLNNLTSGTSVLKKRALPKDWSSQGKNALFREINVLDICSKPESVILLNTSYYSFSLWEGDCNFTKDMISQLVPECDGFYNNSKWMHMHPYACRFWRSKNEKEETKCRDGETKRCLYYPLWDSPESTYDFGYLAYQKNFPSPICIEQQKIRDQDYEVYSLYQERKIASKAYGIDTVLFSLKNFLNYTGTPVNEMPNARAFVGLIDPKFPPSYPNVTREHYTSCNNRKRRSVDNNYAKLRSMGYALTGAVQTLSQISDINDENLQQGIYLLRDHVITLMEATLHDISVMEGMFAVQHLHTHLNHLKTMLLERRIDWTYMSSTWLQQQLQKSDDEMKVIKRIARSLVYYVKQTHSSPTATAWEIGLYYELVIPKHIYLNNWNVVNIGHLVKSAGQLTHVTIAHPYEIINKECVETIYLHLEDCTRQDYVICDVVKIVQPCGNSSDTSDCPVWAEAVKEPFVQVNPLKNGSYLVLASSTDCQIPPYVPSIVTVNETTSCFGLDFKRPLVAEERLSFEPRLPNLQLRLPHLVGIIAKIKGIKIEVTSSGESIKEQIERAKAELLRLDIHEGDTPAWIQQLAAATKDVWPAAASALQGIGNFLSGTAQGIFGTAFSLLGYLKPILIGVGVILLVILIFKIVSWIPTKKKNQ

SEQ ID NO: 15713 - protein, 536 aa, unidentified
MTRTRLLFLLTCYIPGAVSLDNSILAPAGIISASERQIAIYTQTLQGTIALRFIPVLPQNLSSCAKDTLESYNSTVSNLLLPIAENLNALLKDADKPSQRIIGAIIGSVALGVATTAQVTAALAMTQAQQNARNIWKLKESIKNTNQAVLELKDGLQQSAIALDKVQSFINSEILPQINQLGCEVAANKLGIFLSLYLTEITTVFKNQITNPALSTLSYQALYNLCGGNMAALTKQIGIKDTEINSLYEAELITGQVIGYDSADQILLIQVSYPSVSRVQGVRAVELLTVSVATPKGEGKAIAPSFIAQSNIIAEELDTQPCKFSKTTLYCRQVNTRTLPVRVANCLKGKYNDCQYTTEIGALASRYVTITNGVVANCRSIICRCLDPEGIVAQNSDAAITVIDRSTCKLIQLGDITLRLEGKLSSSYSKNITIDISQVTTSGSLDISSELGSINNTITKVEDLISKSNDWLSKVNPTLISNDTIIALCVIAGIVVIWLVIITILSYYILIKLKNVALLSTMPKKDLNPYVNNTKF

SEQ ID NO: 15714 - protein, 562 aa, unidentified
MGTCLNNRLSTIPSIKTVQCILIILSYIIPYSATDNPIADRSLLRAGIVPIYSKSLSVYTNSISGYLTVRMLPPLPKNLTECSQEVVSNYNKTITRMFQPISDNLMRIQEGTDSGTKRFVGAVIGSVALGVATSAQITAALAMVQAQDNAKAIWKLKEAISSTNQAVLELKEGVNTLGVAVDKIQGYINNEILPSLSELECRVNANKLASQLNLYLIELTTIFGDQITNPALTPLSLQALYTLAGDTMGSFLQYIGAQDNEIESLYDSGLINGQIVSYDASIQTIIIKVSIPSISSLSRFSIMRLATVSSSVGGFEKTPLVPEYLLISDNHIEEFSIVDCKESSDIFYCPQILSMPISTATVECLKGRIDQCIYTSQLTILSHRIVTYNGVVVANCFAELCRCTNPSYIIRQDRDVAVTVIDKDLCKRVQIGDIELIVQASIANEYKVNFTVSEDQLAPSTPIDISNELNSLNQTLDKVGQLINTSNQILASLNPKLVNNTSIIVLIVMGVVLILWLLALTIYSIYAARNLNSIGRLAKSAYASYVADKNVYKNESTSSSSI

SEQ ID NO: 15715 - protein, 541 aa, unidentified
MEKGTVLFLAALTLYNVKALDNTKLLGAGIASGKEHELKIYQSSVNGYIAVKLIPFLPSTKRECYNEQLKNYNATINRLMGPINDNIKLVLSGVKTRTREGKLIGAIIGTAALGLATAAQVTAAIALEQAQDNARAILTLKESIRNTNNAVSELKTGLSEVSIALSKTQDYINTQIMPALSNLSCEIVGLKIGIQLSQYLTEVTAVFGNQITNPALQPLSMQALYQLCGGDFSLLLDKIGADRNELESLYEANLVTGRIVQYDTADQLVIIQVSIPSVSTLSGYRVTELQSISVDMDHGEGKAVIPRYIVTSGRVIEEMDISPCVLTATAVYCNRLLTTSLPESVLKCLDGDHSSCTYTSNSGVLETRYIAFDGMLIANCRSIVCKCLDPPYIIPQNKGKPLTIISKEVCKKVTLDGITLLIDAEFTGEYGLNITIGPDQFAPSGALDISTELGKLNNSINKAEDYIDKSNELLNRVNVDIVNDTAVIVLCVMSALVVVWCIGLTVGLIYVSKNTLRAVAIKGTSIENPYVSSGKHAKNSS

SEQ ID NO: 15716 - protein, 542 aa, unidentified
MYVPGVILALLMINPCLTLDNSKLAPVGIISAAEHELAIYTNTLSGSIAVRFLPNLPANLTHCQKTILDNYNVTVTRILKPIADNLNILKHGLEVPKERLVGAIIGTVALGVATSAQITAAVAVAQAQQNAKDIWKLKNAILSTNEAVLELKTGLQQTAIALDKIQDYINNEIIPTVNNLTCEVMANRLGVYLSLYLTELTTVFGNQITNPALSTISYQGLTNLCGNNIGALTKLIGLKDDNVESIYEAGLITGQVVDYDPASQILIIQVSYPSISRLSDIRATELITVGVTTPFGEGRAIVPKYVAQSTVLIEELDISSCKFSSTTLYCTQINTRPLPPRVSSCLKGDYENCQFTTEVGVLASRYASIGKGVVVNCRSIICKCLEPPRIIPQNSLASITVIDSKICKKLQLPDVILRLDGNLESQYFTNISINGGQVTPSGPLDISSEIGNINQTVNRVEDLIHESESWLSRVNPKLISNTAIIVLCVLSSLCVLWLILITAFMAKLLSNVKKIERKVAVSSLIGNPYVYTNPGYSGSKSA

SEQ ID NO: 15717 - protein, 537 aa, unidentified
MMDSLRLTILLVAWFSLGECLDNANTGPIGVLKSKEWQLAAYTQSLYGTIAVRFIPILPSNLTSCMLSVIQDYNQTVSSLLGPIGNNLDSIISSSGEQQARLIGAIVGTVALGVATSAQITAALAVNQAQDNARQIWKLKEAILKTNDAVLELKEGLSQTAVALDKVQSFINNEILPQISSISCEVAANKLGVFLSLYLTELTTVFGNQITNPALTPLSYQALYNLCGGNLAALTRQMGIKDDTLTSLYEAGLIVGQIIGYDASSQILLIQVSYPSVSEITGVRATELVTVSVATIKGEGRAIVPQFVAEGHVTIEELDTSPCRFSKSTLFCRSILTRPLPIRVANCLSGKYDDCQYTTEIGLLSSRYVTVDGGVMANCKSTVCKCLNPEKIILQKTASAITAIDKNTCKLLQINDVKLRLEGTLHSQYFRNISIASNQITSSGSLDISSEIGAINNTVNKVEDLINQSNGWLDSVNPKLMSNTTIIILCVLSGLAIVWLLILTIIMCYSAYKLKSLSIIAAMNSATKNPYVSNTKF

SEQ ID NO: 15718 - protein, 544 aa, unidentified
MLQLPLTILLSILSAHQSLCLDNSKLIHAGIMSTTEREVNVYAQSITGSIVVRLIPNIPSNHKSCATSQIKLYNDTLTRLLTPIKANLEGLISAVSQDQSQNSGKRKKRFVGAVIGAAALGLATAAQVTATVALNQAQENARNILRLKNSIQKTNEAVMELKDAVGQTAVAIDKTQAFINNQILPAISNLSCEVLGNKIGVQLSLYLTELTTVFGNQLTNPALTTLSLQALYNLCGDDFNYLINLLNAKNRNLASLYEANLIQGRITQYDSMNQLLIIQVQIPSISTVSGMRVTELFTLSVDTPIGEGKALVPKYVLSSGRIMEEVDLSSCAITSTSVFCSSIISRPLPLETINCLNGNVTQCQFTANTGTLESRYAVIGGLVIANCKAIVCRCLNPPGVIAQNLGLPITIISSNTCQRINLEQITLSLGNSILSTYSANLSQVEMNLAPSNPLDISVELNRVNTSLSKVESLIKESNSILDSVNPQILNVKTVIILAVIIGLIVVWCFILTCLIVRGFMLLVKQQKFKGLSVQNNPYVSNNSH

SEQ ID NO: 15719 - protein, 555 aa, unidentified
MGARLGPLTMAPGRYVIIFNLILLHRAVSLDNSRLLQQGIMSATEREIKVYTNSITGSIAVRLIPNLPQEVLKCSAGQIKSYNDTLNRIFTPIKANLERLLATPSMLEDNQNPAPEPRLIGAIIGTAALGLATAAQVTAALALNQAQDNAKAILNLKESITKTNEAVLELKDATGQIAIALDKTQRFINDNILPAINNLTCEVAGAKVGVELSLYLTELSTVFGSQITNPALSTLSIQALMSLCGNDFNYLLNLMGAKHSDLGALYEANLINGRIIQYDQASQIMVIQVSVPSISSISGLRLTELFTLSIETPVGEGKAVVPQFVVESGQLLEEIDTQACTLTDTTAYCTIVRTKPLPELVAQCLRGDESRCQYTTGIGMLESRFGVFDGLVIANCKATICRCLAPEMIITQNKGLPLTVISQETCKRILIDGVTLQIEAQVSGSYSRNITVGNSQIAPSGPLDISSELGKVNQSLSNVEDLIDQSNQLLNRVNPNIVNNTAIIVTIVLLVLLVLWCLALTISILYVSKHAVRMIKTVPNPYVMQAKSPGSATQF

SEQ ID NO: 15720 - protein, 539 aa, unidentified
MRVRPLIIILVLLVLLWLNILPVIGLDNSKIAQAGIISAQEYAVNVYSQSNEAYIALRTVPYIPPHNLSCFQDLINTYNTTIQNIFSPIQDQITSITSASTLPSSRFAGLVVGAIALGVATSAQITAAVALTKAQQNAQEIIRLRDSIQNTINAVNDITVGLSSIGVALSKVQNYLNDVINPALQNLSCQVSALNLGIQLNLYLTEITTIFGPQITNPSLTPLSIQALYTLAGDNLMQFLTRYGYGETSVSSILESGLISAQIVSFDKQTGIAILYVTLPSIATLSGSRVTKLMSVSVQTGVGEGSAIVPSYVIQQGTVIEEFIPDSCIFTRSDVYCTQLYSKLLPDSILQCLQGSMADCQFTRSLGSFANRFMTVAGGVIANCQTVLCRCYNPVMIIPQNNGIAVTLIDGSLCKELELEGIRLTMADPVFASYSRDLIINGNQFAPSDALDISSELGQLNNSISSATDNLQKAQESLNKSIIPAATSSWLIILLFVLVSISLVIGCISIYFIYKHSTTNRSRNLSSDIISNPYIQKAN

SEQ ID NO: 15721 - protein, 543 aa, unidentified
MGQISVYLINSVLLLLVYPVNSIDNTLIAPIGVASANEWQLAAYTTSLSGTIAVRFLPVLPDNMTTCLRETITTYNNTVNNILGPLKSNLDALLSSETYPQTRLIGAVIGSIALGVATSAQITAAVALKQAQDNARNILALKEALSKTNEAVKELSSGLQQTAIALGKIQSFVNEEILPSINQLSCEVTANKLGVYLSLYLTELTTIFGAQLTNPALTSLSYQALYNLCGGNMAMLTQKIGIKQQDVNSLYEAGLITGQVIGYDSQYQLLVIQVNYPSISEVTGVRATELVTVSVTTDKGEGKAIVPQFVAESRVTIEELDVASCKFSSTTLYCRQVNTRALPPLVASCLRGNYDDCQYTTEIGALSSRYITLDGGVLVNCKSIVCRCLNPSKIISQNTNAAVTYVDATICKTIQLDDIQLQLEGSLSSVYARNISIEISQVTTSGSLDISSEIGNINNTVNRVEDLIHQSEEWLAKVNPHIVNNTTLIVLCVLSALAVIWLAVLTAIIIYLRTKLKTISALAVTNTIQSNPYVNQTKRESKF

SEQ ID NO: 15722 - protein, 540 aa, unidentified
MTKRINLTLSLYVLVTISACLPTTRCLDNSKLARAGIISSAEYAVSVYAQTNEAYIALRTIPYLPANPNNCFTPTITTYNTTIQSIFSPIVSQINAITSSTSTQQERLFGVIIGTVALGVATAAQVTAAVALTQAQSNAKAILQLKSSIQNTIAAVSEVKDGLSTIGIALGKIQVYVNEVINPQLANLTCQTAAANLGVQLSLYLTELTTVFGPQITNPALSPLTIQALYNLAGSNLDTFFEKYGYKQATATSVLEAGLVTGQIVSFDPATGIGIIRVSLPSIATLSSARVTKLETVSVSTSTGEAVAIVPSFIIQQGTVIEEFIIDGCIRTSADIYCTRLFTKILPDSVLNCLQGLVNECQFTRGLGTYANRFVTINGGIVANCQTLLCRCYSPSYIITQNSNIAVTLIDSSTCRDLDLDGIRLALGNTEFSEYAKNLTIAESQFAPSDALDISSEIGKLNATISRVEDYLNQATKDVTAISINKSAADIILIVTLILTILLIITVIVIVVIIIKQRRVITHKTTNEDMISNPYVTNAK

SEQ ID NO: 15723 - protein, 553 aa, unidentified
MGSRPFTKNPAPMMLTIRVALVLSCICPANSIDGRPFAAAGIVVTGDKAVNIYTSSQTGSIIVKLLPNLPKDKEACAKAPLDAYNRTLTTLLTPLGDSIRRIQESVTTSGGGRQGRLIGAIIGGVALGVATAAQITAAAALIQAKQNAANILRLKESIAATNEAVHEVTDGLSQLAVAVGKMQQFVNDQFNKTAQELDCIKIAQQVGVELNLYLTELTTVFGPQITSPALNKLTIQALYNLAGGNMDYLLTKLGIGNNQLSSLIGSGLITGNPILYDSQTQLLGIQVTLPSVGNLNNMRATYLETLSVSTTRGFASALVPKVVTQVGSVIEELDTSYCIETDLDLYCTRIVTFPMSPGIYSCLSGNTSACMYSKTEGALTTPYMTIKGSVIANCKMTTCRCVNPPGIISQNYGEAVSLIDKQSCNVLSLGGITLRLSGEFDVTYQKNISIQDSQVIITGNLDISTELGNVNNSISNALNKLEESNRKLDKVNVKLTSTSALITYIVLTIISLVFGILSLILACYLMYKQKAQQKTLLWLGNNTLDQMRATTKM

SEQ ID NO: 15724 - protein, 553 aa, unidentified
MDSKPHIRIPASLTLITRITLVLSYICSTSSLDGRPLAAAGIVVTGDKAINIYTSSQTGSIIVKLLPNMPKDKEACAKAPLEAYNRTLTTLLTPLGDSIRRIQGSVSTSGRRRQKRFIGAIIGSVALGVATSAQITAAAALIQANQNAANILRLKESIAATNEAVHEVTDGLSQLAVAIGKMQQFVNNQFNNTARELDCIKISQQVGIELNLYLTELTTVFGPQITSPALTQLTIQALYNLAGGNMDYLLTKLGIGNNHLSSLIGSGLITGNPILYDSQTQLLGIQVNLPSVGNLNNMRATYLETLSVSTTKGFASALVPKVVTQVGSVIEELDTSYCIESDLDLYCTRIVTFPMSPGIYSCLSGNTSACMYSKTEGALNTPYMALKGSVIANCKITTCRCADPPGIISQNYGEAVSLIDRHSCNVLSLDGITLRLSGEFDATYQKNISILDSQVIVTGNLDISTELGNVNNSISNALDRLAESNSKLDKVNVKLTSTSALITYIILTIISLVLGALSLVLACYLMYKQRAQQKTLLWLGNNTLDQMRATTRT

SEQ ID NO: 15725 - protein, 546 aa, unidentified
MAIPVPSSTALMIFNILVSLAPASALDGRLLLGAGIVPTGDRQVNVYTSSQTGIIALKLLPNLPKDKENCAEVSIRSYNETLTRILTPLAQSMAAIRGNSTVSTRGREPRLVGAIIGGVALGVATAAQITAATALIQANQNAENIARLAKGLAATNEAVTDLTKGVGSLAIGVGKLQDYVNEQFNRTGEAIECLTIESRVGVQLSLYLTEVIGVFGDQITSPALSDISIQALYNLAGGNLNVLLQKMGIEGTQLGSLINSGLIKGRPIMYDDGNKILGIQVTLPSVGRINGARATLLEAIAVATPKGNASPLIPRAVISVGSLVEELDMTPCVLTPTDIFCTRILSYPLSDSLTTCLKGNLSSCVFSRTEGALSTPYVSVHGKIVANCKSVVCRCVEPQQIISQNYGEALSLIDESLCRILELNGVILKMDGQFTSEYTKNITIDPVQVIISGPIDISSELSQVNQSLDSALENIKESNSYLSKVNVKLISSSAMITYIVITVICLILTFVALVLGIYSYTKIRSQQKTLIWMGNNIARSKEGNRF

SEQ ID NO: 15726 - protein, 545 aa, unidentified
MARFSQEIFGLSTILLIAQTCQGSIDGRLTLAAGIVPVGDRPISIYTSSQTGIIVVKLIPNLPDNKKDCAKQSLQSYNETLSRILTPLATAMSAIRGNSTTQVRENRLVGAIIGSVALGVATAAQITAATALIQANQNAANIARLANSIAKTNEAVTDLTEGLGTLAIGVGKLQDYVNEQFNNTAVAIDCLTLESRLGIQLSLYLTELMGVFGNQLTSPALTPITIQALYNLAGGNLNALLSRLGASETQLGSLINSGLIKGMPIMYDDANKLLAVQVELPSIGKLNGARSTLLETLAVDTTRGPSSPIIPSAVIEIGGAMEELDLSPCITTDLDMFCTKIISYPLSQSTLSCLNGNLSDCVFSRSEGVLSTPYMTIKGKIVANCKQVICRCMDPPQILSQNYGEALLLIDESTCRSLELSGVILKLAGTYESEYTRNLTVDPSQVIITGPLDISAELSKVNQSIDSAKENIAESNKFLSQVNVKLLSSSAMITYIVATVVCLIIAITGCVIGIYTLTKLKSQQETLLWLGNNAEMHGSRSKTSF

SEQ ID NO: 15727 - protein, 551 aa, unidentified
MIFTMYHVTVLLLLSLLTLPLGIQLARASIDGRQLAAAGIVVTGEKAINLYTSSQTGTIVVKLLPNVPQGREACMRDPLTSYNKTLTSLLSPLGEAIRRIHESTTETAGLVQARLVGAIIGSVALGVATSAQITAAAALIQANKNAENILKLKQSIAATNEAVHEVTDGLSQLAVAVGKMQDFINTQFNNTAQEIDCIRISQQLGVELNLYLTELTTVFGPQITSPALSPLSIQALYNLAGGNLDVLLSKIGVGNNQLSALISSGLISGSPILYDSQTQLLGIQVTLPSVSSLNNMRAIFLETLSVSTDKGFAAALIPKVVTTVGTVTEELDTSYCIETDIDLFCTRIVTFPMSPGIYACLNGNTSECMYSKTQGALTTPYMSVKGSIVANCKMTTCRCADPASIISQNYGEAVSLIDSSVCRVITLDGVTLRLSGSFDSTYQKNITIRDSQVIITGSLDISTELGNVNNSINNALDKIEESNQILESVNVSLTSTNALIVYIICTALALICGITGLILSCYIMYKMRSQQKTLMWLGNNTLDQMRAQTKM

SEQ ID NO: 15728 - protein, 541 aa, unidentified
MQLYSVLALALLAVQAGLGIIPSLSNTNSIDAGFVFQSERAVNIYTNSLTGSVVVKLLPNLPDHLKSCHLDVLSSYNRTLTSIFQPLGESIKHIWGNTTGGSAAGGIQSRIVGAILGGVALGVATSAQITAGVALAQSRQNAENILKLKQSIAATNDAVQEVIAGQRELVIAIGKMQDYINQALNSTIQQIDCVTAANRLGVELSLYLTQLTTAFSNQIQNPALTPLSIQALYNLAGGNLDRFLNRIGATTSNLQSIISSGLIQGQPIGYDSEKQLLILSVSVPSINAVDNLRMAQLTPIVVSTSQGLGAVVIPKYIIAIADLIEEFVADDCIFTTSDAYCTSLTTLPLSNSLQQCIRGNVSACSYSLVRGVLSTKFITLDGSVVANCQAVTCRCIDPPKIISQFAGKPLTIINSKICNVINIEQVTLRLSGHFMSQYGANLSISEGQIVVTGPLDISNELGRVNQSITNAQASINKSNQILEGVNVRLIQVPALATSLALAIAGTVLGALAIIGILVLWVTNKKQSKKIEWLLASKASKM

SEQ ID NO: 15729 - protein, 543 aa, unidentified
MSALQWRCTVAVLTSTLLLAARAVEFSNRRAVDAGFVFQSERAVNLYAKSLTGTIAIKLMPNLPEYMKGCQQDIIKSYNKSLVSIFMPLGDSIKRIWGNTTSSAGDGAAQSRLIGAIIGGVALGVATSAQITAGIAIAQSKQNAENILKLKQAIANTNNAVQELITSQQEVVTALGKIQDYINTALNDTIQQVDCVTSANRLGVELSLYLTQLTTVFSNQIQNPVLTPLSIQALYNIAGGNLDRFLNKIGGSSKNLQSLISSGLIQGQPIAYDAEYQILVIAVSIPSINTVNNLRMAQLVPLSISTPRGQGAVILPRYVVKVADLIEEMSIEDCIVTDTDVYCTRLTTFPLASEMQQCILGNVSACSYSINRGVLTTKFVTVDGIVVANCQAVTCRCVDPSKIISQFSGKPLTVINPEVCKVLNIDQVTLRLSGTFTSEYGGNISIPAGQIVVTGPLDISSELNKVNNSLTNAQAAVDKSNEILKKVNVRLISEAPMVTIIILAVVSLVLSILVMIGLVYTYCTVKKYSKQTEWMMMRSQTKM

SEQ ID NO: 15730 - protein, 574 aa, unidentified
MNATHYKKPTGRSRLHCLPDPPQPPSFIRNSSQGGCGAMRACALFSVWASVGILTWGQLDNTKTIDAGFVVQGEREVSLYSQSLSGTVVVKLVPNLPNDLKDCHKAILQSYNKTLTDILTPLGESIKYIRGNASYTLGRGQARIVGAILGGVALGVATSAQITAAMALVQTEQNAKNILKLKKSIAETNNAVQEIINGQQQLGIAIGKIQDYVNNVLNDTTQKIDCVTSANRLGVELSLYLTQITTAFGNQIRNPALSDLSIQALYNLAGGNLDSFIRKIGGDVSNLQSVLASGLIKGQPIGYDSETQLLLITVRIPSISKIKNMRMASLVPISVTTPKGPGMVIIPRYVVKLASAIEEIFIDDCITTETDLYCSRLVTSPLSSAMQNCIGGVVQDCMYTTANAVLSTPFASIQGSIVANCEQVTCRCRDPPAIISQTYGKPLTIITQHQCSVIEIDGIAVKLKGDFQSQYGGNLSIVRDQVAITGPLDVNAELSKVNASISNAQTALDRSNAILNGVNVSLIRKDSMVGIIVGLVIAIILALLSCGLAVYSCLRGVKQEKYIKYLLSKPNTKM

SEQ ID NO: 15731 - protein, 551 aa, unidentified
MASAATLTYLFVAIGFLVIGHTLSSVLDGRKLVGAGIVIREQKQVRVYSTSQTGTIVLRLLPYISSDHESCIRSTIEAYNATVTNILSPLGEAIQRIQGSYQGSALDREGRLVGAIVGGVALGVATAAQITAASALIQANENAKNILRLKDSIAKTNEAVRDVAEGVGHLAIAVGKLQDFVNEEFNKTTTAINCVQAAQRLGVELSLYLTEITTAFGPQITSPALTRLTIQAIYNLAGGNLDILLNRLGADNSQLSSLVGSGLISGQPILYDAETQILGIQITLPSIGNLKGVLATYLDSVAVDTPAGLASPLIPRTVIQSNGVVEELDTSSCVEAPADIYCTKVTTFPIAQGTTDCLLGNVSQCLYSKTNGVLTTPYMALNGKIVANCRHVTCRCHEPSRILSQDYGEAVLLIDSTVCQILNLDGVSIRLDGRFDSEYSKNISIGANKVIVSSTIDITTELGSVNQTLQDALDKLDQSDAQLSRVNVRLTSTEAMITYIVLTALAIALGLIGLGLGCYSMMKVRAQAKTILWLGAHADRAYGVGQSQSRL

SEQ ID NO: 15732 - protein, 551 aa, unidentified
MGYFHLLLILTAIAISAHLCYTTTLDGRKLLGAGIVITEEKQVRVYTAAQSGTIVLRSFRVVSLDRYSCMESTIESYNKTVYNILAPLGDAIRRIQASGVSVERIREGRIFGAILGGVALGVATAAQITAAIALIQANENAKNILRIKDSITKTNEAVRDVTNGVSQLTIAVGKLQDFVNKEFNKTTEAINCVQAAQQLGVELSLYLTEITTVFGPQITSPALSKLTIQALYNLAGVSLDVLLGRLGADNSQLSSLVSSGLITGQPILYDSESQILALQVSLPSISDLRGVRATYLDTLAVNTAAGLASAMIPKVVIQSNNIVEELDTTACIAAEADLYCTRITTFPIASAVSACILGDVSQCLYSKTNGVLTTPYVAVKGKIVANCKHVTCRCVDPTSIISQNYGEAATLIDDQLCKVINLDGVSIQLSGTFESTYVRNVSISANKVIVSSSIDISNELENVNSSLSSALEKLDESDAALSKVNVHLTSTSAMATYIVLTVIALILGFVGLGLGCFAMIKVKSQAKTLLWLGAHADRSYILQSKPAQSST

SEQ ID NO: 15733 - protein, 545 aa, unidentified
MDRKLLNLALILLICMPGHAASSLDGRKLAAAGILITEEKSISVYTSSLTGTIVVKLLPNLPTDKRDCMKDAIASYNKTLTSILTPLGDSIRRIQDSTQESEGSGEERIIGAILGGAALGVATAAQITAASALIQANQNAANILRLKESISATNEAVHEVTKGVSQLTVAMGKMQAYVNEQFNKTGEALDCLKVSQQIGVELSLYLTELTTVFGPQITSPALSPITIQALYNLAGGSLDYILNKMGVGNSQLNSLISSGLITGSPILYDSATQLLGIQITLPSVSGVRNLRAVFLETLAVHTPKGYASALVPRVVTTVGSVIEELEMSYCITAGLDLYCTRVLTYPLSQGITRCLTGNVSSCSYSKTEGALTTPYMTLKGSVVANCKLITCRCEDPKRILTQNYGEAVTLIDSSLCRTISLEGVTLRLTGTFDSSYERNITVSDDQVLITGNLDISTELGNVNNSINNALDKLEESNEKLSRVNVKLMSTNAMITYIVLTVIALVLGIIGLGMGCYVLYKQKAQQKTLLWLGNNTLQQMKASTKM

SEQ ID NO: 15734 - protein, 538 aa, unidentified
  VARIANT 287: note = Any amino acid
MASPMVPLLIITVVPALISSQSANIDKLIQAGIIMGSGKELHIYQESGSLDLYLRLLPVIPSNLSHCQSEVITQYNSTVTRLLSPIAKNLNHLLQPRPSGRLFGAVIGSIALGVATSAQISAAIALVRAQQNANDILALKAAIQSSNEAIKQLTYGQEKQLLAISKIQKAVNEQVIPALTALDCAVLGNKLAAQLNLYLIEMTTIFGDQINNPVLTPIPLSYLLRLTGSELNDVLLQQTRSSLSLIHLVSKGLLSGQIIGYDPSVQGIIIRIGLIRTQRIDRSLVFXPYVLPITISSNIATPIIPDCVVKKGVIIEGMLKSNCIELERDIICKTINTYQITKETRACLQGNITMCKYQQSRTQLSTPFITYNGVVIANCDLVSCRCIRPPMIITQVKGYPLTIINRNLCTELSVDNLILNIETNHNFSLNPTIIDSQSRLIATSPLEIDALIQDAQHHAAAALLKVEESNAHLLRVTGLGSSSWHIILILTLLVCTIAWLIGLSIYVCRIKNDDSTDKEPTTQSSNRGIGVGSIQYMT

SEQ ID NO: 15735 - protein, 566 aa, unidentified
MRPLNTLLTVILIILISYLVIVHSSDAVERPRTEGIRGDLIPGAGIFVTQVRQLQIYQQSGYHDLVIRLLPLLPTELNDCQKEVVTEYNNTVSQLLQPIKTNLDTLLADGNTREADIQPRFIGAIIATGALAVATVAEVTAAQALSQSKTNAQNILKLRDSIQATNQAVFEISQGLEATATVLSKLQTELNENIIPSLNNLSCAAMGNRLGVSLSLYLTLMTTLFGDQITNPVLTPISYSTLSAMAGGHIGPVMSKILAGSVTSQLGAEQLIASGLIQSQVVGYDSQYQLLVIRVNLVRIQEVQNTRVVSLRTLAVNRDGGLYRAQVPPEVVERSGIAERFYADDCVLTTTDYICSSIRSSRLNPELVKCLSGALDSCTFERESALLSTPFFVYNKAVVANCKAATCRCNKPPSIIAQYSASALVTITTDTCADLEIEGYRFNIQTESNSWVAPNFTVSTSQIVSVDPIDISSDIAKINNSIEAAREQLELSNQILSRINPRIVNDESLIAIIVTIVVLSLLVVGLIIVLGVMYKNLKKVQRAQAAMMMQQMSSSQPVTTKLGTPF

SEQ ID NO: 15736 - protein, 551 aa, unidentified
MASTITLAYLSAAVAVLTIDPTWSSVLDGRKLVGAGIVIREQKQVRVYSTSQTGTIVLRLLPYISSDHESCIRSTIEAYNTTVTNILSPLGEAIQRIQGSYQESALDREGRLVGAIVGGVALGVATAAQITAASALIQANENAKNILRLKDSIAKTNEAVRDVAEGVGHLAIAVGKLQDFVNEEFNKTTTAINCVQAAQRLGVELSLYLTEITTVFGPQITSPALTQLTIQAVYNLAGGNLDVLLNRLGADNSQLSSLVGSGLISGQPILYDAETQILGIQITLPSIGNLKGVLATYLDSVAVDTPAGLASPLIPRTVIQSNGVVEELDTSPCVEASADIYCTKITTLPIAQGTTNCLLGNVSQCLYSKTNGVLTTPYMTLNGKIVANCRHVTCRCHEPSRILSQDYGEAVLLIDSTMCQVLNLDGVSIKLDGRFDSEYSKNISIGANRVIVSSTIDITTELGSVNQTLQDALDKLDQSDAQLNKVNVRLASTEAMVTYIVLTVLAIVLGLVGLGLGCYSMMKVRAQAKTILWLGAHADRAYGASLPQSRL

SEQ ID NO: 15737 - protein, 553 aa, unidentified
MGSKPSTRIPAPLMLITRIMLILGCIRPTSSLDGRPLAAAGIVVTGDKAVNVYTSSQTGSIIVKLLPNMPRDKEACAKAPLEAYNRTLTTLLTPLGDSIRKIQGSVSTSGGRRQKRFIGAVIGSVALGVATAAQITAAAALIQANQNAANILRLKESIAATNEAVHEVTDGLSQLSVAVGKMQQFVNDQFNNTARELDCIKITQQVGVELNLYLTELTTVFGPQITSPALTQLTIQALYNLAGGNMDYLLTKLGIGNNQLSSLIGSGLITGYPILYDSQTQLLGIQVNLPSVGNLNNMRATYLETLSVSTTKGYASALVPKVVTQIGSVIEELDTSYCIESDLDLYCTRIVTFPMSPGIYSCLSGNTSACMYSKTEGALTTPYMALKGSVIANCKITTCRCTDPPGIISQNYGEAVSLIDRHSCNVLSLDGITLRLSGEFDATYQKNISILESQVIVTGNLDISTELGNVNNSISNALDRLAESNSKLEKVNVRLTSTSALITYIVLTVISLVFGALSLGLACYLMYKQKAQQKTLLWLGNNTLDQMRATTRA

SEQ ID NO: 15738 - protein, 594 aa, unidentified; identical to SEQ ID NO: 8963

SEQ ID NO: 15739 - protein, 546 aa, unidentified
MWPILFLCVGLMSCVAQSALLDQSKVAPVGVFFTDPYKLKITGPETTKLMVIRLIPSLGAAQTCTQPSIDEYKLLMTSVITPIQAVLARTMAAVDVTEQNTTSRIAGVIVGSVALGVATSAQITAGIALHNSQENAKAIAAMGNAITATNTAVQNLITAQGQTVTVINTMQDQVNNDIIPAINTLACSISQNRMSIILGQFFSFVQVAFGPVIQSPINSPITVQALNTLFGGDLSRFMEALGYSPGDLSDVLATGSATVRVIAVDPVLFTLTLEASFPTIIDYPGSSIIPIQAITFSTNGSEWLTQTPPWIHTKETQVSGFDPSMCKLTDTSMVCPRDTTYSLSDSVLTCLSGVTSTCPKIRVLNGLSPRYVVYKGVVIANCRATSCVCTDTGRPIAPLSGTLLTEINQEMCSVIGVDGVLIRAEQKLEGVSWGVSIAALGPTIQLDPVDISSEMGAINHSINAAQKALDESKRILQHINPDIVNTESAIATIVLAVLSLVMIFFGAVALIYLHKKINNLAQAQRIASFQMSPTLAHRNYAPRHRG

SEQ ID NO: 15740 - protein, 553 aa, unidentified
MAIKLIVRVAIILVSLSITFGQVDYGRLRKIGVFEKQTMNLKLSISASQRYMVIKTVPNLGTVSSCGDKEMAAYKESIRKLISPMHDMIEYIKGEVVVEAATSVALNGTQVRFFGLVVAIGALGLATSAQITAGIALHNSLENAKAIKGLSDAMKESNQAIQKLQDATAGTVIALNALQDQINTQIVPALNTLGCSVVSNTLGVALTRYYSELVQLFGPSLANPVEAPLSIQAISGAFNGDLKGMIRDYGYSPSDLEDIIRTGAITGRVIDVDMEDLTIILEISLPTLLVMRDTKVVNFGRITYNLNGSEWQTLSPDWIAIRNTLMSGVDLSTCVMSRQNLICKQDPTFAIDHTVSQCLRGEITSCPRGRVVNSIAPRFAIVNGNVLGNCVATTCLCGDPGTPVIQDASSSLTIMSIDKCELVSIDGYNFRPGPPVVNTTFHLSIDDIGPEVSVNPIDISGALGKIEQDLQSSKEHLANSDTILASINPKIINTNAAIGLIVVSSLGLIAAVLALCWLCCLTKSMVGRDSTAFIGGKGPDMGPIMSSLEGMSF

SEQ ID NO: 15741 - protein, 545 aa, unidentified
MTRITILQIILTLTLPVMCQVSFDNLEQVGVMFDKPKFLKITGPASTATMIIKLIPTLGTMESCGTSAVNEYKKTLDTILVPLRDTINKLSTDITVVEGTSNISNKREKRFVGIAIAVGAVALATSAQITAGIALSNTIKNAEAIESIKSSIQASNQAIQKVIDAQGRTVTVINGIQDHINSVINPALNQLGCDVAKNTLAISLTQYFSKLSLLFGPNLRNPVEQPLSVQAIAGLMDGDINAVVSQLGYTQSDLLDLLSTESIVGTVTAIDMVNYMIQIEMSFPQYITIPDTKVLEGHKITFNDKGSEWQTQVPSTIAVRDILIAGVDPDGCSITSTSYICKNDPTYAMSEVLTNCFRGNTQECPRARITSTFATRFAIARSTVIANCVAAVCLCGDPGIPVVQKAEVTLTAMTLDQCSLITVDGLQIKPSKSIANVTANFGNITLGPVVSVGDLDLSAELTKVQSDLKEAQDKLDESNAILQGINNKILTAPTSIALIVVSVVVILLIIGMISWLVWLTKAVRRSNTRSERVTPSAYNNLGFIK

SEQ ID NO: 15742 - protein, 544 aa, unidentified
MRVTIFHTILILTIPVMCQISFDNLEQIGVMFDKPKFLKITGPASTATMIIKLIPTLGTMESCGTSAVNEYKKTLDTILIPLKDTIDKLSTDITVVEGTSKASARREKRFVGIAIAVGAVALATSAQITAGIALSNTIKNAAAIESIKSSIQASNQAIQKVIDAQGRTVTVINGIQDHINSVINPALNQLGCDVAKNTLAISLTQYFSKLSLLFGPNLRNPVEQPLSVQAIAGLMDGDINAVVSQLGYTQSDLLDLLSTESIVGTVTAIDMVNYMIQIEMSFPQYITIPDTKILEGHKITFNDKGSEWQTQIPSTIAVRDILIAGVDPEGCSITSTSYICKNDPTYAMSEVLTNCFRGKTQECPRARITSTFATRFAIARSTVIANCVAAVCLCGDPGTPVVQKAEVTLTAMTLDQCSLVTVDGLQIKPSRSIANVTANFGNITLGPVVSVGDLDLSAELTKVQSDLKEAQDKLDESNAILQGINNKILTAPVSIALIVVSIVIVLLIIGIISWLVWLTRAVKRSDTRSERVTPSSYNNLGFIK

SEQ ID NO: 15743 - protein, 557 aa, unidentified
MSNKRTTVLIIISYTLFYLNNAAIVGFDFDKLNKIGVVQGRVLNYKIKGDPMTKDLVLKFIPNIVNITECVREPLSRYNETVRRLLLPIHNMLGLYLNNTNAKMTGLMIAGVIMGGIAIGIATAAQITAGFALYEAKKNTENIQKLTDSIMKTQDSIDKLTDSVGTSILILNKLQTYINNQLVPNLELLSCRQNKIEFDLMLTKYLVDLMTVIGPNINNPVNKDMTIQSLSLLFDGNYDIMMSELGYTPQDFLDLIESKSITGQIIYVDMENLYVVIRTYLPTLIEVPDAQIYEFNKITMSSNGGEYLSTIPNFILIRGNYMSNIDVATCYMTKASVICNQDYSLPMSQNLRSCYQGETEYCPVEAVIASHSPRFALTNGVIFANCINTICRCQDNGKTITQNINQFVSMIDNSTCNDVMVDKFTIKVGKYMGRKDINNINIQIGPQIIIDKVDLSNEINKMNQSLKDSIFYLREAKRILDSVNISLISPSVQLFLIIISVLSFIILLIIIVYLYCKSKHSYKYNKFIDDPDYYNDYKRERINGKASKSNNIYYVGD

SEQ ID NO: 15744 - protein, 662 aa, unidentified
MKKKTDNPTISKRGHNHSRGIKSRALLRETDNYSNGLIVENLVRNCHHPSKNNLNYTKTQKRDSTIPYRVEERKGHYPKIKHLIDKSYKHIKRGKRRNGHNGNIITIILLLILILKTQMSEGAIHYETLSKIGLIKGITREYKVKGTPSSKDIVIKLIPNVTGLNKCTNISMENYKEQLDKILIPINNIIELYANSTKSAPGNARFAGVIIAGVALGVAAAAQITAGIALHEARQNAERINLLKDSISATNNAVAELQEATGGIVNVITGMQDYINTNLVPQIDKLQCSQIKTALDISLSQYYSEILTVFGPNLQNPVTTSMSIQAISQSFGGNIDLLLNLLGYTANDLLDLLESKSITGQITYINLEHYFMVIRVYYPIMTTISNAYVQELIKISFNVDGSEWVSLVPSYILIRNSYLSNIDISECLITKNSVICRHDFAMPMSYTLKECLTGDTEKCPREAVVTSYVPRFAISGGVIYANCLSTTCQCYQTGKVIAQDGSQTLMMIDNQTCSIVRIEEILISTGKYLGSQEYNTMHVSVGNPVFTDKLDITSQISNINQSIEQSKFYLDKSKAILDKINLNLIGSVPISILFIIAILSLILSIITFVIVMIIVRRYNKYTPLINSDPSSRRSTIQDVYIIPNPGEHSIRSAARSIDRDRD

SEQ ID NO: 15745 - protein, 546 aa, unidentified
MATQEVRLKCLLCGIIVLVLSLEGLGILHYEKLSKIGLVKGITRKYKIKSNPLTKDIVIKMIPNVSNVSKCTGTVMENYKSRLTGILSPIKGAIELYNNNTHDLVGDVKLAGVVMAGIAIGIATAAQITAGVALYEAMKNADNINKLKSSIESTNEAVVKLQETAEKTVYVLTALQDYINTNLVPTIDQISCKQTELALDLALSKYLSDLLFVFGPNLQDPVSNSMTIQAISQAFGGNYETLLRTLGYATEDFDDLLESDSIAGQIVYVDLSSYYIIVRVYFPILTEIQQAYVQELLPVSFNNDNSEWISIVPNFVLIRNTLISNIEVKYCLITKKSVICNQDYATPMTASVRECLTGSTDKCPRELVVSSHVPRFALSGGVLFANCISVTCQCQTTGRAISQSGEQTLLMIDNTTCTTVVLGNIIISLGKYLGSINYNSESIAVGPPVYTDKVDISSQISSMNQSLQQSKDYIKEAQKILDTVNPSLISMLSMIILYVLSIAALCIGLITFISFVIVEKKRGNYSRLDDRQVRPVSNGDLYYIGT

SEQ ID NO: 15746 - protein, 545 aa, unidentified
MALNKNMFSSLFLGYLLVYATTVQSSIHYDSLSKVGVIKGLTYNYKIKGSPSTKLMVVKLIPNIDSVKNCTQKQYDEYKNLVRKALEPVKMAIDTMLNNVKSGNNKYRFAGAIMAGVALGVATAATVTAGIALHRSNENAQAIANMKSAIQNTNEAVKQLQLANKQTLAVIDTIRGEINNNIIPVINQLSCDTIGLSVGIRLTQYYSEIITAFGPALQNPVNTRITIQAISSVFNGNFDELLKIMGYTSGDLYEILHSELIRGNIIDVDVDAGYIALEIEFPNLTLVPNAVVQELMPISYNIDGDEWVTLVPRFVLTRTTLLSNIDTSRCTITDSSVICDNDYALPMSHELIGCLQGDTSKCAREKVVSSYVPKFALSDGLVYANCLNTICRCMDTDTPISQSLGATVSLLDNKRCSVYQVGDVLISVGSYLGDGEYNADNVELGPPIVIDKIDIGNQLAGINQTLQEAEDYIEKSEEFLKGVNPSIITLGSMVVLYIFMILIAIVSVIALVLSIKLTVKGNVVRQQFTYTQHVPSMENINYVSH

SEQ ID NO: 15747 - protein, 546 aa, unidentified
MVVILDKRCYCNLLILILMISECSVGILHYEKLSKIGLVKGVTRKYKIKSNPLTKDIVIKMIPNVSNMSQCTGSVMENYKTRLNGILTPIKGALEIYKNNTHDLVGDVRLAGVIMAGVAIGIATAAQITAGVALYEAMKNADNINKLKSSIESTNEAVVKLQETAEKTVYVLTALQDYINTNLVPTIDKISCKQTELSLDLALSKYLSDLLFVFGPNLQDPVSNSMTIQAISQAFGGNYETLLRTLGYATEDFDDLLESDSITGQIIYVDLSSYYIIVRVYFPILTEIQQAYIQELLPVSFNNDNSEWISIVPNFILVRNTLISNIEIGFCLITKRSVICNQDYATPMTNNMRECLTGSTEKCPRELVVSSHVPRFALSNGVLFANCISVTCQCQTTGRAISQSGEQTLLMIDNTTCPTAVLGNVIISLGKYLGSVNYNSEGIAIGPPVFTDKVDISSQISSMNQSLQQSKDYIKEAQRLLDTVNPSLISMLSMIILYVLSIASLCIGLITFISFIIVEKKRNTYSRLEDRRVRPTSSGDLYYIGT

SEQ ID NO: 15748 - protein, 539 aa, unidentified
MGFRKNLRLLGIFWLIILSDTVDFERLASIGGIKGHSKLYKIKGHPTTKDIVIKLVPNLNNLTVCSEMSIDGYLNLINAVIIPISQSLELMRNNVKDGTPNENIFGAIVAGAALGIATAAQVTSVVALHKSNQNAAKINSLRDSITKTNQAVEQLSLGVQETVSVLMGLQDQINTNLVPKINILSCKQLSNTLNIMLLQYYSQILTVFGPNLRDPATVPVSIQALSQLFEGNLELLTSSLGISSTDFNDLLTGKLITGSIIWADTQGHYLILRVNIPDLIEVPGAVIQEFIKIGYNFGGSLWMPTIPNKIIIRGYHLSLIDSTNCIITDNSYVCDRDYSLPMNPILRECFEGNTSSCGREMVLNSYIPLYALSEGVIYANCLATSCKCATTNKPIVQSTSTVITMIDNSKCPVVEVGKQMISVGSYLGQVSPNNLTIEIGPPVYTEPVDITNQLGNINETLSKTLDLIKQSNSILDMITGGLNPQIGSMISLILAAIAILLSGITCLFSTKSYVKCNKLQMNCFKSYERMDPIYHSQQN

SEQ ID NO: 15749 - protein, 565 aa, unidentified
MGLTKSTILVYLLVYYHAHIIAINAGLDYEGLASIGVVKGPSYNYKIRGTPTTKLLVIKLIPNVGSLDNCTQKQMADYKSLVKNVLTPVSDALSTMLNYIEQQSNGVRLIGAVLAGAALGVATGAAITAGIALHKSNQNAQAIAQLKDAIKNTNQAVQTLKLANQEILGVVDSLRGQINTQIIPVINQLSCDTIGLTLGIKLTQYYSEILTAFGPAIQDPVNSKLTIQAISGAFSGNFDEMMKVMGYTGSDLHDILQGDLITGNIIGVDPDIGYIALEIHFPTLTEIPNAVIQELMPISFNDKGDEWMTLVPRYVLLRTTYVSNIDISKCLITERSVICYNDYATPMSFDVIRCLTGNLTYCPREQIIASYVPRFALSGGVIYANCLSTVCRCAVDGVPIVQSLKATIMMLDNKNCRVYQIGELLISTGAYLGSVEFKNENIDLGPPIVIDKVDLGGQIAGINQTLQGVEDYIDKSNEILDQVNPSVTSLGAMIIVYIFIALAILIGLIALMIDVKLNSQIKILINQSIVNQMRAGLENPGYSRSLPSFSSIASKGSSQELVNTN

SEQ ID NO: 15750 - protein, 541 aa, unidentified
MAFLKSAIICYLLFYPHIVKSSLHYDSLSKVGIIKGLTYNYKIKGSPSTKLMVVKLIPNIDRVRNCTQKQFDEYKNLVKNVLEPVKLALNAMLDNVKSGNNKYRFAGAIMAGVALGVATAATVTAGIALHRSNENAQAIANMKNAIQNTNEAVKQLQLANKQTLAVIDTIRGEINNNIIPVINQLSCDTIGLSVGIKLTQYYSEILTAFGPALQNPVNTRITIQAISSVFNRNFDELLKIMGYTSGDLYEILHSGLIRGNIIDVDVEAGYIALEIEFPNLTLVPNAVVQELMPISYNVDGDEWVTLVPRFVLTRTTLLSNIDTSRCTVTESSVICDNDYALPMSYELIGCLQGDTSKCAREKVVSSYVPRFALSDGLVYANCLNTICRCMDTDTPISQSLGTTVSLLDNKKCLVYQVGDILISVGSYLGEGEYSADNVELGPPVVIDKIDIGNQLAGINQTLQNAEDYIEKSEEFLKGINPSIITLGSMAVLYIFMIVIAVISIIALVLSIKLTVKGNVVRQQFAYTQHVPSMENVNYVSH

SEQ ID NO: 15751 - protein, 544 aa, unidentified
MKVTILTAYIAASVFTCCHSQLALSELTKIGIIPGRSYDLKTSTQASYQYMVIKLIPNVNGLNNCTNSTVESYKKMLTRLLNPIDVALKKMKNAVSDKAPEKLGNVKFWGAVIGGVALGVATSAQITAGVALHNSIQNANAILTLKDSIRQSNKAIQELQTAMSTTVVVLNALQDQINNQLAPAINSLGCQVVANTLGLKLNQYFSEISLVFGPNLRDPTSETLSIQALSRAFNGDFDSMLSRLKYDDSDFLDLLESDSIRGRIIDVSLEDYLITIQIEYPALLTIKDAIIQTFNLISYNTRGTEWISIFPKQLLVRGTYISNIDISQCVLAATSIICKSDTSTPISSATWACATGNVTSCARTRVVNAHVPRFALSGGVIFANCAPVVCKCQDPLYSINQEPKVTNVMVDVDACKEMYLDGLYITLGKSQLPRAMYAEDVSLGGPISVDLIDLGNEINSINSAINRSEEHLDHANELLDQVNPKIVNVKTFGVMLGLLLLLILWCVVTLVWLICLTKQVSRVSFGGSMGSRASTVNSLSGFVG

SEQ ID NO: 15752 - protein, 547 aa, unidentified
MSTKVILLVCTMFVLMHSCNSQLALSELTKIGIIPGKSYDLKLSTQSSFQFMVIKLIPNVDGLSNCTFNSMTNYKKMLTRVLEPINNALQHIKNAISDKQPAELPGANARFFGAIVAGAALTVATTAQITAGIALHNSIQNANAILGLKDSIKQSNKAIAELQTAAQQTVLVINALQDQINNQLVPAINTLGCQVIGNTLGLRLNQYFSEVSLIFGPNLRDPTSETLSIQALSRAFNGDFDSMLSKLKYDDTDFLDLLESDSIRGRIIDVSLDDYFIVIQIEYPSLISIKDATVQTFNLISYNHRGSEWISIFPSQLLVRGTYISNIDISECVSTTNSLICKSDTSSPISSATWACATGNLTGCARTRVVNTHVPKFALSGGVVFANCAPIVCKCQDPMANINQEPKVTNVMVSSDTCKEVYVDGIYITLGKKTLPRAMYAEDVALGGPISVDPIDLGNDVSAIQDAINKSKEHLDEANHLLDKVNPNIVNAKSFAAIMAIVIVLIIWFVINLVWLIYLTKLSISNSRMSNMGSRASTVNSLAGFVG

SEQ ID NO: 15753 - protein, 551 aa, unidentified
MLFQTAVQSLATWALLILLSPYLDHSTAQVGFSELSKIGIIKARSYLLKTRGAPITQPIVVKLMPNLKNFTGCGQQAVADYKSLLNNILLPINASLVHMQNAISSRVGGVRFWGAVIGGVALGVATAAQVTAGVALHNTKQNAADIWAIKKAMLETNDAIHELQTASAQTVLLVSGIQEQINNQIVPAINTLGCQVAENTLALTLSRYFSELSLVFGPNLRDPATETLSIQAISNAFNGDFESLLKNLGYSSSDFLDVLESQLIRGRIIGVDTEDYLIIIQVEYPSITQIKDAVVQTFNLISFSHEGVEWMPVFPRQILVRMNLVSNIDTEGCVYTSTSVICESDTSTPVSIPLLECIHGNTSHCIITRSVNSHVSRYALSDGVLFANCLPMLCQCQTTGKTIIQEYGVASVMITKEMCPEVYIDGFYIQVGPRVLNRTLYASNYSLGGQVSIDPVDIGSEISQIQTHLNNTQQLLDKSSNILNSIDHYIMSIESIPILIAMCVIIFLWLIGLTCAICCYIRKVGQLNGVPWQLRQSNTVNSLSSLIPQDK

SEQ ID NO: 15754 - protein, 544 aa, unidentified
MSKRQHVLLILLLLADYVETQIAFTELTKIGVIRSRNYNLKIKGSVTTQPMVIKLIPNLSNISACPDQDKVIAEYKLLLNKILSPINESLSFARSVVQTRSSGVRFWGAVIGGIALGVAASAQITAAIALHKANQNAAMIKNMKDAIINTNKAVEKLQTTASNILLTISALQEQINTNIVPAINSLGCAVAMNSIRLQLNRYFSELTFVFGPNLRDPSSQTLSIQAISQAFNGDFESMMSALNYQKSDLLDLVQSDSIRGRIIDVDMNEYFISLQIEYPDLIMIEGATVQEFNLISHNDKGVEWMAAFPRAILKRGSFLSNIDLKDCSKTDLSYICQEDTSTPMSATLYNCVQGQLEDCARSLVVNSHVPRFALLDGVVFANCVPITCVCTQSNQHLIQDVLASNVMISSESCEEVQIDGMYITVGQRRLNRSMYAHNIKHGPPISTNPIDISNQLASAEESIKESKKYLEKSNDILRLINPSLVNTGTVVFLIVLTIIIVVVLGGLVFWVYRLSNKVDNYRYAVKRQDNLSTVSSMSSLIPGI

SEQ ID NO: 15755 - protein, 551 aa, unidentified
MACVIRLVITIIIAWYIPSQVSCQLALSNLTKVGVIPSRSYNLKITGVTSQQYIVVKLMPNLENVSECALTHVANYKAMLTRILLPINDSLSRVKSAVSDKPINTKSGENFWGAVVAGIALGVASMAQITGSIALHNSLENSKAIHQMKDAISKTNQAVEHLQTSTARTIIAINALQDQINNQFVPALKTLNCEVVGNSIGLRLNQYFSELLLVFGPNLRDPALETLSIQAISQAFNRDFDTLIRTLGYTDIDLLDLIESSSIQGRIVDVNLEDYYIVIQVEYPAVTLIPDATIQLFNLISFSFKGQEWISVFPSQLLVRGAYISAIDISKCTFTTHSILCKHDTSYPISETLSSCARGDIGKCARTRVVNSHVSKFALSGGVLYANCFTINCRCVEPEFAINQDPSATNIMISSEYCREVLVDSIYVRVASKVLPRETFSTDIVTGGIINLDPIDISNEVASIHESLLASNKSLSEAKEILAKVNPKIVNVRTATFLIIAFVVIFVWAVISLIWLIYLTRKNNNRDHLSERSRLVNSHIPTISNLHTYGT

SEQ ID NO: 15756 - protein, 546 aa, unidentified
MKHRRDMLMTKALLIIIILIGPLSSQISFTNLSKIGVIKGKNYKLKITSNPTYQFMVLKMIPNVVNMSQCGQDHLDNYKGMLKRILQPISDSINLMRSVIQDKPNNGRFWGALVGGVALGVATSAQVTAGVALHNSLENARAILQLKDAIQATNQAVQEVISAQRKSVLVINALQDQINGNIVPAIKSLGCKVAGNTFGLRLTQYFSEVSLVFGPNLRDPAAETLSIQAISRAFNGDFDSLLKALGYKESDLMDVLESGSIRGRIIDVSLDNYFLIIQIEYPTLVNIPDATVQKFNLISYNYDGSEWLSVFPKALLKRGSYLSNIDLSDCTQTTNTILCPQDTSSPLTQNLYDCATGKISQCARMRVVNSHVSRYALSDGVLFLNCIPINCRCSDPEYAIIQEPTTTTLMMSYDDCREVMVEGIFVTVGKKTLNRTSYTGEVDVGGIVTLDPIDISTDVADIQDTLDKAQEEIDKSNEILSKVNPNIITLGGFVSIISFTTLFGIYCVVSLIWLICLTKRTSRPYAMMTFRNRSPTITTLSSNMTS

SEQ ID NO: 15757 - protein, 549 aa, unidentified
MTKLYYISIIIVVIAINLHYIEAQISLAELSKIGIIQGNNYGLKVSGVSTYQLMVIKLIPNVSQLSNCTTDVMVSYKGMLDRILNPINSSLAKVRAAIKDKVDYTPSRNGERFWGAIVGGVALGVATAAQVTAGVALHNSLENAKAIMQLKDAIRNSNAAIQELTTSQGQVVVAINALQEQINTQLVPSLNQLGCSVIGNTLGLKLNQYFSELSLIFGPNLRDPTSETLSIQAIARAFNGDFDTMLNKLKYDTSDFLDLLESGGIRGRIIDVSLTDYIISLQIEYPTLTAIPDATVQLFNLISYNHRGSEWMSVFPRQMLIRGSYLSNIDLSECVQTSSNYICSTDTSSALSSGTYECATGNITSCARTRVVNSHVSRFALSKGVLFVNCASIVCRCQDPKYTIIQDTQVTNVMISSQDCKEVYIDGYFITLGPKTLERSMYSDNVTLGGTVSVEIIDIGNELNSIQESLNRTQHYIDKSNEILDRVNPNVINLGTIGGIMFLTILATIWFIISLIWLICLTRKIMIPRSNLTTSSRSSTVNSLAGFIN

SEQ ID NO: 15758 - protein, 544 aa, unidentified
MSKLRAAVLLLIMIPSLCRSQLALSELTKIGIIPGKSYDLKLSTQSTYQYMVIKLIPNLNNMTKCTIDTLDNYKNMLSRVLNPIHDSLKKMKDAVQDKEPANMPPVKFWGAVIGGVALGVATSAQITAGVALHNSIQNANAILQLKDSIRQSNKAIAELQTASRTTVTVLNALQEQINTQLVPAINNLGCQVVANTLGLRLNQYFSEISLIFGPNLRDPTSETLSIQALSKAFNGDFDSMISQLKYTDKDFLDVLESDSIRARIIDVSLEDYFITLQIEYPSLVQVSDAVVQTFNKISYNHRGSEWISLFPTQLLIRGMYISNIDISMCTMTSTSLICKSDTSSPISTATWSCANGNLTSCARTRVVNAHIPRFALSRGVLFANCAPIVCKCSDPPMNINQEPKMTNVMVSSDECREVYVDGLYITLGKRTLPRSMYAEDVSLGGPISVDPIDIGNELNSIHDSLNKSQEYLDEANALLDKVNPRIINVQTFGVMLAFIILLIIWVIATIIWLIYLTKSIHYLNRHVSLSSRGSTVTSLSGFVG

SEQ ID NO: 15759 - protein, 662 aa, unidentified; identical to SEQ ID NO: 8758

SEQ ID NO: 15760 - protein, 552 aa, unidentified
MAASNGGVMYQSFLTIIILVIMTEGQIHWGNLSKIGIVGTGSASYKVMTRPNHQYLVIKLMPNVTMIDNCTRTEVTEYRKLLKTVLEPVKNALTVITKNIKPIQSLTTSRRSKRFAGVVLAGVALGVATAAQITAGVALHQSIMNSQSIDNLRTSLEKSNQAIEEIRQASQETVLAVQGVQDFINNELIPSMHQLSCEMLGQKLGLKLLRYYTEILSIFGPSLRDPVSAEISIQALSYALGGDINKILEKLGYSGADLLAILESRGIKAKVTHVDLEGYFIVLSIAYPTLSEVKGVIVHKLEAVSYNLGSQEWYTTLPKYVATNGYLISNFDESSCAFMSEVTICSQNALYPMSPLLQQCLRGSTASCARSLVSGTIGNRFILSKGNLIANCASVLCKCYSTGTIISQDPDKLLTFVAADKCPLVEVDGITIQVGSREYPDSVYVSRIDLGPAISLEKLDVGTNLGSALTKLDNAKDLLDSSNQILENVRRSSFGGAMYIGILVCAGALVILCVLVYCCRRHCRKRVQTPPKATPGLKPDLTGTTKSYVRSL

SEQ ID NO: 15761 - protein, 543 aa, unidentified
MNRIKVMIISSLLLSDITIAQIGWDNLTSIGVISTKQYDYKITTLNTDQLMVIKMVPNISSIINCTKLELTKYRELVSGIIRPINESLELMNSYINMRAGSERFIGAVIAGVALGVATAAQITSGIALHNSIMNKKQIQELRKALSTTNKAIDEIRIAGERTLIAIQGVQDYINNIIIPMQDKLQCDILSSQLSVALLRYYTNILTVFGPSIRDPITSTISVQALSQAFNGNLQALLDGLGYTGRDLRDLLESKSITGQIIHADMTDLFLVLRINYPSITEMQGVTIYGLNSITYHIGPEEWYTIMPDFIAVQGFLISNFDERKCSVTKSSILCQQNSIYPMSTEMQRCIKGEIRFCPRSKAIGTLVNRFILTKGNLMANCLGIICRCYTSGQVITQDPSKLITIISQEECKEVGVDGIRIMVGPRKLPDITFNARLEIGVPISLSKLDVGTDLAIASAKLNNSKALLEQSDKILDSMSKLDSMNSRIIGLILAIMIIFIIIITIIWIIYKKCRNKDNKFSTSIEPLYIPPSYNSPHSVVKSI

SEQ ID NO: 15762 - protein, 550 aa, unidentified
MGLKVNVSAIFMAVLLTLQTPTGQIHWGNLSKIGVVGIGSASYKVMTRSSHQSLVIKLMPNITLLNNCTRVEIAEYRRLLRTVLEPIRDALNAMTQNIRPVQSVASSRRHKRFAGVVLAGAALGVATAAQITAGIALHQSMLNSQAIDNLRASLETTNQAIEAIRQAGQEMILAVQGVQDYINNELIPSMNQLSCDLIGQKLGLKLLRYYTEILSLFGPSLRDPISAEISIQALSYALGGDINKVLEKLGYSGGDLLGILESRGIKARITHVDTESYFIVLSIAYPTLSEIKGVIVHRLEGVSYNIGSQEWYTTVPKYVATQGYLISNFDESSCTFMPEGTVCSQNALYPMSPLLQECLRGSTKSCARTLVSGSFGNRFILSQGNLIANCASILCKCYTTGTIINQDPDKILTYIAADHCPVVEVNGVTIQVGSRRYPDAVYLHRIDLGPPISLERLDVGTNLGNAIAKLEDAKELLESSDQILRSMKGLSSTSIVYILIAVCLGGLIGIPALICCCRGRCNKKGEQVGMSRPGLKPDLTGTSKSYVRSL

SEQ ID NO: 15763 - protein, 546 aa, unidentified
MKILFATLLVVTTPHLVTGQIHWGNLSKIGVVGTGSASYKVMTQSSHQTLVIKLMPNITAIDNCTKTEIEEYKRLLGTVLQPIKVALNAITKNIKPIRSSTTSRRHRRFAGVALAGAALGVATAAQITAGIALHQSMMNTQAIESLKASLETTNQAIEEIRQAGQEMILAVQGVQDYINNELVPAMGQLSCDIVGQKLGLKLLRYYTEILSLFGPSLRDPISAEISIQALSYALGGDINKILEKLGYSGSDLLAILESKGIKAKITYVDIESYFIVLSIAYPSLSEIKGVIIHRLEGVSYNIGSQEWYTTVPRYVATQGYLISNFDDTPCAFSPEGTICSQNALYPMSPLLQECFRGSTRSCARTLVSGSIGNRFILSKGNLIANCASILCKCYTTGSIISQDPDKILTYIAADQCPIVEVDGVTIQVGSREYPDAVYLHKIDLGPPISLEKLDVGTNLGNAVTKLEKAKDLLDSSDLILETIKGASVTNTGHILVGAGLIAVVGILIVTCCCRKRSNDSKVSTVILNPGLKPDLTGTSKSYVRSL

SEQ ID NO: 15764 - protein, 546 aa, unidentified
MTRVAILTFLFLFPNAVACQIHWGNLSKIGIVGTGSASYKVMTRPSHQTLVIKLMPNITAIDNCTKSEIAEYKRLLITVLKPVEDALSVITKNVRPIQTLTPGRRTRRFAGAVLAGVALGVATAAQITAGVALHQSLMNSQAIESLKTSLEKSNQAIEEIRLANKETILAVQGVQDYINNELVPSVHRMSCELVGHKLGLKLLRYYTEILSIFGPSLRDPIAAEISIQALSYALGGDINRILDKLGYSGGDFLAILESKGIKARVTYVDTRDYFIILSIAYPTLSEIKGVIVHKIEAITYNIGAQEWYTTIPKYVATQGYLISNFDETSCVFTPDGTVCSQNALYPMSPLLQECFQGSTKSCARTLVSGTISNRFILSKGNLIANCASVLCKCYTTETVISQDPDKLLTVVASDKCPVVEVDGVTIQVGSREYPDSVYLHKIDLGPAISLEKLDVGTNLGNAVTRLENAKELLDASDQILKTVKGVPFGGNMYIALAACIGVSLGLVTLICCCKGRCKNKEVPISKINPGLKPDLTGTSKSYVRSL

SEQ ID NO: 15765 - protein, 552 aa, unidentified
MSNYFPARVIIIVSLITAVSCQISFQNLSTIGVFKFKEYDYRVSGDYNEQFLAIKMVPNVTGVENCTASLIDEYRHVIYNLLQPINTTLTASTSNVDPYAGNKKFFGAVIAGVALGVATAAQVTAGVALYEARQNAAAIAEIKESLHYTHKAIESLQISQKQTVVAIQGIQDQINTNIIPQINALTCEIANQRLRLMLLQYYTEMLSSFGPIIQDPLSGHITVQALSQAAGGNITGLMRELGYSSKDLRYILSVNGISANIIDADPEIGSIILRIRYPSMIKIPDVAVMELSYLAYHAAGGDWLTVGPRFILKRGYSLSNLDITSCTIGEDFLLCSKDVSSPMSLATQSCLRGDTQMCSRTAVQDREAPRFLLLQGNLIVNCMSVNCKCEDPEETITQDPAYPLMVLGSDTCKIHYIDGIRIKLGKVQLPPITVLNTLSLGPIVVLNPIDVSNQLSLVETTVKESEDHLKNAIGALRSQSRVGGVGIVAIVGLIIATVSLVVLVISGCCLVKYFSRTATLESSLTTIEHGPTLAPKSGPIIPTYINPVYRHD

SEQ ID NO: 15766 - protein, 557 aa, unidentified
MYKVVLLFLLLCNAPVVAQLATSQLGSIGVYSVKELEYRVTGEYVTQYLVVQIIPELPTNDNCTRPVVRDYKDSIYNILAPVNETLDIVSTYVGPYSGTKRFVAEIIAGAALGVATAAQITAGIALYEARQNAAQIEAIKSSLKHTNAAIQSLQTAQKQTVVAIRSIQDQINTKIIPQLNTLSCDLIGQQLRLSLLEYYTEILTVFGPIIQSPLNGEVTIQAIARSAGGNLTGLLNELGYNSQDLKNILEINAIRGSVVDVDPILGTLIFNIRYPTFIKIPDATIIQLAYVSFHSGSYDWMTQGPSHIMVRGYTIADVDTTQCTVGSNYLMCPRDTTKPFSSSMNQCLRGNLTYCPRTIVTDRDAPRFLVVKGNLVANCITINCKCEDPEYTIMQAKDEPLVILDNGTCKAHFVDGIRIALGPRKLPTIYLSKEIKLGPVITVNPVEVSHQLSVIEDNIENSEAHLKIAIEKLNNVPQLNGSYVSPVVAIVISVVSLCVTLVVAFLLYRYINHVQNLRFNLDTIEKGPTLAPKGHHYPGSYLNQGFSSYPSAPSLAM

SEQ ID NO: 15767 - protein, 566 aa, unidentified
MAEQEKTPLRYKILLIIIVINHYNITNVFGQIHLANLSSIGVFVTKTLDYRTTSDPTEQLLVINMLPNISNIQDCAQGVVNEYKHLISSLLTPINDTLDLITSNINPYSGRNKLFGEIIAGAALTVATSAQITAGVALYEARQNAKDIAAIKESLGYAYKAIDKLTTATREITVVINELQDQINNRLIPRINDLACEVWATRLQAMLLQYYAEIFSVIGPNLQDPLSGKISIQALARAAGGNIKLMVDELNYSGQDLSRLVKVGAIKGQIIDADPSLGVVIIKMRYPNIIKIPNVAISELSYVSYSSDGQDWITTGPNYIVTRGYSIANIQTSSCSVGDDFVLCDRDMTYPMSQVTQDCLRGNIALCSRMVVRDREAPRYLILQGNMVANCMSITCRCEEPESEIYQSPDQPLTLLTRDTCDTHVVDGIRIRLGVRKLPTISVINNITLGPIITTDPIDVSNQLNAVVSTIDQSAELLHQAQRVLSERARGARDHILATAAIVICVVLAVLILVLLIGLVYLYRTQNEILVKTTMLEQVPTFAPKSFPMESQIYSGKTNKGYDPAE

SEQ ID NO: 15768 - protein, 553 aa, unidentified
MASLLKTICYIYLITYAKLEPTPKSQLDLDSLASIGVVDAGKYNYKLMTTGSEKLMVIKLVPNITYATNCNLTAHTAYTKMIERLLTPINQSLYEMRSVITERDGGTIFWGAIIAGAALGVATAAAITAGVALHRAEQNARNIAALKDALRNSNEAIQHLKDAQGHTVLAIQGLQEQINNNIIPKLKESHCLGVNNQLGLLLNQYYSEILTVFGPNLQNPVSASLTIQAIAKAFNGDFNSLMTNLNYDPTDLLDILESNSINGRIIDVNLNEKYIALSIEIPNFITLTDAKIQTFNRITYGYGSNEWLTLIPDNILEYGNLISNVDLTSCVKTKSSYICNQDTSYPISSELTRCLRGDTSSCPRTPVVNSRAPTFALSGGHIYANCAKAACRCEKPPMAIVQPATSTLTFLTEKECQEVVIDQINIQLAPNRLNKTIITDGIDLGPEVIINPIDVSAELGNIELEMDKTQKALDRSNKILDSMITEVTPDKLLIAMIVVFGILLLWLFGVSYYAFKIWSKLHFLDSYVYSLRNPSHHRSNGHQNHSFSTDISG

SEQ ID NO: 15769 - protein, 540 aa, unidentified
MTITTTIIAILLIPPSFCQIDITKLQRVGVLVNNPKGMKISQNFETRYLILSLIPKIENSHSCGDQQINQYKKLLDRLIIPLYDGLKLQKDVIVVSHETHNNTNLRTKRFFGEIIGTIAIGIATSAQITAAVALVEAKQAKSDIEKLKEAIRDTNKAVQSIQSSVGNLIVAVKSVQDYVNNEIIPSITRLGCEAAGLQLGIALTQHYSELTNIFGDNIGTLKEKGIKLQGIASLYHTNITEIFTTSTVDQYDIYDLLFTESIKMRVIDVDLSDYSITLQVRLPLLTKLSNTQIYKVDSISYNIQGKEWYIPLPNHIMTKGAFLGGADIKECIEAFSSYICPSDPGYILNHEIENCLSGNITQCPKTVVTSDVVPRYAFVNGGLIANCITTTCTCNGIDNRINQSPDQGIKIITHKECQVIGINGMLFNTNREGTLATYTFDDIILNNSVALNPIDISMELNKAKLELEESKEWIKKSNQKLDSVGSWYQSSATITIIIVMIIILVIINITIIVVIIKFHRIQGKDQNDKNSEPYILTNRQ

SEQ ID NO: 15770 - protein, 541 aa, unidentified
MIKKIICIFSMPILLSFCQVDIIKLQRVGILVSKPKSIKISQNFETRYLVLNLIPNIENAQSCGDQQIKQYKKLLDRLIIPLYDGLRLQQDIIVVDNNLKNNTNHRAKRFFGEIIGTIALGVATSAQITAAVALVEAKQARSDIERVKNAVRDTNKAVQSIQGSVGNLIVAVKSVQDYVNNEIVPSIKRLGCEAAGLQLGIALTQHYSELTNIFGDNIGTLKEKGIKLQGIASLYHTNITEIFTTSTVDQYDIYDLLFTESIKMRVIDVDLNDYSITLQVRLPLLTKISDAQIYNVDSVSYNIGGTEWYIPLPRNIMTKGAFLGGANLQDCIESFSDYICPSDPGFILNRDIENCLSGNITQCPKTLVISDIVPRYAFVDGGVIANCLSTTCTCNGIDNRINQAPDQGIKIITYKDCQTIGINGMLFKTNQEGTLAAYTPVDITLNNSVNLDPIDLSIELNRARSDLAESKEWIKRSEAKLDSVGSWYQSSTTEIIQIVMIIVLFIINIIVLIVLIKYSRSQNQSMNNHMNEPYILTNKVQ

SEQ ID NO: 15771 - protein, 555 aa, unidentified
MQKSEILFLVYSSLLLSSSLCQIPVEKLSNVGVIINEGKLLKIAGSYESRYIVLSLVPSIDLQDGCGTTQIIQYKNLLNRLLIPLKDALDLQESLITITNDTTVTNDNPQTRFFGAVIGTIALGVATAAQITAGIALAEAREARKDIALIKDSIVKTHNSVELIQRGIGEQIIALKTLQDFVNDEIRPAIGELRCETTALKLGIKLTQHYSELATAFSSNLGTIGEKSLTLQALSSLYSANITEILSTTKKDKSDIYDIIYTEQVKGTVIDVDLEKYMVTLLVKIPILSEIPGVLIYRASSISYNIEGEEWHVAIPNYIINKASSLGGADVTNCIESKLAYICPRDPTQLIPDNQQKCILGDVSKCPVTKVINNLVPKFAFINGGVVANCIASTCTCGTNRIPVNQDRSRGVTFLTYTNCGLIGINGIELYANKRGRDTTWGNQIIKVGPAVSIRPVDISLNLASATNFLEESKTELMKARAIISAVGGWHNTESTQIIMIIIVCILIIIICGILYYLYRVRRLLVMINSTHNSPVNAYTLESRMRNPYMGNNSN

SEQ ID NO: 15772 - protein, 539 aa, unidentified
MPISILLIITTMIMASHCQIDITKLQHVGVLVNSPKGMKISQNFETRYLILSLIPKIEDSNSCGDQQIKQYKRLLDRLIIPLYDGLRLQKDVIVANQESNENTDPRTERFFGGVIGTIALGVATSAQITAAVALVEAKQARSDIEKLKEAIRDTNKAVQSVQSSVGNLIVAIKSVQDYVNKEIVPSIARLGCEAAGLQLGIALTQHYSELTNIFGDNIGSLQEKGIKLQGIASLYRTNITEIFTTSTVDKYDIYDLLFTESIKVRVIDVDLNDYSITLQVRLPLLTRLLNTQIYKVDSISYNIQNREWYIPLPSHIMTKGAFLGGADVKECIEAFSSYICPSDPGFVLNHEMESCLSGNISQCPRTTVTSDIVPRYAFVNGGVVANCITTTCTCNGIGNRINQPPDQGVKIITHKECNTIGINGMLFNTNKEGTLAFYTPDDITLNNSVALDPIDISIELNKAKSDLEESKEWIRRSNQKLDSIGSWHQSSTTIIVILIMMIILFIINITIITIAIKYYRIQKRNQVDQNDKPYVLTNK

SEQ ID NO: 15773 - protein, 539 aa, unidentified
MPTSILLIITTMIMASFCQIDITKLQHVGVLVNSPKGMKISQNFETRYLILSLIPKIEDSNSCGDQQIKQYKRLLDRLIIPLYDGLRLQKDVIVTNQESNENTDPRTKRFFGGVIGTIALGVATSAQITAAVALVEAKQARSDIEKLKEAIRDTNKAVQSVQSSIGNLIVAIKSVQDYVNKEIVPSIARLGCEAAGLQLGIALTQHYSELTNIFGDNIGSLQEKGIKLQGIASLYRTNITEIFTTSTVDKYDIYDLLFTESIKVRVIDVDLNDYSITLQVRLPLLTRLLNTQIYKVDSISYNIQNREWYIPLPSHIMTKGAFLGGADVKECIEAFSSYICPSDPGFVLNHEMESCLSGNISQCPITTVTSDIVPRYAFVNGGVVANCITTTCTCNGIGNRINQPPDQGVKIITHKECSTIGINGMLFNTNKEGTLAFYTPNDITLNNSVALDPIDISIELNKAKSDLEESKEWIRRSNQKLDSIGNWHQSSTTIIIILIMIIILFIINVTIITIAIKYYRIQKRNRMDQNDKPYVLTNK

SEQ ID NO: 15774 - protein, 565 aa, unidentified
MTAYIQRSQCISTSLLVVLTTLVSCQIPRDMLSNIGVIVDEGKSLKIAGSHESRYIVLSLVPGVDLENGCGTAQVIQYKSLLNRLLIPLRDALDLQEALITVTNDTTQNAGVPQSRFFGAVIGTIALGVATSAQITAGIALAEAREAKRDIALIKESMTKTHKSIELLQNAVGEQILALKTLQDFVNDEIKPAISELGCETAALRLGIKFTQHYSELLTAFGSNFGTIREKSLTLQALSSLYSANITEIMTTIRTGQSNIYDVIYTEQIKGTVIDVDLERYMVTLSVKIPILSEVPGVLIHKASSISYNIDGEEWYVTVPSHILSRASFLGGADITDCVESRLTYICPRDPAQLISDSQQKCILGDTTKCPVTKVVDSLIPKFAFVNGGVVANCIASTCTCGTGRRPISQDRSKGVVFLTHDNCGLIGVNGVELYANRRGHDATWGVQNLTVGPAIAIRPVDISLNLADATNFLQDSKAELEKARKILSEVGRWYNSRETVITIIVVMVVILVVIIVIVIMLYRLRRSMLMGNPDDRIPRDTYTLEPKIRHMYTNGGFDAMAEKR

SEQ ID NO: 15775 - protein, 557 aa, unidentified
MQVTTLRPAIILSIALLVTGQVPRDKLANLGIIIKDSKALKIAGSYENRYIVLSLVPTIDNVNGCGSIQIAKYKEMLERLLIPIKDALDLQESLIVIDNETVNNNYSPQYRFVGAIIGTIALGVATAAQVTAGVALMEAREAKRDISMLKEAIEKTQNSIEKLQNSAGEQILALKMLQDYVNGEIKPAIEELGCETAALKLGIALTQHYTELTNAFGSNLGSIGEKSLTLQALSSLYKTNITNILTATNLGKTDIYDIIYAEQVKGRVIDVDLKRYMVTISVKIPILSEIPGVLIYEVSSISYNIDGAEWYAAVPDHILSKSAYIGGADISDCIESRLTYICPQDPAQIIADNQQQCFFGHLDKCPITKVIDNLVPKFAFINGGVVANCIASTCTCGEERIQVSQDRNKGVTFLTHNNCGLIGINGIEFHANKKGSDATWNVSPIGVGPAVSLRPVDISLQIVAATNFLNSSRKDLMKAKEILNQVGNLKDLTTITIINIVIIIILLICVIGLGILYHQLRSALGMRDKMSVLNNSSYSLEPRTAQVQVIKPTSFMG

SEQ ID NO: 15776 - protein, 573 aa, unidentified
MAAESPNPVHIITISLIMLTTLSQCQIPRDKLSNIGVIIDEGKALKIAGSHESRYIVLSLVPGVDTSNDCGTTQIVQYKNLLNRLLIPLRDALDLQESLITVTNETSVTPDLGQFRVFGAVIGTIALGVAASAQITAGVALAEVREVKRDIELIKDSISKTHKSIEFLQNSVGEQILALKTLQDFVNDEIKPAIDELGCETAALRLGIKLSQHYSELLTAFGSNLRTIGEKSLTLQALSSLYSTNITEIMTTVDTGQANIYDIIYTEQIKGTVIDVDLERYMVTLSVKIPILSEIPGVLIYRASSISYNIDGEEWYVTVPSHILSRTSFIGGANIAECVESRLAYICPRDPAQLISPEQQRCLLGDTTSCPVTRVIDSLIPKFAFLNGGVVANCIASTCTCGKSRRPVSQDRSRGVIFLTYDNCGLIGVNGIELYANSKGHDATWGDHNLTVGPAVSIKPIDISLNLAAATDFLEDSRAELEKARKILAEVGGWHNSRTVQITIIVLVILILIVMIGVIVVLYKTRRTFVNNNAQKERLENIYTLEPKTKYMYTNGAFEPPIRQGRAPPSLYS

SEQ ID NO: 15777 - protein, 565 aa, unidentified
MAIYPLRVQCISALLTIVLIKLVSCQIPRDKLSNIGVIVDEGKSLKIAGSHESRYIVLSLVPGVDLENGCGTVQVIQYKSLLNRLLIPLRDALDLQEALITVTNDTMTGAGVPQARFFGAVIGTIALGVATSAQITAGIALAEAREAKRDIALIKESMTKTHKSIELLQNAVGEQILALKTLQDFVNDEIKPAISELGCETAALRLGIKLTQHYSELLTAFGSNFGTIGEKSLTLQALSSLYSANITEIMTTVRTGQSNIYDVIYTEQIKGTVIDVDLERYMVTLSVKIPILSEVPGVLIHKASSISYNIDGEEWYVTVPNHILSRASFLGGANIADCVESRLTYICPRDPAQLIPESQQKCILGDTTRCPVTRVVDSLIPKFAFVNGGVVANCIASSCTCGTSRRPVSQDRSKGVMFLTHDNCGLIGVNGIELYANRKGDDATWGIQNLTVGPAIAIRPVDISLNLAAATDFLQDSRAELERARKILSEVGRWYNSGATLITIIIVVIVILAVIVVIVIVLYRLRRSMLTGNLAGQMSRDTYTLEPKVRHMYTNSGFDAMTEKR

SEQ ID NO: 15778 - protein, 565 aa, unidentified
MVTYIQRVQCISALLTVVLITLISCQIPRNRLSNIGVIVDEGKSLKIAGSYESRYIVLSLVPGVDLENGCGTAQVIQYKSLLNRLLIPLRDALDLQEALITVTNDTTTNVGVPQSRFFGAVIGTIALGVATSAQITAGIALVEAREAKRDIALIKESMTKTHKSIELLQNAVGEQILALKTLQDFVNDEIRPAISELGCETAALRLGIKLTQHYSELLTAFGSNLGTIGEKSLTLQALSSLYSANITEIMTTIGTGQSNIYDVIYTEQIKGTVIDVDLERYMVTLSVKIPILSEVPGVLIHKASSISYNIDGEEWYVTVPSHILSRASFLGGANIADCVESRLTYICPRDPAQLIPDSQQKCILGDTTRCPVTKVVDSLIPKFAFMNGGVVANCIASSCTCGTGRKPISQDRSKGVIFLTYENCGLIGVNGIELYANRKGHDTTWGVQNLTVGPAIAIRPVDISLNLAAATDFLQDSRAELEKARKILSEVGRWYNSGATLITIIVVMIIVLVVIIVIVIALYRLKRSMLMNNLAGQIPRDTYTLEPKIRHMYTNGGFDAMAEKR

SEQ ID NO: 15779 - protein, 557 aa, unidentified
MRRTTLRRAIILSIALLHTFQVSRDIFPNLGIIITASKALKIAGQYEDRSVVLSLVKTSDNVKKCDSIRVARHREMLARLLVPINDTPDLQEFWLAIDAVTVNNDYRQAYRFVGAIIGTIAHELARAAAVTAGASLMEALEARTKTSMSREAIGKTQSSIRPLQHAAFEQIRTRKLLQCHVNGEIQPLIEELARKTAALKVGIALKQHYTSLTNAFGLNLGSIGEKGLNLQGISSFYKTNRTDILTNTNLGKTDTEDIIYAEQVKAEVIDVDLRRYMVTLSVKIPIFSERPQVLIYEVSSISYNIDGAEWYAAVPDHILSKYSSTGGADISDCIESGLTYICPRDPAQIPADNQQQRFLGHVDKKVITKVIHNLVPKSAFINGGVVPNCIASTCTCGAKRVQVSQDRDKGVTFLTHNNCGLIGINGIELHANTGQSDATASVSLIGVGPAVSLRPVDISLQLVAATSFLNSSRTDLSKAREILNQVGNLKDLTVLQIINIVIIAVLQICVQGLGVLYHQLRSALGMRDKMSVLNNSSYSLEPRTSQVQTTKPTSFIG

SEQ ID NO: 15780 - protein, 540 aa, unidentified
MITKTVSMFLVLSSLSLCQIDITRLQRVGILISKPKSIKISQNFETRYLILNLIPRIESTQSCGEQQIKQYKKLLDRLIIPLYDGLRLQQDVIVVNNDSHNKTNHRTKRFFGEIIGTIAIGVATSAQITAAVALVEAKQAKSDIEKIKNAVRNTNKAVQSIQSSVGNLIVAVKSVQDYVNNEIVPSIKRLGCEAAGLQLGIALTQHYSELTNIFGDNIGTLKEKGIKLQGIASLYHTNITEIFTTSTVDQYDIYDLLFTESIRMRVIDVDLNDYSITLQVRLPLLTKISNTQIYSVDSVSYNIGGREWYIPLPRNLMTKGAFLGGADLQNCIESFSSYICPSDPGFVLNHEIENCLSGNITQCPKTLVTSDIIPKYAFVDGGVIANCISTTCTCNGIDNRINQEPDQGIKIITYKECQVIGINGMLFKMNQEGTLADYTFDDIILNNSVALNPIDISIELNKAKSDLAESKEWIKKSERILDSVGSWYQSSVVEIIQIVMIIILLVINIIIIIFLIRYSRPKNKSTNNHTEEPYTLTNKI

SEQ ID NO: 15781 - protein, 565 aa, unidentified
MVTYIQKVQCIPALLTVVLITLISCQIPRDKLSNIGVIVDEGKSLKIAGSYESRYIILSLVPGVDLENGCGTAQVIQYKSLLNRLLIPLRDALDLQEALITVTNDTTTNVGVPQSRFFGAVVGTIALGVATSAQITAGIALAEAREAKRDIALIKESMTKTHKSIELLQNAVGEQILALKTLQDFVNDEIRPAISELGCETAALRLGIKLTQHYSELLTAFGSNLGTIGEKSLTLQALSSLYSANITEIMTTIKTGQSNIYDVIYTEQIKGTVIDVDLERYMVTLSVKIPILSEVPGVLIHKASSISYNIDGEEWYVTVPSHILSRASFLGGANIADCVESRLTYICPRDPAQLIPDSQQKCILGDTTRCPVTKVVDSLIPKFAFMNGGIVANCIASSCTCGTGRKPISQDRSTGVVFLTHENCGLIGVNGIELYANRKGHDTTWGVQNLTVGPAIAIRPVDISLNLAAATDFLQDSRAELEKARKILSEVGRWYNSGVTLITIIVVMIIVSIIIIVIVITLCRLKKSMLMNNPTGRISKDTYTLEPKIRHMYANGGFDAMAEKR

SEQ ID NO: 15782 - protein, 540 aa, unidentified
MTITTIIIAILLIPLSFCQIDITKLQRVGVLVNNPKGMKISQNFETRYLILSLIPKIENSHSCGDQQINQYKKLLDRLIIPLYDGLKLQKDVIVVSHETHNNTNLRTKRFFGEIIGTIAIGIATSAQITAAVALVEAKQARSDIEKLKEAIRDTNKAVQSIQSSVGNLIVAVKSVQDYVNNEIVPSITRLGCEAAGLQLGIALTQHYSELTNIFGDNIGTLKEKGIKLQGIASLYHTNITEIFTTSTVDQYDIYDLLFTESIKMRVIDVDLSDYSITLQVRLPLLTKLSNTQIYKVDSISYNIQGKEWYIPLPNHIMTKGAFLGGADIKECIEAFSSYICPSDPGYILNHEIENCLSGNITQCPKTVVTSDVVPRYAFVNGGLIANCITTTCTCNGIDNRINQSPDQGIKIITHKECQVIGINGMLFNTNREGTLATYTFDDIILNNSVALNPIDISMELNKAKLELEESKEWIKKSNQKLDSVGSWYQSSATITIIIVMIIILFIINITIIVVIIKFYRIKGENQNDKNSEPYILTNRQ

SEQ ID NO: 15783 - protein, 552 aa, unidentified
MNPLNQTLIAKVLGFLLLSSSFTVGQIGFENLTRIGVHQVKQYGYKLAHYNSHQLLLIRMIPTVNGTHNCTHQVITRYREMVREIITPIKGALDIMKKAVSPDLVGARIFGAIVAGAALGIATSAQITAGVALHRTKLNGQEISKLKEAVSLTNEAVEQLQYSQGKSILAIQGIQDFINFNVVPLLEEHTCGIAKLHLEMALMEYFQKLILVFGPNLRDPIGSTIGIQALATLFQNNMFEVSLRLGYAGDDLEDVLQSNSIRANIIEAEPDSGFIVLAIRYPTLTLVEDQVITELAHITFNDGPQEWVATIPQFVTYRGLVLANIDVSTCTFTERNVICARDQTYPMIIDLQLCMRGNIAKCGRTRVTGSTASRFLLKDGNMYANCIATMCRCMSSSSIINQEPSHLTTLIVKETCSEVMIDTIRITLGERKHPPIDYQTTITLGQPIALAPLDVGTELANAVSYLNKSKVLLEHSNEVLSSVSTAHTSLTATIVLGIVVGGLAILIVVMFLFLEAQVIKVQRAMMLCPITNHGYLPNEDLLTRGHSIPTIG

SEQ ID NO: 15784 - protein, 551 aa, unidentified
MHHLHPMIVCIFVMYTGIVGSDAIAGDQLLNIGVIQSKIRSLMYYTDGGASFIVVKLLPNLPPSNGTCNITSLDAYNVTLFKLLTPLIENLSKISTVTDTKTRQKRFAGVVVGLAALGVATAAQITAAVAIVKANANAAAINNLASSIQSTNKAVSDVIDASRTIATAVQAIQDRINGAIVNGITSASCRAHDALIGSILNLYLTELTTIFHNQITNPALTPLSIQALRILLGSTLPIVIESKLNTNFNTAELLSSGLLTGQIISISPMYMQMLIQINVPTFIMQPGAKVIDLIAISANHKLQEVVVQVPNRILEYANELQNYPANDCVVTPNSVFCRYNEGSPIPESQYQCLRGNLNSCTFTPIIGNFLKRFAFANGVLYANCKSLLCRCADPPHVVSQDDTQGISIIDIKRCSEMMLDTFSFRITSTFNATYVTDFSMINANIVHLSPLDLSNQINSINKSLKSAEDWIADSNFFANQARTAKTLYSLSAIALILSVITLVVVGLLIAYIIKLVSQIHQFRSLAATTMFHRENPAFFSKNNHGNIYGIS

SEQ ID NO: 15785 - protein, 543 aa, unidentified
MGVKGLSLIMIGLLISPITNLDITHLMNLGTVPTAIRSLVYYTYTKPSYLTVDLIPNLKNLDQNCNYSSLNYYNKTALSLIQPIADNINRLTKPITSSEIQSRFFGAVIGTIALGVATAAQVTAAIGLAKAQENAKLILTLKKAATETNEAVRDLANSNKIVVKMISAIQNQINTIIQPAIDQINCQIKDLQVANILNLYLTEITTVFHNQLTNPALESISIQALKSLLGPTLPEVLSKLDLNNISAASVMASGLIKGQIIAVDIPTMTLVLMVQIPSISPLRQAKIIDLTSITIHTNSQEVQAVVPARFLEIGSEILGFDGSVCQITKDTIFCPYNDAYELPIQQKRCLQGQTRDCVFTPVAGTFPRRFLTTYGTIVANCRDLVCSCLRPPQIIYQPDENPVTIIDKDLCTTLTLDSITIEIQKSINSTFRREVVLESTQVRSLTPLDLSTDLNQYNQLLKSAEDHIQRSTDYLNSINPSIVNNNAIIILIILCILLILTVTICIIWLKYLTKEVKNVARNQRLNRDADLFYKIPSQIPVPR

SEQ ID NO: 15786 - protein, 529 aa, unidentified
MGTIIQFLVVSCLLAGAGSLDPAALMQIGVIPTNVRQLMYYTEASSAFIVVKLMPTIDSPISGCNITSISSYNATVTKLLQPIGENLETIRNQLIPTRRRRRFAGVVIGLAALGVATAAQVTAAVALVKANENAAAILNLKNAIQKTNAAVADVVQATQSLGTAVQAVQDHINSVVSPAITAANCKAQDAIIGSILNLYLTELTTIFHNQITNPALSPITIQALRILLGSTLPTVVEKSFNTQISAAELLSSGLLTGQIVGLDLTYMQMVIKIELPTLTVQPATQIIDLATISAFINNQEVMAQLPTRVMVTGSLIQAYPASQCTITPNTVYCRYNDAQVLSDDTMACLQGNLTRCTFSPVVGSFLTRFVLFDGIVYANCRSMLCKCMQPAAVILQPSSSPVTVIDMYKCVSLQLDNLRFTITQLANVTYNSTIKLESSQILSIDPLDISQNLAAVNKSLSDALQHLAQSDTYLSAITSATTTSVLSIIAICLGSLGLILIILLSVVVWKLLTIVVANRNRMENFVYHK

SEQ ID NO: 15787 - protein, 542 aa, unidentified
MASLLVGLMLLGLTTGSTGLDPTALMQIGVIPTNVRQLMYYTEASSSYIVVKLMPTIDSPISGCNISSIASYNSTITKLLQPIGENLETIKSQLVPTRRRRRFAGVVIGLAALGVATAAQVTAAIALVKANENTAAILNLKASIQKTNAAVADVVQATQSLGTAVQAVQDHLNNVVSPAITAANCKAQDAIIGSILNMYLTELTTIFHNQITNPALTPITIQALRILLGSTLPTVVEKAFNTQISAAELLSSGLLTGQIVGLDLSYMQMVIKVDLPTLTTQPATQIVDLATISAFINNQEVMAQLPTRIMVTGGLIQSYPASQCTITPSTVYCRYNDAQVLSEDTVACLQGNLTRCTFSPVVGSFMTRFVLFDGIVYANCRSMLCTCMQPASVILQPNSSPITVIDMYKCVSLQLDNLRFTITQIANATYNSTIKLSASQILPIDPLDISQNLAAVNKSLNSALQNLAQSENYLSAITSANTTSILAIIALCIGILGLLLVILIAVVIWKLVSIVSTERTRMDNYVYHNQAFQQSQLDLNKP

SEQ ID NO: 15788 - protein, 537 aa, unidentified
MRSSLFLVLTLLVPFAHSIDSITLEQYGTVITSVRSLAYFLETNPTYISVRLMPAIQTDSSHCSYHSIENYNLTLTKLLLPLQENLHQITDSLSSRRRKKRFAGVAVGLAALGVATAAQVTAAIAVVKAKENSAKIAQLTSAISETNRAVQDLIEGSKQLAVAVQAIQDQINNVIQPQLTNLSCQVADAQVGTILNMYLTELTTVFHPQITNSALTPITIQALRSLLGSTLPQVVTSTIKTDVPLQDLLTSGLLKGQIVYLDLQSMIMVVSVSVPTIALHSMAKVYTLKAISAHVNNAEVQMQVPSRVMELGSEIMGYDIDQCEETSRYLFCPYNGGSILSATMKMCLNGNISQCVFTPIYGSFLQRFVLVDGVIVANCRDMTCACKSPSKIITQPDSLPVTIIDSTSCSNLVLDTLELPIISINNATYRPVQYVGPNQIIFSQPLDLLSQLGKINSSLSDAIEHLAKSDEILEQIQWDSPQGYTLIALTSVLAFVVVAIVGLLISTRYLIFEIRRINTTLTQQLSSYVLSNKIIQY

SEQ ID NO: 15789 - protein, 538 aa, unidentified
MKVFLVTCLGFAVFSSSVCVNINILQQIGYIKQQVRQLSYYSQSSSSYIVVKLLPNIQPTDNSCEFKSVTQYNKTLSNLLLPIAENINNIASPSSGSRRHKRFAGIAIGIAALGVATAAQVTAAVSLVQAQTNARAIAAMKNSIQATNRAVFEVKEGTQRLAIAVQAIQDHINTIMNTQLNNMSCQILDNQLATSLGLYLTELTTVFQPQLINPALSPISIQALRSLLGSMTPAVVQATLSTSISAAEILSAGLMEGQIVSVLLDEMQMIVKINIPTIVTQSNALVIDFYSISSFINNQESIIQLPDRILEIGNEQWSYPAKNCKLTRHHIFCQYNEAERLSLESKLCLAGNISACVFSPIAGSYMRRFVALDGTIVANCRSLTCLCKSPSYPIYQPDHHAVTTIDLTACQTLSLDGLDFSIVSLSNITYAENLTISLSQTINTQPIDISTELSKVNASLQNAVKYIKESNHQLQSVNVNSKIGAIIVAALVLSILSIIISLLFCCWAYVATKEIRRINFKTNHINTISSSVDDLIRY

SEQ ID NO: 15790 - protein, 541 aa, unidentified
MPQQQVAHTCVMLWGIISTVSGINTEALSQYGVVVTNVRQLTYYTQAGSTYLAVRLLPSLASPDQSCALHSIINYNATLQAILSPIAENLNLISTALREQHRKKRFAGVAIGLTALGVATAAQATAAVALVRANKNAEKVEQLSQALGETNAAISDLIDATKNLGFAVQAIQNQINTAILPQIHNLSCQVIDAQLGNILSLYLTELTTVFQPQLTNPALSPLTIQALRAVLGTTLPALLSEKLKSNIPLGDLMSSGLLKGQLVGLNLQNMLMIIELYIPTLSTHSTAKVLDLVTISSHVNGREVEIQVPNRVLELGSEVLGYGGSECALTMSHILCPFNDARVLSTDMKYCLQGNITHCIFSPVVGSFLRRFALVNGVVIANCADMSCVCFDPQEIIYQNFQEPTTVIDIKKCGKVQLDTLTFTISTFANRTYGPPAYVPPDNIIQSEPLDISGNLIAVNNSLSSALNHLATSEILRNEQIWTSSLGISTIVALVIIGILIICLVVTWAALWALLKEVRGLNSAVNSQLSSYVMGDKFIRY

SEQ ID NO: 15791 - protein, 561 aa, unidentified
MRLTPYPIALTTLMIALTTLPETGLGIARDALSQVGVIQSKARSLMYYSDGSSSFIVVKLLPTLPTPSGNCNLTSITAYNTTLFKLLTPLMENLDTIVSANQAGSRRKRFAGVVVGLAALGVATAAQVTAAVAVVKANANAAAINKLAASIQSTNAAISDVISSTRTLATAIQAVQDHVNGVLASGLTEANCRSQDALIGSILNLYLTELTTIFHNQIVNPALTPLSIQALRIILGSTLPLIVESRWNTNLNTAELLSSGLLTGQIISISPSYMQMVIQITVPTFVMQPGAKIIDLVTITANRMEEEVLIQVPPRILEYANEIQAYTADDCVVTPHAVFCKYNDGSPISDSLYQCLKGNLTSCVFTPVVGNYLKRFAFANGVMYVNCKALLCRCADPPMVITQDDLAGITVIDITVCREVMLDTLAFKITSLNNVTYGANFSMLAAAIKDLSPLDLSAQLAQVNKSLASAEEKIAQSSSLAAQAVSQEATITVGSVAMLIAVLALIAGCTGIMIAVQMSRRLEVLRHLTDQSIISNHHYAELNPPPYNHSYESLHPIPQSH

SEQ ID NO: 15792 - protein, 533 aa, unidentified
MWIMIILSLFQIIPGVTPINSKVLTQLGVITKHTRQLKFYSHSTPSYLVVKLVPTINTESTVCNFTSLSRYKDSVRELITPLAKNIDNLNSILTIPKRRKRMAGVVIGLAALGVAAAAQATAAVALIEAKKNTEQIQALSESIQNTNKAVSSIEKGLSSAAIAVQAIQNQINNVINPALTALDCGVTDAQLGNILNLYLIKTLTVFQKQITNPALQPLSIQALNIIMQETSSVLRNFTKTDEIEHTDLLTSGLITGQVVGVNLTNLQLIIAAFIPSIAPLNQAYILDFIRITVNINNSESMIQIPERIMEHGISLYQFGGDQCTFSDWSAYCPYSDATLMAPGLQNCFRGQAADCVFSTVMGSFPNRFVSVQGVFYVNCKFIRCACTQPQRLITQDDSLSLTQIDAKTCRMLTLGFVQFSINEYANVTYSFKNNVTAGQLIMTNPIDLSTEIKQMNDSVDEAARYIEKSNAALNKLMYGGRSDIVTTVLLVGFILLVVYVIFVTYILKILMKEVARLRNSNHPDLIKPYNYPM

SEQ ID NO: 15793 - protein, 531 aa, unidentified
MLNSFYQIICLAVCLTTYTVISIDQHNLLKAGVIVKSIKGLNFYSRGQANYIIVKLIPNVNVTDTDCDIGSIKRYNETVYSLIKPLADNIDYLRTQFAPTKRKKRFAGVAIGLTALGVATAAQVTAAVALVKAQENARKLDALADSIQATNEAVQDLSTGLQAGAIAIQAIQSEINHVINPALERLSCEIIDTRVASILNLYLIRLTTVFHRQLVNPALTPLSIQALNHLLQGETEGLVKNESKMTDSKIDLLMSGLITGQVVGVNIKHMQLMIAVFVPTTAQLPNAYVINLLTITANINNSEVLVQLPNQILERSGIIYQFRGKDCVSSPNHMYCPYSDASILSPELQLCLQGRLEMCLFTQVVGSFPTRFASDKGIVYANCRHLQCACSEPEGIIYQDDTSAITQIDASKCSTLKLDMLTFKLSTYANKTFDASFSVGKDQMLVTNLLDLSAELKTMNASVAHANKLIDKSNLLIQSNALIGHSNTIFIVVIVILAVMVLYLIIVTYIIKVIMVEVSRLKRMNIYSIDK

SEQ ID NO: 15794 - protein, 554 aa, unidentified
MIPRVLGIIVLYLTHSQILCINRNTLYQIGLIHRSVKKVNFYSQGSPSYIVVKLVPTLAAIPPNCSIKSLQRYKETVTSLVQPISDNLGYLQDKLVTGQSRRRRRFAGVAIGLAALGVAAAAQATAAVALVETRENAGKIQALSESIQNTNQAVHSLKTALGFSATAIQAIQNQVNEVINPAINKLSCEVLDSQLASMLNLYLIHLTTVFQTQLTNPALTPLSIQALTSVLQGTSGVLMNSTNSTLTQPMDLLATGLITGQIISVNMTSLQLIIATFMPSIAELPNAVLHSFFRITTSVNLTEVMIQSPEFIMEQNGVFYDFNTAHCQLGDNNVYCPYIDAARLSSTMTNCINGKLGDCVFSRVIGSFPSRFVSLNGAILANCKFMRCNCLAPEKIITPLDGEMISLIDLRVCQKLTLGTITFEISQPVNVSFQGGFVANAGQIIVTNPFDISAELGQINNSLNDAQGFLDQSNNWLKVSGWISNSGSLFIAGIVVIGLIVLCIVIIIYINVQIIREVNRLRSFIYRDYVLDHDKAPYSPELSSPHRKSLKTVS

SEQ ID NO: 15795 - protein, 534 aa, unidentified
MAHINSLILLLMLTETGSSVNIQLLQSLGVINTHKRQLAFYNQQPPSYLVIRLLPTLNIPKQNCTLNSINRYEKAVKDIIKPISDNLNWLSDNLIPKRRGKRFAGAAIGLAALGVAVAAQATAAVALVEARANAEKISSMSAALQETNQAVSSLTAAMASSGIAIQAIQNEINNVIHPILNQVQCGVLDSQIASILNLYLIKITTIFNNQLTNPALHRISIQALSVLMQSTKDSLKNLTAGDTQTSLDLIRTNLIEGQIVAVNMTTLQMVIAVYIPAVAKLESAVLLDFISITVSSNQSEVMLQLPSRILEVGNNIYTFKGDQCTLTETTAYCLYSDAVPVNEKISDCMKGIQSSCIFTRIIGSFANRFASVNGAIFANCKSLTCSCTQPDGLIYQPDNVPLTIIDKIKCSKLNIGHLTFNIRDSTNATIDLHTDLSDSQITITNPLDLSAELTQINNSVINSHLHLMNSENILRRIDSGLFSKAIMIFLLVGVCSLIIVVIGLIVWIRFILLHLKSSSHTNRQGSSLFSIDSV

SEQ ID NO: 15796 - protein, 538 aa, unidentified
MNLLKVHLLLMLYPSCICGINKDKLLSIGLVHKSVKNLMFYSQGSPSYIVVKLVPTLGNLPENCTLNSLKRYKSTVTSLLTPLSDNLNYLQQTLTVSKGSRRRRFAGVAIGLAALGVAAAAQATAAVALVEARQNAAQIQSLSESIQNTNLAVNELKTAIGASAVAIQAIQTQVNDVINPAINRLSCEVLDAQLASMLNLYLIHLTTVFQNQITNPALSPLSIQSLQSLLQSTSGILTNMTAGSNLVLNDALATGLITGQVVGMNLTSLQIVIAAYVPNVAKLTNAIVHQFIRITTSVNGTEVIVQSPTQIMEQNEVMYELRSDHCSESVMNIYCPYIDAQLMPPTSTNCINGQLNDCTFSKVVGSFPTRFAAVEGAILANCKYLQCNCLVPPYIITPLKGEMISMINLSKCQRLDLGTVVFEINNPVNVTFNGNYRADVGQLIVTNPLDISAELNQINTSLSNAQTFLSKSDAWLRVSQWLSNSGTIFIILLIGLGIGVIYMVINTYVVVQIIKEINRIRDKDRAHLLKGSVSSISM

SEQ ID NO: 15797 - protein, 538 aa, unidentified
MRIALTAVIVSIHFDLAFPMNKNSLLSVGLVHKSVKNLYFYSQGSPSYIVVKLVPTLGNVPGNCTLNSLVRYKSTVSSLLSPLAENLEYLQKTLTVSRGGRRRRFAGVAIGLAALGVAAAAQATAAVALVEARQNAAQIQSLSEAIQNTNLAVNELKTAIGASATAIQAIQTQINEVINPAINRLSCEILDAQLASMLNLYLIHLTTVFQNQLTNPALTPLSIQSLQSLLQGTSSVLTNITSSSKLALNDALVTGLITGQVVGLNMTSLQIVIAAYVPSVAKLSNAVVHNFIRITTSVNGTEVIIQSPTIIMEQNEVMYDLKTGHCTESDLNIYCPYVDAQLLSPGMTNCINGRLNDCTFSKVVGSFPTRFAAVEGAILANCKYLQCNCLTPPYIITPLNGEMISMIDLSKCQRLDLGTIVFDINNPVNVTFNGNYRADVGQMIVTNPLDISAELNQINTSLSNAQGFLSKSDAWLHVSQWVTNSGTIFIILIIGLIVGIVYMIINTYVVVQIIKEINRMRTSDRAHLLKGSISSIST

SEQ ID NO: 15798 - protein, 532 aa, unidentified
MVTIIKPLILLVTVILQISGHIDTTALTSIGAVIASSKEIMYYAQSTPNYIVIKLIPNLPNIPSQCNFSSIAYYNKTLLDLFTPISDNINMLHQRLSNTGRNRRFAGVAIGLAALGVATAAQVTAAFALVEAKSNTAKIAQIGQAIQNTNAAINSLNAGIGGAVTAIQAIQTQINGIITDQINAATCTALDAQIGTLLNMYLLQLTTTFQPQIQNPALQPLSIQALHRIMQGTSIVLSNLTDSSKYGLNDALSAGLITGQIVSVDLRLMQITIAANVPTLSRLENAIAHDIMRITTNVNNTEVIVQLPETIMEHAGRLYQFNKDHCLSSTQRFFCPYSDAKLLTSKISSCLSGIRGDCIFSPVVGNFATRFISVKGVIIANCKFIRCTCLQPEGIISQLDDHTLTVIDLKLCNKLDLGLIQFDLQVLSNISYEMTLNTSQNQLILTDPLDLSSELQTMNQSINNAANFIEKSNSLLNSSTYEFNRSVALLVALILLSLTILYVIVLTCVVKLLVHEVSKNRRHIQDLESHHK

SEQ ID NO: 15799 - protein, 539 aa, unidentified
MAPCVLFLSSLLLISTISPSHGINQPALRRIGAIVSSVKQLKFYSKTKPNYIIVKLLPTINLSKSNCNLTSINRYKESVIEIIKPLADNIDNLNQKLLPKNRRKRMAGVAIGLAALGVAAAAQATAAVALVEARKNTQMIQSLADSIQDTNAAVQAVNIGLQNSAVAIQAIQNQINNVINPALDRLNCEVLDAQIASILNLYLIKSVTIFQNQLTNPALQQLSIQMLSIVMQDTAKILGNFTIGDKFDQHDLLGSGLITGQVVGVNLTNLQLIIAAFIPSIAPLPQAYIIDLISITISVNDTEAVIQIPERIMEHGSSIYQFGGKQCVYGQFSAYCPFSDAVLMTQDLQLCMKGNIEHCIFSSVLGSFPNRFASVDGVFYANCKYMSCACSDPLQVIHQDDSVNLMVIDSSVCRSLTLGHVTFPIIAFSNVSYQMKTNISIEQMIVTSPLDLSTELKQINNSVNIANTFLDSSNRALKTSIFGTSSQIILIVLLIFTCLLILYVIFLTYIIKILIKEVKRLRDGNSRTGSKLSFINPDV

SEQ ID NO: 15800 - protein, 537 aa, unidentified
MLWLTILIALVGNHESTCMNINFLQSLGQINSQKRFLNFYTQQPPSYMVIRLVPTLQLSANNCTLGSIVRYRNAIKELIQPMDENLRWLSSNLIPQRRGKRFAGVAVGLAALGVAVAAQATAAVALVEARANAEKIASMSQSIQETNKAVTSLSQAVSASGIAIQAIQNEINNVIHPILNQVQCDVLDARVGNILNLYLIKVTTIFQNQLTNPALQRLSTQALSMLMQSTSSYLRNLSSSESAINADLSMTNLIEAQIVGINMTNLQLVLAVFIPSIARLNGALLYDFISITISSNQTEVMLQIPHRVLEIGNSLYTFEGTQCEMTKLNAYCLYSDAIPVTESLRDCMNGLFSQCGFVRIIGSFANRFASVNGVIYANCKHLTCSCLQPDEIITQDTNVPLTIIDTKRCTKISLGHLTFTIREYANVTYSLRTEIANSQITVVSPLDLSSQLTTINNSLADATNHIMNSDRILDRLNSGLYSKWVIIFLICASIVSLIGLVFLGFLIRGLILELRSKHRSNLNKASTYSIDSSIGLT

SEQ ID NO: 15801 - protein, 548 aa, unidentified
MLSYNKQIYMIILLVLLDQTTTSNSQLALSELSKIGIIKARSLKLKVKGQPSIQHMVIKLIPNLDNITTCTYTSLNSYKQLLLKILNPIRNSLDLVQNSISERRSGVRFWGAVIGGVALGVATSAQITAGIALHKANENAKAIMSMKDAIKKSNQAVQKLQNAVGNTVLAVSALQDQINSQIVPFINQLSCELINNKLALSLNQYFSEISLIFGPNLREPALSTMSIQAISRAFNGDFESLLTNLGYNSDDFLDILESKSIIGRIIEVDLQEYLIIIQIEYPMITPVPEAFVQKFNLISFNVGGTEWLSVFPRNILIRGTLISNIDLTDCTETTNSAICSSDTSSPLSAELYNCAKGNITLCARTRVVNSQVPRYALSDGVIFANCLPTPCQCKTSGNLIIQDVFTTNVMVDQSFCPEIFIDGIFITVGRRFLNRTTYSSNVTVGGQVTIDPVNIGTELAEVKKDIKESQDLITESDKILNKINLSFNSTALMVFLIIVAVISVVWIPLSILWLIYITKGKNLIGFKNYNHDRLSTTGTLSSLIPSIS

SEQ ID NO: 15802 - protein, 543 aa, unidentified
MMRYKNFRLIFILTICIYTMILTIKAQYAYTELSKIGIIKGNTYNLKITSQTSSQYMVIRLIPNLQNLTKCTLSSLSNYKLLINRVLLPINQSLSYINSVVHNKYTNQRFWGAVVGGVALGVATSAQITAGVALHNSNQNAKAIQNLKDAITNSNKAIESLKTAAGQTVTAISALQDQINSQLVPSLNQLGCQMVETTLTLKLNQYFSEISLIFGPNLRDPASETLSIQAISRAFNGDFESLSKTLGYSGADFLDILESDSIRGRIIGVNLEDYFIILQIEYPTMISIPDAKVQEFNIISYNHLGSEWFSIYPSVLLSRGNYLSNIDVSRCTRTTNSYICLSDTSSPISNSILLCSQGNLKSCARTRVVNTYVPRYALSNGVIFANCISMNCRCSDPEFLISQDSHVSNVMISSDDCKEVYLDSIYITVGPKKLNRTMYSSNVEVGGPITINPIDVGNEIADISTSLNKTQHYLDKSNSILNRINLRIVNSSSIIVLIIMASICLILIIGLIIWNCYMYRIINYNRLRSIASSRSSTINTLTN

SEQ ID NO: 15803 - protein, 545 aa, unidentified
MAERRYLIILILSVLISEVRPQVAISELSKIGVIKARNYGLKIKGNPSYQFMVIKFIPTITLNDNAKCNFTAVDEYKIMLERILTPINKSLEIMKSTITSRTTGVRFWGAVIGGVALGVATAAQITAGIALHNSIKNAAAIQGLTSAILKSNKAIEKLTLSSQKTVLAISGLQDQINTNIIPAIEKLGCETAHNTLRLHLNRYFSETSLVFGPNLRDPSTEAVSIQALSQAFGGDFDSLLTQLGYTKQDFLDVLQSDSIVGRIIDVDVPNALMTLQIEYPEMTDIPDAVVQEFNLISYNYKGLEWMSLFPRHILIRGNFLSNIDLTDCSRTDNNYICREDTSSPLSNSMYKCATGSLPDCARVQVVNSHVPRYALSDGVVFANCLPITCVCTSKSQHIIQDNKASNVMITSEFCKEIQIDGIYITVGPRLLNRTYYGANISVGPPITTNPVDVSNQLAQVENELNEAKKYLDQSNNIINNIKHSILTPQTMVYLVIISVFLILWFIITLIWLIKLTRNQGNSDHFRQSLERGSTINSLSSLIPGT

SEQ ID NO: 15804 - protein, 608 aa, unidentified; identical to SEQ ID NO: 15296

SEQ ID NO: 15805 - protein, 589 aa, unidentified; identical to SEQ ID NO: 15297

SEQ ID NO: 15806 - protein, 650 aa, unidentified; identical to SEQ ID NO: 8686

SEQ ID NO: 15807 - protein, 643 aa, unidentified; identical to SEQ ID NO: 8685

SEQ ID NO: 15808 - protein, 506 aa, unidentified
MLNTLLKTLLLGLVSGMRLSVYNMSTPFLIPLPSPPDCHSNKNHTNISAEAVTIWNIDTSQLAGEAIVLWTEQYETRCSTNFWGNYLEEITSTELIPSAVPTVQNMKLWSSRLQLYNTRSTTAESIYSCKWMSTITKTITKTWVKKSSLYYNSDGSLFSEGIEWKTKISDNIYQTGLRFLYSSTSTLHACPPLLKQTYPGVVQNSDQFKFITIPQLQIQFNLIISSSHAVCKVNNTTLYQTPEKYLVSLSSRTKDEGISPMVSVNTDYSWSHILFDLNALEKMIESELELVEHETCLTRQMLWKQMFYARNPSLIAQYHSGNPWATGSFINGKIAIQIPKLVNSHCTYPKMRHVNGTHMRVECEKLGDVYISPWDNCLSSNPCNNITDYGFWFKSSSQLYVDYITGEVQSSTRFNSISFPRFTEVNLNKLTKYLQNLPLENNLIALDAKISTTEHLSVSFHDIKQFVENIVHNIWSSFVMYIMIIIIICYGIKQCFHSPGRKKPLY

SEQ ID NO: 15809 - protein, 470 aa, unidentified; identical to SEQ ID NO: 15399

SEQ ID NO: 15810 - protein, 476 aa, unidentified; identical to SEQ ID NO: 15398

SEQ ID NO: 15811 - protein, 451 aa, unidentified
MFFTILPTLLLGNWTLVNITDITCPHYKDYTIHPEAINHKLSLYEVTDEDYNEYNNVLFGRDCSKLTLSTKCKAHLMASNEIEYEEIYESPDITDCNSLKMDNMIKYPESNCRWNLFDNGYISNNETTIKINDKSFLLDVHTGLIVNQDKIFNHCDEHMCEYKNNRGFWLRSKDINTEKELCTHLKNTTHLNKQEGYLSVYQNNKFLYIENNPVHYDDMCTIKRCNNLILTIKNFKKYVIKSSGLFQECKTDNIHYLNKEESFNEVEDHILCANKLVKVIKEKKLNYYDLKYFHPTRIGLHNIYRLNEDKKLEKNIAYYSKVDSDKDEVKVKSVACGTKVNCLYNGKHKINSEKEFNVDIKEYKIYKDEVEKGFIIEDSMYIPYEKTEIEFERNAITFDFDEIYKFGMGLLIIALILLILVCVVTKCKSRNNIKSRKSLKRFEEKASFLNI

SEQ ID NO: 15812 - protein, 447 aa, unidentified; identical to SEQ ID NO: 15264

SEQ ID NO: 15813 - protein, 442 aa, unidentified
MHVILPVVLLTSFKLINFHELICPPDNVIDHDLEGLNMLHEYKTKEYVLKEGALDVFSLSGYDCTKVRMKTGCKFHFFAKNDIINEMEMIPIDNRTCQNLSNKVLKYPEPECISGIFNNDYHYVSREESLSQSRTYLFNPTTNEVINYHDIFESKVDNVYKYKNNRGYWIAQNNEKKMECDHYEEHGSSDLKIKIYEKEKDKFISVNGKIYSVDNVCKINFCGLSLATTKDRIFFKLPPKVDIKTCIDEVSTPSKSDMVKVDNFYKECEENRMELISAKRFNYQQLMKFMPQTMGIHHVYRINSNKTLEMAIGRYGMVNLDTLNGTEHWIECGLETKCTYNGIMRPLTNKTSIEIDFNQLIKHHEEIKNGIYVYDNVYNQYYDETTTIYKTQNTLLTGLYMMLPWIAESVIILLIVFILIKRLVKRRKNKRRRESDIKMGTW

SEQ ID NO: 15814 - protein, 443 aa, unidentified; identical to SEQ ID NO: 15207

SEQ ID NO: 15815 - protein, 450 aa, unidentified
MTKQIFKMNAITSCIPLLLFVYEVSGRGNCTKIESSGIKELDCSKTVSTGLGWKQCINSELTISTLIPENYIIIEGNEKNCYQRVSTCYTYPFNVRNEKEHKAIKTPCRKDYEIYDDFRPQYDYLDYSCNWNFFSGETTTKTDFVSSYSQSIGKLYLSNYVIEVKGEDLYRVEGDEKLFCNKLLTRCWIPNKADDLKIQSITKPVHIKVKECGNDVVDLYNHKILFQLDKVCTTSYGGIKVYQTLNHFMLTNHTMINDPPFCKDNLMWREFSDLDLIREESISTLEGLIKTLSCEKLKSSGSTNVSEWEALSEVNSQIPRISITYDNEKVIIYRCFGQGTTEFDNLSELEQVITIQQRKVKTMISEIKGLQHGSLVTNFRVNKFNEISYFYIACVMIMFMMIAAICIKIIFVCIRSNSGKNQTRNMFKNNHLGEIGGRRPTTVEGFRLMK

SEQ ID NO: 15816 - protein, 476 aa, unidentified; identical to SEQ ID NO: 15398

SEQ ID NO: 15817 - protein, 449 aa, unidentified
MAYIIFPILLLGAFRLASRQDLTCPSLTDDSNLNIIYNTTYSVPKVSTNVLETNSYKLKGFDCYKIIMKTTCEANLLSKNRINYEKVVISVDEKECKLGSSLELIEYPIPHCEWNMFSSSINVKTLEFIHYKEKSYYVNPQTGFLVGQMELFNYCDDKYCVYKRNQGIWIKDKNDNTYDCSKHNVNTMYVADMLIGKVGDRRVIKVSNRTIYEEDVCTISRCGVKLMYLSDFEIYKLPTGIDFKKCKEGHVTMIKNNQLIKQLQSEIECVSYVEDMISSKTINYEQLRKLHPTNIGVHKVYRLNSNQKLEVSMAYYTRIDDIEIINKENHWITCGKKYKCSYNGAIHLGELILNGTFSVDDYTRYIDEKPEPIVINLDYEPAIKDMTLTTQQYSESSTFNLISKYWMWTGELLLIVISVCCLLTCIIRSCKSKGSHINLISGRRVNDIY

SEQ ID NO: 15818 - protein, 512 aa, unidentified
MFHTWITLGILHQFSTSILLPDCPSKTNWHDVHLTSTLCERGGKPTEYNKLETTVIKVLNHKQFQKEHEGYFCSSVTLYTICTTNFWFQSTIDKSLERELPSLIDCYLALDHSKEDPIDFHLQLSYPPAKCEWGFPSKTISQSKKVISLSSHSARFNSITAGLEDPLFLHGECYQSRCSTNLPGTIWIAKKNFSECEGLTGLLVHVGTIGASHQVILHKGLPAISSFTLCEKTLCKREGFETSFGLFFTSNYPFTHVQSSCKNPYNSKYYTSEYDAEVRLQLIEKDLIVLKCKQAVTSMLRSKSIFNPYLHYFNPTKAGTAPVYQLFQDKLKVAICSYIHAEPYSIDNNASGIRDTLGYRVNSSELSWKFWSHNPQEPNSSCSALGPNGIHRDDNCRLFYPYLNLLDELTGDPVMKLVNISTPQIKNSYNYLNKRLRKQMMDELDNPNFFNLLGQTVVNFWHLGLIFLVSFGGGLFLIKSFKYWIVNYKKKRQNDNFERVQQVELSLIPFGE

SEQ ID NO: 15819 - protein, 539 aa, unidentified
MDVSAIKVLLAVLSVVHPILIPDCKSNTVWFPATLDISMCPLPLTEYTSSIFKEGQIGLFSPEDMTQKLVDGAICYIKVSKVKCTTGFFWSQNIQKSVSFRRPPKSACRDHIDQQREEISFTEAEFPTPVCKFQLLSSTTTTTESETLIVEPHPIEYSYRDQLLLNSVLLRGKCRERICPTYRLEAYWIAKDPLPDCPPMTRHPAKIYFDGQKPVSVISDVLPPLGLKGSCRTVYCGQPGIRTVENIFINISGVDITSQIPTCTERHQLEGFSKDISSKGELLTFEEHTKYTLCIYAVILMKSLEVKHPYLLSVFQPQFAGSHPCYRIFNRTTIMKAICPYIHMDPVGVSPHGVIGTDKHSKPVIWKFWDALTKEKCPSLGPNGIIRDEQCKVHYPHEYVGSDIMSLIGEMMRDHAPIEKSFDILTRNTQSGNVEISDKRKSQSDSRSFIDAMSDDFTTLKADFLIAVKAFAGFCVVCVLYKLKFFKLITKMLCCCISLGKLSTKLFVASSSTVLRSSNTHRLRRRQRRHEEIEMNPFA

SEQ ID NO: 15820 - protein, 560 aa, unidentified
MKKTNRSTILFNMLFNKMLFQIFLFLVNLHVAISTSQKLKDYQLIPIKEIGSRRTILPADLSCSTKSNNDHFGITSFQTQIPLHESPTRVGTFCRVFNTNLTCSFGAFTYTFKTSSSAVSSSRQECQEIVSRFTHGHHSGFLEVTPNCAVFSFATKTTRHYLVTKEILPFSPELSGVKSSLFHQNVCQDKYCLSSDGLTHWFLDSHESPGCTGTVLGFGELRRTISESGVGYTIGSSLIADTPLKELCIGSRYCGKYFVLNSDFQAFLLDDQSLEIQDLLLTKLVKCPANSKVSPIPTRSFRSRQTFSDKIKIHSNLCQDRLNAARRTNILQERHLGLFVLPVEGISAGYRIENGKLWQYSLLYRRVRQVSIPHGNHLESDLQLTFEDTTGSTLHLSKDLCIFEAATDQSLDQFSCTWFNGIKIGQTSMIYPSYTNSFNYLQPCKEIQFQEEKEEERERTMDKQQSESLSDWFFKSWVLLLSLFIAFLLILSIILIICCCKCRKHGDQSDKLYNGVTIREIADRDVSSERSISFHSVHPRRVLPIQNPPGPLMINWFGDE

SEQ ID NO: 15821 - protein, 565 aa, unidentified
MMRVILYLITILTWLHAGVANPVINVTLDYPAIPSQTWISKNPINLSKVSCGINNLKTESHYIDLEIYLPYSNREKAGGHLCRRFNHKMLCNSGWAGFTYENEVSASPISKEQCVEAVSGYLNGKPPQGPLQFPKCETFSSKSADNFRIDVEYLIVDLDKRDVSYVHHLFPQGRCKDVYCKTVHPNMFWITENLSPPSCDDLRLGRASILLDEYQGFAYSLIDTAYIPPLPLQTGCKGISYCGHMGLRLDTGFLLLPATNQSITRLDNITMKMHRCNSSTTIKELSMFEMAKTRSFHEMLAFHQSQCERVIHRVQSHQGIKSSDLIYLGPILGGRGVTFRLRNNSLIQYETRWERVERFEIDCRSLNSCRVQFKKPGYSELFNLPTNSCSEPPAELLLEGVICMWFGGISFGTRGLYYPHRHFTTLIYEGYMDALEQGDEYIEPSAIPDNDEGITDDTDSEEGETSYESWWDTLKNEIWWIITGVVVLLGMLLLIRILLCISRSCSNGSPTSKGGSTIIELQTMGYLQVPDKVKNAGLHAPATLIGGMGVRPKKKNQPLHEFLSP

SEQ ID NO: 15822 - protein, 524 aa, unidentified
MFLLFLLLFVVHPLVGTGLPENTTWDFPNHVYFFPRDELYTWKPIRSSELSCPPFFPITTGSGKISVTYATPGPMTTESATITGYSCYKSIFSVKCSENFVGWQTISHTIRPTEVSHRECLDEYRRIKTGSLPAAHEFPAPNCGWWADRWAEKEYITLIHHPVSFDPYSLEFFDPLFPGGKCNNRVCSLIHQGGIWIQTEEHVGICENWHSGIGHVGLVKNELVLFPMIGEVRSLQGACTLKFCGHIGYRLATGEFFKLDFYSLPKRIPFCEKGVQVRLDSPRGMTYEIEEKVMKEEDRLECLTSVALMQSTGHASQYLLSTLVPRHAGPGDAYRLSNGIIEHAHVFYVGITKASTGRDQNVVGIDSKGNPVQWTDWIKDNGTLIGPNGVTRKPGSPVVIPRFERLANEYDLSLARVQSLKPIPHPLVTFLANKSDFLESESDNLGRDGSFWEGVRDWFHSMWGSFTWSMILVVLGIVGLVFLLRRYSVKLRLPDSPKVEKKKKKSRRGNPVRDPWGDIADTAV

SEQ ID NO: 15823 - protein, 513 aa, unidentified
MGTVGEVFLLLSLLSFLPLVGSDPVVKAIAAPYFFPENLNYAWHPIEVTSLTCPPQRSIPEQDKGIPVIFETIHPSSLERALVNGYSCYTSTMAVKCSVNFVGWKTLSHQITNKEPSSTACWEAIKRQEDGAQSPPPTFPAPNCAWWSENWAELDYTLVLKHPARQDPYTEALYDPLFPGGSCNKAECPLIHDGGIWIQTEPLASICKHWEVLEGLTYTGPEIGRILFSPEGPPKYLDHSCRMTFCGRRGYRLQDGEFLVFSSPPAWGVPPVCPAGTLVRAHTPEEEIRWNEISKMEEADRLMCISRLSVAYATGKVSLELLGSLVPSHGGPGTAYRINNGTLEAAHVKYVPLINSSNEEGNLVGVGPDGTPILWEYWVLSGSRMIGPNGVYKSKGRIIVPNFERRKLTYDLTIHVFEDLKEIPHPSLVIRSNHTDLLRKVSHNQGVEGDHWASIRLWFSSLWGSFIWTCGLALIGLILLCCICRRVRCCCRGCGRPQSKETGGWESIEMNDL

SEQ ID NO: 15824 - protein, 545 aa, unidentified
MAFSTLSFTSLMVFHLIIPVSPTPLDGKILYTVPKEIHDWHHIDPKDLSCRFDFTDNHGECISTGPEDHFVLKAGFGGEISLEGYTCTGITLTTTTYTSFFGSVSVTFSQSYYSPSYQTCRERYQMKSERPSEYEATLLHPVHESSWMRTVDVSTNSYLIVTGSKAKFDPYTEHLLSSIFPKGECIANPTEGICSTTMEHTLWFSVTEQSTYCDIFEPAKLTRYGKDYKACGYQDSHGFYRSVQGACVENFCGKVGLRFLDGFVMFAGNIEQTLYCTPDLLISLHTTMLDAREEELRKYIKDWKDDCLDVIEDITYRGVTSIRKLGYFRDMVPGPGRAYRISPNGLEAADVVYIPVSNWSEILPNRTCLLINGQCMEPVNDQFFNGITLGPEGVIIIPERDLLSGIFDDYFQIVHQIDVRHPSVIAISDHIERLNTSSIKQTNSEHISPIDFGLGSWTNWALTLVIFVLASLLLMFVAKKLVVCLWKSGKRSGMSSDPERVPNRERGPLRPPRVRDVEVYGFGDRGHQRRTGEIARPERMAETNF

SEQ ID NO: 15825 - protein, 660 aa, unidentified
MTMRQWVLLVLFLLGVFPGNVVVLRHDQELNPEYGRKMKVTEHTFRGKDGIWRKFLVTIFGKQVFGSDYPERHSIAESFVETTVTPEHSRQKRATPDPNAMYSKLKRAGGYQDSPGWESYVSWPKKLGEWTSNFAGGGPKCPIFKDPLSVHSRSEILIHMQRPSHPEGIFVQGYLCEAQSWMSRCKETWYFSYEETQKVEKQTAELEKCHEAIRLLEEGNPVIPRYPLALCYWNADHTETIVYHTVTRHTAALNPYTSHLVDPVMLRGNCALNSTACPTSHASVLWIKDSHHSDHTVCTKEDWEDYEMSVHLTGLQVAGNKWETVHLLEGEGIGTKVLEKSCKMCFCGTTGIRFDDSEWWTFKGYTQSQKGGAEIRFKDVMEGLPDCDQRKSKEIGISHPHFSESYGRKEVGNMLRALQCNNAIGKLMEGEHLTPIDISSLAQEKPGLGLMYRLHRDKSGFFDLQWAHANYSLILYKPDPLLNSIGLDYLQNPVTLDEWVTSDIPGIQIGVNGIIRRIDKNKTLEILAPQIMLQMGELSPEFAKKIAVKRIDWIDDKGESNIIDDDGVDIPRGELDRTNVVDGVRNWVEKVRDTISGWTSGIKAVLGTAVLIVMVVILWRVVMICKAIKCKSGNASKTNDSAESLFVPKTSDHRLAKMFG

SEQ ID NO: 15826 - protein, 667 aa, unidentified
MSKSIVIFLICFVFITQVSSILDWPFRFPEIGKMIAQNDVLKKGTDGKATKYRLSLIAIPLGTFGRPPYDIAEPGTPMPVTLPRVTRDVKPLEHLIESQGQYIQTDRSVRYYLNWPDQIQAWSNKFPDDGPICPQFKTSLKVIDRKLTKMTMSRPMHPEGLFVNGYLCESQVWISRCKETWYFSYDEKREIKYDVPVYEKCLESLRLYQKGDPIELEHPLMVCYWNAEHVESRVYHVITPHVTTINPYRNEVQDPLLANRTCQLKNSHCSTIRESTIWIRDSHDPLEGICNLKNWNHAEVDVSEVDSETSIQYRWRKGHHLEGPEFGMKLLESGCQMTFCGIRGVRFTDGEWWTSLVTDPTRNQTKSNQIYNAISDLKTCSAEESSDIGIAHPNFQDPVRKKEIGNVVKALQCSQTIGKLLSGEELTPLDLSSLAPDIPGPGIVYKLKWVNDSGYILHWAHATYKLIRYHPRQIHPGNISIGYDHLNKEMLVNEWENTPVPSIKIGHNGVLKKIVTPGNNFSILVPQMMLQMGEVDNSFVNKIPVEHIKLEQINDEPIIDDDEKNMIKNDEKDVINRENVVDGVGSWLHKIGEVITGWTSGGKSFILMILMLCSGYLIIKLSLFCYLKVKRRKSIPDGMETKKRSKQNEYVDLKPLKNGSRNNPFSV

SEQ ID NO: 15827 - protein, 702 aa, unidentified
MKLFVLAIVCLGLRSRVINCQDKQRYVITNKGWLYDTVDNWYLEPYRPFGPPKTIERQIEEKLNLTKGNIPNKGSYPSESKMYMYNWPFGPYLWHELTPDSNIGCPKFKSNQGELNNINTKITVKRPSHPDGLFVKGYICEGLEWVLTCSETWYWSVSFTKQIKSFTPTLDECQYSVKAYESGEPITPYFPEPLCFWNADHTESIKFTITTQHSTLFDPYRGMLDDHTMVVNTCPYNSTYCKLKDVNKIWVRDDNDKYRTHEICKIDTWEEFDANVYFLDLPDNANSLDANWKNHLLIEGEGIGKKDLSRACRMFFCGIPGIRFPDREWWSIKIDGHNNEVEYQNLDMIPECTNNQTIGLSHPHFKDSEEKIEVLDIIKTVRCAETLSKIYASFQISPFDLSALAQEHPGIGLVFSLRKQDNGRSPKIYWSYANYKLIEVSLDQNSEFDTSVLGLKQNRTNLFVDSRLNEHQNETMPITTSPKREGSLIGWYHNQEVWSNEWYAGSVAGLHEVGLNGIVRESLGDSKQCVKNGATLNCSNKPSSITKYKIIFPSAAYKMGLVTSMITKGIPISNILRPTDMTQKEFDLENPNDIVRETDSINRVDIVNSTKHWWNGITHSFSFGFKSLLAWVTTVIHISIIVVCILIIVKLYKTCKRNQSQATHATKRTGKMLDTIIGEDHLYDTVKTPSRNEDIRLNLFNH

SEQ ID NO: 15828 - protein, 668 aa, unidentified
MMMQKVIVLAMVSLCASVHRSVHKIGNLVLCPNSPMGICLPGHHPPIPTTKKPSVRNIARLPREILNRPEMKDIGVVIIDRRLDGSSIHGKVERATIQRKQQNPQEVREEEYDQVEGKVTYMNWPSKSGEWTENFGPTGPVCPRFSSQFYITHDKLIRAVLTRPEHPEGVFVDGYLCEAQIWSSKCTKTWYFSYQEERSISGAVAEVEKCFQALELQKAGNPVKPEHPLSVCYWNAEHTESVVYHLITPHTSTVNPYTNKIVDPLFLKGGCSLDSHICQTSKLSVMWLRTGHDSPSMVCNVDNWKKQQIVLHEVDMETHEKGKWARRTILEGDHLGTKVLESGCRTKFCNLNGIRFDDSEWWTMDPHEDFQHNPLYGRIRDMISQLPICSEEKSKDIGIAHPNFETSFLKKEMGNMLRALRCNDAVGKILEGESITPVDLSALAPTSPGPGIMYKLEETEGGQIVLKWAHANYSLIRVSPIPNTDELGYAKGGSKIIIKEWTNTTIPGIQVGPNGILKKHLMNGSSVLLAPQSMLQLGELDPSFSRRIDVNHIKWTEDTGAETLSEEELIPLKNGSIIRHNAMDWIEMWVHEVGDVVSGWSSGIQAVISIFFIFVFVAALYKLTQICIRIKRRIHPSKKKIQSPDPEADADLIGSKPERDNRNQTVFG

SEQ ID NO: 15829 - protein, 591 aa, unidentified
MISNMFFLFQLSLFLQFIAGDESLETITAPETPDPILLKGDTKYLFLVPSSVKNWKPADLNELTCPPLISKPDTSEMTYFSTDVMELQKHHELAPVEGYLCSGLRYKVICSEGFFGQKTIAKKIENIEPDSKQCLDDLSKFKNDDYLLPYFPSEDCNWMKETPTHKDFIVFQKHFVKYDPYNNGFYDPLLKKDYCDTQVCETEHDQTIWITEKSIENECIFNYPIKKHIFHTADFGKMIIDYELNQWTSVEDGCLINYCGREGIRLSNGMFFVGKFYKNLNNLQTCSAGTKVSYKPLTSKLEEIENEIILDQERLLCLDSIRQMTATKKLSFYSLSFLEPKSSSRHKVFRIHNKTLEYTETEWHPIMSFNFDEPNKIGIDKNGKSVYWNEWVPSGISGLLSGFNGVYKKENETKVTIARLETIKEDYDREMMIDHELVEVEHPKIVHLKRENITGSRVEIVNKEHSDVSGWLSSVLSSFWGKIMMTIISIILIVIIGLVLINCCPIICKSCIKRYKTKEESRNRHRLDREDNGRLRRQHRVIFNNQSNDEENAIEMVEYTDTPRPLRPIPDATTSDTESRSPTTAHSFFNR

SEQ ID NO: 15830 - protein, 592 aa, unidentified; identical to SEQ ID NO: 15180

SEQ ID NO: 15831 - protein, 537 aa, unidentified
MKSVFFFFVILFNTMDADLSIPLGNTNNLPGLTTPLEPIVEGRSRTSRKEKDFGEMTVLPLRRLEPWRECAIADLQCPPRYDFGEKIGSLITTEKLWPVRGLSVLQEGYFCTKTSRDRTCSTSFFGSEDLSGSEEYLYPNDSDCLKEVKSLESGRYSPPVWPEHTCAWMATRTVTLVQYQLNLHNVLWEDIGGTYHDAKLKGGKCSTRICSTNNPGVLWIRGKKANHLLRPEDRLPCKIYENKTSSILQVHCDYHHPLHFKVGACKFSYRGESGIRSEEGVGLAWDLKKGSKIARYVGPECDKKKTPIYQWSANSKFRYDAATKADDDLHARCLDALVRIREHKDISQWDLGYFYPSSPGPFPAYRLNKSSKVLECSKYLFTLKEVKSGRSLVDYLPEESIIPDPRTGEKLGVSGLIVKNDSSVYVPHQRSNQMISWEHHLGPKDKVEISRMSLTPNVDDNTLLFSEDPQNHATENGTSQATFLSHLGFGIEHLFYTLLGLSIAGLVGVCVVKVCLENAFKCGCKYCSRSDLDDYSH

SEQ ID NO: 15832 - protein, 542 aa, unidentified
MVQLVLQSFWTALILNLSIPPSSGDIQDNTIEWRHPVFSVPDKGVEVNLMIHGPIKYPWKTCSRESFVCPPTVHDGIEEGLIKEILDLEVPDNLDKAVIDGYLCHKIRRRTICETSFFGHQTITYHRYRLVITKDNCREVMREYEEGSYEPSGQPDPECAWMSTDVSDVDIMEITPHPVFFNPFDSSMEDAVIKGFCKGEFCQTHREGTLWIRKSSSKPALDYKKVSCNFFRGEEITDHLKWLIKCPRFPYFKVNKRTCRTILDGKSALGNPDGLIIITDLGKKGPLPTCSKKVKFGLLKSSGQIQSGLEEIKDDFLYERCIDSLSRIVHQSSVNFRDLGFFYPRSPGLHPLYMLKDKKIWCNRALFEEKKVTLDDKSLEKTFVHYSWMRWKNTSLYQSANGVTWNKETNSSDSGTKYHIPHLMEMSASLAITHTRGHSVAYPRTFHIRQNMDDPLTDVDTHVQKRHPLGENFAKWWDNLGEVVKGVISTITTLIVILVSLFIVWVLVFCLKKIGGGCRENVNELSKPNNEFGMDSWGSQLP

SEQ ID NO: 15833 - protein, 532 aa, unidentified
MLTRTARTTSTSLFIKLSILCVLTDHITSGDKNGTTDEKKSHFVYPSRIVGSLLPCLPEDLVCPPTVKDYATVGLTPTKKKLLMPAGGKTEHVGGVLCHLVKKRTTCWTSLWGSNDISQQEYRTPVVLDRCRLAVNNYLRGEHENVEFPESECSWMSTIDMDITGAIITPHETFFDPYKTSVYDKHLIRSCRNRVCETVRRDLVWFALEEFPLPSDLFQKQDCIIYSSDPDNEATLIKCEGYPYLTISNQSCQINYGGRTGVATPHHFAIFGNIPGHDSLPPCSDNVIIGVTGPMEKSIERRGEYADMNLRERCLDAIDRITNENTVTLRTLGHFMPRSPGRHPVYILINSTLMCGSAKYKEYTGSLDNDNLWTLLKNSLWVHWADDNHLSYNGVLRYGKESQPEIHIPHLNDIRDSLVALHTEELELIPTNRVVFIPDKEVPLNASIPTQRKTTKIGGDLGTSFNAIGSWFQTNMSLLITLGTGMALLGLGYVLLMIVLKCIKGLKKPPKSDSINLNLQPFQPSGKDRAEH

SEQ ID NO: 15834 - protein, 530 aa, unidentified
MYIHILLMILVSGVFGTVIFVPTGKLNWTPDSIHNLTCPSYIKIYEGHPKQMRYAVYTAPADKEMYRDGFICATTTWSVTCDFRWYGSKYISHEVVVKRTTPDQCKFAIKEYQEGLPELPTMPAESCGWNNVLTESKDYVTVTPHSVRLDPYGMVYVDSEFKDGRCSEQVCQTPNHRGIWLPKTDKGDQCSQVSASMVTLSPNRPDGKWTSSTILVSGTKELQLSKACKLSFCGKDGFRFANGEWFSFLGGLEKGIEEIVKTLDRCPMDTIIHTHNSHSDLSRIEAIAYENALQVNCYQELRRASETKKVSNFLLSFFTPLHEGLGIAHRINKGQLETASAYYTRVKLADHPTLDNLGMNSKGQTVSYKDLVPVTTEKGSGMSLFNGNTVKDGKINWVLSTIQQSIIKDLEEDTFGAEFIQHPHAKHLPSYLNETIIKEKGQGTPGDVITSIKHWAGGLWQSISASLFIGLLLILIGLVIFKVLIKYLFKCPRSSEKIRTPHIEEMGLMRTEAETLNSRTTPALSWFEIV

SEQ ID NO: 15835 - protein, 521 aa, unidentified
MAGTLIAILLCVTGVYSTIEFVPSGHLNWTPENVKNLTCPSFLADESVRQYGKSIGVKTAPRSKDIPHDGYICVTSQWSVTCDFRWYGSKYISNDVIRVPTTESMCRESIQKVMKGIPVVPFMPTENCGWNNVLVEEKQFTTATKHTVKKDPFGMMYIDSEFSDGKCGKEVCDAPNHMGIWIANKDNNDACSDLEVSAIDAYPSTRTRDWDADSFILTLSQKPLRIADSCKLRLCGLNGYRFKNGEWYSLTTQIDSGMQKQLDKVPNCPSDIQVHVHDSHSEAARIESLGMELALQVLCIQELRRSQDTGKVSNFLLSFLAPIHSGYGRVHRINKGKLETALGFYNKVTLARKPKLSKIGSSGSKNIAYEDTVVMKEGSKTMSLFNGNTYEDGEIKWIKNSIRTNVITDLDKEDFIASYIDHPHADHLPSKFNYTMIHKTGYGESENVFSSIQHWAGGLWQSITSTLLMLVAIAFFIILFLWIIRTCCLTRHKTPTIVMRDHDTVPLTSGRDVNLFSGMSV

SEQ ID NO: 15836 - protein, 820 aa, unidentified
MDLVRFSIALSVFLCYGTPPSQGQAIVSIKDSCEAKSAPWIPCEKFDYVKNATGSGIKCWIFCSRSGFYSKTGRFIRCIQGDPEAKYIKSCRRQIEKRGKEKMREGTRGKRKTSEPKEEGVRAKTDFTPDESRRLNNLTKVFRKVEDKDLNDFKKFILEKGLETKIKLANDGKISFRDPDCGENKDYPCHRIHQIIEGVNENIDYINEILSLKKMKEELRLRERESEEGEFPGLLNTTNRRGFLLHYPVELGNWSRLEDPSQIKCPSHHKDMLSNPRRLGKYNLDIIVRRPRIGTFETVVPGYICQGMQWTSTCNEMWYFVTYHDRAVHYITPNKLKCLQNIRAHKRGEHIKPYYPLEECNWNSETTKTVDYFMITPYSPEVDPFTLEFKSEIFPDRTSCRPGDEICVTDDDSKVWFPDEDDKLIARGHCPDETWDESHLTIHPEEMPENWEDPQSPWVSDYILKGVLFGEKRVKKSCLLEFCGTSGLLFEDGEWWELNVFSREKGRESLTKIFIEQEEIRRCNGTETRVGVAGKETDEKALLNAVLSKNAYERCKSARYRLIENKYLRLDDLSYINPRESVTWWAYRVRAGDDERTFKLEKTTGEYRYLQVPPSLEQHVTDCDGQENCSVSIGYYRGELINSSDWTRTGHDDVYVGVNGLLRKDTGNKTIVLYPPLMKEYQEIFSDSGESDDEAFIYKPDIHEKKGKPKEAEDEKDEKSKKNKTPIDDIKDWWSNIKGEWHLIKGILIGLFTFALLIGVVKLGVFIKSSFRKRRDDSIPEGKDEEIGIKMQSRRSRQNIYEEINEVSPTMTRRGRNIFN

SEQ ID NO: 15837 - protein, 818 aa, unidentified
MKKTMETIKNFILILSVAVQLDTGHGMEFALIRNTCDTRSMKQVPCQHLISVRESTGPKGKCLIFCAKEKRRWAEGVESQCLQGDPTSPQVVKCKERIEKGLERLTVLTSSKRKRMREPFRARGNQTKEEGGRLIRISDVLKRIDHKDLEQFKKDVLEKNVETFLYVNSSNLIDMHKNYSCSPPDGFECYSIKRAIDDSNEKVLYVQKAQKEKDKSTWSKDLLSDAYRREEGTIETATERGFLIHYPIESRDWSNLTDPSQIKCPSHQGDRLRKSGTLRNVDLEIIVRRPRPGNFKTAVPGYICQGMQWTSTCNEMWYFVTYHDRAVKTITPNEVKCLQNIQSHKRGEDVRPYYPLEECNWNAETTKTVDYHMITPYSPLVDPFTLEFKSEIFLESSSCSPGDKFCLTDDTSRIWFPDQDDPLIALGHCQDTTWDESFLTVHPEEIPRNWSDPNSTWTNDLILKGILFGEKRVSKSCILEFCGELGLLFEDGEWWEINVFSKEQHRSRLTKQFLEEEKLERCTGTESRIGVVGKETDEKALLDAALRRSGYEKCKAARYRLIENRNLRLDDLSYINPRDSVNWWSYRVRAEDSDRLFRLEKAISLYRLVQVTPKLLKGGQVCEDKRNCSLIIGYHKGKEIKSSDWEETGHDGVYIGVNGLIRRDTRNVSYIYYPPLIKEYEEMFSDSGEIEDEAFIFQPEIHSKKTKPKSDDQDSSTDSKKNKTPIDDLEDWWKKLKSEWGAIKGTLIGVTLIVGLILLLKLILAVKRLISRKRGKKSEAGKEEKEKEMVRFRATPNIYEEIDERSPTRPRGRRTIFT

SEQ ID NO: 15838 - protein, 784 aa, unidentified; identical to SEQ ID NO: 15272

SEQ ID NO: 15839 - protein, 758 aa, unidentified
MKKTMELIKVIPVACLLYIFLSRHILVGQCKDKIQTGKNTSPPKSRNFKGSPPDSDSVLAKTNLTQEESKRLSNISQVLEKIEDRDLAEFKRIILDKNLEKSLSEDKDGKIHLNAPKCGENDSYRCHRVNKILENVNDNIDHLNDLLRKSSGSNLREKLRELDDSSEGGGKGSKSDGHGSFLLHYPITVGNWSELEDPTLIKCPSHHRNQIGHSGSDRRLDLDIIARRPRTSTFQTSVPGYICHGMRWTSSCNEMWYFVTYHDRAVTSITPNKLKCIQNIQAWKRGEHVKPYYPLEECNWNAETTKTVDYHMIIPYSLRVDPLSLQFEGEIFLDSQSCKPGDSLCFTDDNSKIWFPDDDDKLVATGHCPDESWDESSLTIHPEKMPNDWSNENTSWSQDYILKGILFGEKRVRRSCLLEFCGAMGLLFEDGEWWEISVYSADSKRESLTKLFLKEEGINRCNGTEERIGVAGKETDEKALLDAVLRKTGYEKCKAARYRLTENKHLRLDDLSYINPRDSVMWPAYRVRRQSEGSEKYFSLETAMSEYGMVQVTRSLQMLGQKCYGVENCSMIVGYNLGKEIRSDDWTPSGHPGVYVGINGLIRKDDENTSRIYYPPLSKEYESVFSDSGEMEDEAYIYKPEIKHKGNVNPKKDDEDSSEEEKKNKTPLDDLSDWWKKLKGEWKLIKGIIVSFLVFLGLYLIIKCCLKLRSVIKEKKIKKVVDEEKSLELKERRAEPNIYEEINETSRPRVRRGRNYFN

SEQ ID NO: 15840 - protein, 660 aa, unidentified
MATFKVLVLMILWITSIFNVRCEKFVTIPVNCSGEVDIDKMDVMCPNRYNLLSTNHLMEGEEVETFCRPSLRENDLLDGYLCRKQKWEVTCTETWYFVTDVKYQIIEVIPTENECMEERERKLKGEYIPPYYPPTNCVWNAIDTQERTFITLIEHPVIEDPVTMTLMDSKFTKPCNPKHNEVTICDTYNPLIKWISKETSGLNLHCQIKSWECIPVKLHHSHRNMMEALYLESPDFGIVDASKICNLTFCGYNGILLDNGEWWSIYRSGFTHGFLDNHILKNRRIEECKEKKPGYKLAKLDTTYIDLEFEIELEHEKCLGTLEKLQNGEYVTPLDLSYLSPSNPGKHYAYRLEYINTTEHKCVQLGFTYEGGDCRKMLDERDDHGAYYNWTTIKLQRVIRAVCYYHTFSMNLDESKHKYYDQDNRSIQIDEKFISEVLKSTPLIDRHEKYEGNLSWNGIIIESKNGHEKNVIVPSASQYNHVMINKILKRLDTVMYDSYKFDSESGSISYNKIVPIVREDNLQNAHRVDVIQYIKDKGSYIINGFTGWFSSLGKLMRWTIWGVGLFFSIFTLYKIIMILRKHSNDNVRKEFKETAGKVMIGQPIDTKSMSRTSIKANNKGKFDKVKDLFTPRSKTISHLTTDTLKEHTDGTYEELHFFNV

SEQ ID NO: 15841 - protein, 582 aa, unidentified
MFLLTVNLLCVMAYANGADIWINYPEQCKNISLKEGLKELCGGNQLMNIRNKLLDDTYKEIGEICTPNYAMEKRSQGYRCASIKKKVICKMLDNFDHEVTYISESHPIDKSKCHELIQHRDLLNNKEEPYYPPPKCDSSSSSVNELEFITLINYNAMFDPIGFESNDNYLFNFEGSDKKPIDHIYQSEFCQSKNWICHGDKSYIPLEIFKGDNQVSIRLELIKLGIIYDSNFGELPINNACLLNYCGKSAIKLFNGAIIRIKNSPLTSKLTACNKSQIDMPEVNLARKRYSNIGPVLLTTINKRYDICQKIKKNLELERPVPINNLHYLAPFEPGQHPALVYRQVSTTISSSFRSKVVPVNMLSMSMCEYTTGILTNDGIVDDLKSNDTVIKLINNKEIKWSDIKNREHWYEEQRNPDIIDGNETDLLSYWYNGVTRKGNTIIYPTSYILQTLKKVYMDTEKELKVDFFRVEHEYNVTRKDILKHNYTNADRKNDTNLDKEYLDREYKDIKELNATETKKEGEDEEVQIIQNKEYWNEESSIWGISTIITIIGIYYIYRKNKRSKTFLNVKHKITKFFKLDY

SEQ ID NO: 15842 - protein, 586 aa, unidentified
MFLQLFNIVLIYGVRTSQSTWINYPENCTSISLQDGLRELCGGDQLMNIRNQLLDDTYKEIGEICTPNYSMEKKSEGYRCASIKKKVICKMLENFDHEVTYISESHPIDKAKCHELIINKDLLNNIEEPYYPPPKCDSSKSSVSELEFIKLINYDVILDPVGFQNEDNYLFQFDKTNPIPIDYIYQSEFCQSKNWICHGDKSYIPLEIFKGDNQASIRLELIKLSIIYDSNFGELPIRDACRLHYCGKPAIKLFNGAIIKIKESPIVLGLPSCNRSRIEMPETNLAKKRYSNVGPVLLTTLNKRFELCKKIKKNLELKQPIPINNLHYLAPFEPGKHPALVYRLVSTTINQSLRNKVVPVSMLSMSMCEYITGQIIEDGIKRNLTDEDTVIILANNKEIKWKDLKGRENWYQEQANPNIIDKNPDHLSYYWYNGVMRREDKFTYPSRYILQTLKKIYTDTERESRISFFKFRLERNITKTEVIKFRDIEESSDQDHSQSVNKTLEGDDYWNWVEETTSDKNKTDGSRGDEKQTIQNKEYWNEESSIWGISTIITVLGIYYIYRKNRREKIFLNMKHRVQRFFKLDY

SEQ ID NO: 15843 - protein, 649 aa, unidentified
MISKILCWMALGQCLRVTRAETESRVFNVPVNCMEERPIKPTEIVCPKRYNELSLEAHHTLIEGEEKIEQICRPALRDDDHVDGYICREQHWETECEETWYFATVINYHIRETIPSPGDCISAVKQFKDGVLIPPYYPPAGCFWNTKIKETIKFMVLTRHKSILNPMDNLVHDSQFINPCDLKKTQKTGCKLKDVTGLWIPEIEIGLSSEHCSRKHWECIGIKSYKSELDEKIRIWEAPEIGIINITKSCKQSFCGFKGVVFDDGEWWGYANTTEDELIKAHVSDCKDRKPGIRVHNDHTDYETYDIRAEMENERCQNTISKILNSEPINTVDMSYLSPTRPGRDYAYRFKQVNWTETFCLRWVQTGLSKDCNKFWKYSDRGGKVTKDHVGIGEYTRALCEFRPIIDKDGDGYISKEELGKHNMSTSFSLMRLDKKGGNQGADSIEVGFNGIVRIPKSEKDGEKYMVRMTSVYDGLEQRNRLIKFEVLEFEDVVAKYQGEGNYDVNDKVVELIPDNQKNISRTDFVRTIANGGKEIISGIVGWFTGTAKIIRWTIWAIGALVTTYAIYKLHKLVRGKNKQESQNYQGEQGGQTESKPKWFKRGRREETPKKSIRLENPLYEEIDIDDNYSLRHKDSGRLKLKKDGFFDV

SEQ ID NO: 15844 - protein, 640 aa, unidentified
  VARIANT 633: note = Any amino acid
MNLIQFTCVIAVIESINTYRLANLPFDCQKEHEIPVEAIDCPLRRNELKVDHLQKGREFKICKPKLSEDDHVKGKLCRIQKWRTKCTETWYFTTFIEYSVVDIQPNKLDCAKEWERQKAGFPVVPFFPPAVCYWNAINEIAETYVTLVDHPVLEDPYNSEVIDPVFYGTRCSPINKFDTHWFCKSTNNLILWMSDKDSLRSQHCDIRTWDCITVNSYVSWEEDHLNHKILRNSTIWEAPDIGRIGLYDACKIDFCGVEGLRLNNGEWWFLEREGNFYGYDYHTMPKCDNNVKIGVKTHVDRTLFEEIDIKLELEHSKCIDTIIKMRSGIDISPDWMVLNIPSDPGKNYAYRFEQESKVLYYCYNAKLRELQEISESQSACNDSKRQIKIFRKRDIAKIGKYKRAVCDYKTVYIPEIDSNDVGYNISSWLFAIDNTTIETKINEYKWSNLTGDQNNQYQLSWNGILKMSSGRYLINTFSLLDGLVHESQLSKLEVRSFEHPKMDKDSLYFHFLNDTGETVEIDLNDDNKLDRTDIIKSATQKIKDFYHGITGWFSGLTVMIRWILWIIGAIVTIYIIVKLKRKVSKKKPDKTPDTTVSRFFRKLDKIKSVPAHVVKSKKKTNSSSGNKSTDDTXEMINFYN

SEQ ID NO: 15845 - protein, 655 aa, unidentified
MSSEIKMLIELMLFSILSCVISQRVYNFPFNCTEPERIKDYQIKCPIRQNEVSLEAHHVEVDEKIEKICRPQIKDDDHIEGYICREQHWTTKCTETWYFSTEIEYTIKETVPNQADCQKELEKLKRGISIPPYYPPAGCFWNMAQSEKITFVVLVPHKVLQNPYDMKLYDPGFIEKCDVKKAKTKGCKMKDITGLWVTNNDGKNTSEHCNKDHWECIGIKSFRSELNLHDRLWESPELGIMKLNKACKKNFCGYKGVILEDGEWWGYTNVADSEIEYVHLNNCDDSRLPGFRIHQDRTEFEEFDIKAEMENERCMNTLSKILNKENLNFVDMSYLSPSRPGRDYAYLFEQVSWDETFCLTWPDSRKSKNCKVDWKVHKNAGLVTKKHGAIGTYYRSMCMYYPIEDTNKDGILQKDELKDKGIPGKNRYRTLKRSKNDYGEDSEFNITYNGMVVVNESFHMAVKSIYDGTEDYNSLLKFEVSEFDKIDLNEAYKEEENKWNDIDLTPVSSVNRSRSDIIKEVEKGGRKIISAVTGWFTGLAKTVRWTIWGIGSIVTIYAIWKLKKMITKKNKEDKNLVNHNELNEAFEMSKDVERGRVETWIRKNKGKEEGIYEQVSDIEDNVSKYERGVHASKGGDKMNVYSPHGKNGKKGFFNH

SEQ ID NO: 15846 - protein, 640 aa, unidentified
MKSLTRTTLILILFGQSISYRIANLPFDCENEHEIPVEAIECPTRKKELKVDHLKEGREHRICKPKLSTDDHVKGKLCRIQKWKTKCTETWYFTTYIEYEVVDVMPNKIECAKEWERAKAGFPIIPFFPPAVCYWNAENVISETFVTLVDHPVLQDPYNSEVIDPIFYGTRCSPINNFDSHWFCKSVNNLIMWMSDKDQFKSPHCDIHTWDCIVVKTYVSWDEDHDTHKYLRNTTVWESPDIGRVGLYDACKKEFCGVEGIRLNNGEWWFLEREENYYGFDYKDLRKCKEGETIGVRTHVDRTLFEEIDIKLELEHSKCIDVLIKLRSGIAISPFELGYLAPSSYGKGYAYRFEQETKIIYQCYPRIDRVPQIKIVTDNAQNCSDGKMRYMRTFNQTRVGKYKRAVCMYKNVFIPEAQQDKEAGYDIGKWQFAGSNDSIEGNISKNGWSNFRSQSGSEYQIGWNGMIKLTSGRYLINTYALLDGLLHEAQLSALEVKPFDHPVYHHMDDFIKWLNGSSINEERDLLDDSRLERTDIIKSAGEKIKGVYHNIVGWFSGVTSVIRWVLWGIGAIVTLYVIIKIRRVMKKKNNENEGKNEVKQFFEKLSKIKTHKSDNVLPTNKAGIGKDKKDDEYEMINFYS

SEQ ID NO: 15847 - protein, 639 aa, unidentified
MKSLYYSLFLLFNAKNIITYRIANLPFNCENEHSIPVEAIDCPVRRNELKVENLKQGGEHRVCKPKLSTDDHVQGKLCRIQQWKTKCTETWYFTTYIEYEVVDVMPNKIECAKEWERTKAGFPIIPFFPPAVCYWNAENVISETFVTLVDHPVLQDPYNSEVIDPIFYGTRCSPINSFDSHWFCKSVNNLIMWMSDKDQLRSPHCDIKTWDCIVVKAYVAWDEDHNTHNYLRNTKVWESPDIGRVGLYDACKKRFCGVDGIRLNNGEWWFLEREENYYGFDYRGMRNCRAEETIGVRTHVDRTLFEEIDIKLEIEHSKCIDVLIKLRSGITISPFELGYLAPSSYGKGYAYRFEQETKNIYQCFPKIEKVPQIKYITDDLKNCKDNKTRYARTITQTKIGNYKRALCNYKNVFIPETKQDQQAGYDIKMWTFAGTNDSIKEHIENNSWSPFKSQSGNNYTIGWNGMIKLNTGRYLINTYALLDGLIHEAQLSALEVKSFQHPVYQNFDDFAKWLNGSSIYEERELLDDSHLERTDVIKSAGEKIKGIYHNIVGWFSGVTSIVRWILWGVGAIVTVYVILKIRRVIKNKHDEKDNKSEIKQFFERLGKIKTHKGDNNSVPNIKGKRDKKEDEYEMINFYS

SEQ ID NO: 15848 - protein, 674 aa, unidentified
MTNLLKKTTANKMALFLVTIAITHMVLINSAICEKYVTIPINCNGEVEINKMDVMCPNRYNVLSTNHLFKGEEVETFCRPSLRENDLLDGYLCRKQKWEVTCTETWYFVTDVQYQIIEEVPTVTECLEEKERKLQGEYIPPYYPPTNCIWNAVDKQYRTFIILIEHPVIEDPISMKLMDSKFNKPCDPVHGKVTTCDTYNPLVKWVSKETNGYSLHCQIKSWECIPVKLHHSYEDVLDKLYLESPDFGVVDASKICNMSFCGHEGILLENGEWWSIYRSGFTNGYLQNHKSINNRIESCSNRKPGYKLTKLDTTYIDLEFEIELEHEKCLGTLEKLQNGEYVTPLDLSYLSPSNPGTNYAYRFEYKNKTVDKCVQLEYTYEAGDCKIMFDGREGHGAYYNWTTIKLDKIKRAVCEYHTFSFDLKNKKHTYNDRDDPKIQINKTFVETVLKSTPLIGRNEEHEGNMSWNGIIIEQAKDSEEINVIVPSTSQYNHIVIKKLLRKLDMVDYYGYKFDSLSGSVSYNEIKPVLRSENIQNAERVDVIKYIKEKGSYIINGFTGWFSSLGKMVRWTIWGIGLIFSLFTLYKIITLLRKHSNLNKKEKESQAKSTIITNSNPSETNDFKESIVISDQPKGVARKLFDYFSKKSGKRQNINRQAASDSTGRTYEEIHFFNV

SEQ ID NO: 15849 - protein, 649 aa, unidentified
MISKIQSCIIFGLCSRVFSADIGSKVFNVPVNCVGEKPIKPTEITCPKRYNELSLEAHHTLIEGDEKVEQICRPALRDDDHVEGYVCREQHWETECEETWYFATVINYHIREKPPSLSDCITAVKQYKDGILIPPYYPPAGCFWNTKIKETIKFMVLIKHRSILNPIDNLVHDTQFINPCDLKGAQKDGCKLKDITGLWIPELENGLSSEHCSKKHWECIGIKSYKSEVDEKTRIWEAPEIGIINITKSCKQSFCGYRGVVFDDGEWWGYANETEAELIDAHIPTCSGKKPGIRVHNDHTDYETYDIRAEMENERCQNTISKILNSEPINTIDMSYLSPTRPGRDFAYRFKQVNWTETFCLRWAESGLIKDCRKHWKLSDRGGKVTKEHVGIGGYTRALCEFRPIVDQDGDGYISKTELGRHNMSAEFSSMKLGTRSSNQPVDSLDVGFNGIVKVTDDRTREEKYMVRTTSVYDGLEQRNRLMKFEVLEFEDVVSKYQGEGHYDVKGKSIDLTPDEQKSINRTDFVKTIANGGKEIVSGIVGWFTGTAKLVRWTIWAVGALVTTYAIYKLHKLVRGKPRSEEDRSQAEDRAEENKRSSWFNSGKKNDLRKNPLKHDNPLYEEIDLEDTYSMRKKEGWKTDRTRDNFFDV

SEQ ID NO: 15850 - protein, 609 aa, unidentified
MMYLFLLILSYTTLSDCLMKSRLVNLPTNCRDETPIDKEHVECPFRRNELRVDHLQRRELTKLCRPKSQEDDHIEGYVCKVQTWRTTCLETWYFTTYVKYDVVEETPTPSDCFKELERIRHGVPAVPYFAPSVCYWNAENTIRVTFTTLTPHNVIEDPYNLKLLDPSFPGGICNGTRSGFCYMKNERSLWIPSSSSHSRHCQWKGWECVTAHILNSWDESRVNQDVLVDSTVIEAPEIGRIGIYDACQMTFCNVTGIKLATGEWWVPHDYDDKFRKSFDRLRHCSSDEKIGVRNHVDKTLFEELDIKAELEHQRCIDALMKLRNGESLNALEMSYFAPTTPGLGYAYRFVQQKKVYSYCIGYADSYDYRICKKYYTQKKGRAYGGYYNFTKTILGTIVRGLCDYKTVQIPMQIAGIRESRMSRSSLWRLPLTNETMEIHLKNYSWSLLENEQTNSIYNLSWNGFIQKGEDYIINAFSLYDGLLRDIQVAKLEVMSVEHPHVIEDHELVDPIIKHISDNSKLDRTDVVDEIEKKGKGILLTIKGWFSGLSQIVRWGLWIIGGLITVYSMYKINKLIKEKGKKRSEDNFHSGLEALTNQNMSGPYDRPFFS

SEQ ID NO: 15851 - protein, 649 aa, unidentified
MISKVQFHIILSLCSGIFNAEIGSKVFNVPVNCVGEKPIKPTEITCPKRYNELSLEAHHTLIEGDEKEEQICRPALRDDDHVEGYVCREQHWETECEETWYFATVINYHIVEKPPSLNDCIMAVKKYKDGILIPPYYPPAGCFWNTKIKETIKFMVLIKHKSILNPIDNLVHDTQFVNPCGLEEAKKDGCKLKDITGLWIPEMENGLSSEHCSRKHWECIGIKSYKSELDETTRIWEAPEIGIINVTKACRQSFCGYKGVVFDDGEWWGYANVTEPELMEAHIPACTKIKPGIRVHNDHTDYETYDIRAEMENERCQNTISKILNSEPINTIDMSYLSPTRPGRDFAYRFKQVNWTETFCLRWPTNDMNKDCNRHWKLTERGGKVTKDHVGIGGYTRALCEFRPIVDKDGDGYISEKELGRHNMSKEFSSMRLGTKSSNQPVESMDVGFNGIVRMTDQSTRETKYMVRTTSVYDGLEQRNRLIKFEVLEFEDVVSKYQGEGNYDVKDTSVEITPDGQRVINRTDFVKTIAKGGKEIVSGIVGWFTGTAKMVRWTIWAVGALVTTYAIYKLHKMVKNKQKPDDGKDQTEYPGVGDSTASWFKSNKKHDGKKKPIKHDNPLYEEIDLDDTYSMRKKEGWKVDKNRENFFDV

SEQ ID NO: 15852 - protein, 655 aa, unidentified
MSSEIKMSVGLMFFSLLSCVVGQRVYNFPFNCTEPERIKDYQIKCPIRQNELSLEAHHVEVDEKIEKICRPPIKDDDHIEGYICREQHWTTKCTETWYFSTEIEYTIKETIPNQADCQKELEKLKRGISIPPYYPPAGCFWNMAQSEKITFVVLVPHKVLQNPYDMKLYDPGFLEKCDVEKAKTKGCKMKDITGLWVTNNDGKNTSEHCNKDHWECIGIKSFRSELNLHDRLWESPELGIMKLNKACKKNFCGYKGVILEDGEWWSYTNLADSEIEYVHLNNCDESRLPGFRIHQDRTEFEEFDIKAEMENERCMNTLSKILNRENLNFVDMSYLSPSRPGRDYAYLFEQVSWDETFCLTWPESKKSKNCKIDWKANRNAGLVTKKHGAIGTYYRSMCMYYQVEDTNKDGILQKEELRDKGIPGKNRYRTLKRSKNDYGEDSEFNITYNGMLVVNESFHMAVKSIYDGTEDYNSLLKFEVSEFDKIDLNEAYKEEEKKWNDIDLTPVSSVNRSRSDIIKEVEKGGRKIISAVTGWFTGLAKTVRWTIWGIGSIVTIYAIWKLKKMITKKNKEDKNLVDHNELNEAFEMSKDVERGRVETWIKKNKSKDEGIYEQVTDIEDSVSKYERGVQASKGRDKMNVYSPHGKTEKRGFFNH

SEQ ID NO: 15853 - protein, 607 aa, unidentified
MIFIVIAILCISPILAGRIVNIPVDCKGEREISKLEVRCPIRRNELSVRNLREYEHRETICRASLRDSDSVEGYLCVKQRWITKCEETWYFTTYTSYRIEERSATYAECLQALNTKNKGKSILPFYVPSTCYWNMINEQYEDFIILTDHPIYENPHDGKFYDSLFLSPCQITNERLCATKHDSILWIPKNISNPHSEHCNIRRWECLAVKVFEDFDFETGKKELVIEAPELGRWSLGSGCKMSFCYHKGVRFPDGEWWAYHEGSSIGLQELRNCEPNELAGYRSHLSLEMFDELDIQAQMEHERCLRTLEKIQDEEPISILDMSHLSPSSPGKDYAYRFEYETKVHHKCLDYNMSYSKPNCNRLFTDDEGTGGGYYNWTASHLKTIKRAHCQYVSGIENETGIWLETYHGGKPRFQEINLTEFKREKIVSRDEDRNIGYVSWNGITTNCSISEHDNCKIIVPTLSVQNQMIDEVQVAKFEIVSYKGYVMEQKLMQDELSRIILDSPIIDEEKIKRVDFIDKLKEGGSYIISGVMGWFTGIGKVVKWAIWIIGGIVSAWAIWKLRKLIVKTNSKNQDSVKRPNQVKRLREEQEVRDRNIYEDIDMFDV

SEQ ID NO: 15854 - protein, 669 aa, unidentified
MSKMERQRFMLLILSITILNINAEDNDGYVYDKGFKIALLPLNCSKVTQISHNDVICPPRRNELDTSQLRTTDKVIVGCRPKNKADDHIPGKICRVTTWRTTCTETWYFTTTIDYSIVEDTPGDVQCITEYERLKTGLPDVPYYPPSICYWNAQNTVSVQFVTISDHPTLQDPYNKDVIDPIFDENRCRPRVEYNEYVFCDTRRDKIKWFTHKTQFTSDHCQSENWDCQAIKQSSGVDIDHNNYNKIHETEIWESPDIGRIGVYDSCYMKFCDKLGIRLVTGEWYYIKNQNNQSIHHIAHKECPPNSTIGVRNHIDRTLFEELDVKLEFEHSQCIQTLIKLRNKENISPLELGYLSPSNEGTFYAYLVEYKKIPKIICSTGIQNATNGPKCKDSRYRYEEMGYVFDQPQLSIKRAKCEYRSIVINGGSSMDGGYALEKDHRISYAKNRQKFNILDFYDENKTEHYYKYGTKDHQYNLTWNGILVSNRITNYGRNHTIYKKFYLTSFSALDSLIPTVQSAKLEVSTINIDRVKRLYIDEQNQVWHLEDHDVLKRVDVVETIEDGVGKVIHTVTGWFSGAGKMIQWFLWGVGLLVVIWILVKIHFYRKRRKPILTDSNPLYKFFNRKQIEPIRDVEQNEVELVEPSKPRSDAKMKQHYSDDGIYEDVNFRY

SEQ ID NO: 15855 - protein, 665 aa, unidentified
MTFHRKSLIFVILWLIIRSDGFNYRGGFKIALLPVNCSNPINIRPEDVICPPRYNELDTNKIKDTDEVLTACRPKNKEDDHIKGKTCRVTTWRTTCTETWYFTTQIDYTIVEEEPGNVECILEYERLKKGNPAVPYYPPSVCYWNAVNTVKVKFVTVLDHPVLEDPYTLEVIDPLFNGQRCSYNDSFDGYRFCDTKSRFISWFAPKSEFRSSHCFIENWDCQTVKRSIGVDIDHHDFSKIHESEVWESPDIGRIGVYDACKMKFCGYWGVRLATGEWFNIRGRTNNVSLNTLVQRECEKNTTIGVRNHIDRTLFEELDVRLEFDHSQCIQTLIKLRNRERISPLELGYLNPSNEGKYFAYLVNYTTQPKIICTNKIEDVKDNQTKCTEGIFQQIGYRFEQPVMSIKRGLCEFKNVVLNSRNSADGGYYLENDTVISYARDKQSFKIKEFYDPEKPIHTEYTSYTHKYNLTWNGILVGRRTRNDTESDVRRKYYLPTFSPLDSLIPTIQSAKLEVTTIDLLRVKKLYIDENNQIWHLEDHQTLERVDVVEKVEEGVSKIFHTVSGWFSGAGKLIQWCLWTVGLLVVCWVLVRIYQVRRTKRQDKNKEFENPFKKFFSESKTKFPNRNQDVRIELEPIEPRKPRGKRTPKRDPYPDDGIYEDVNFKY

SEQ ID NO: 15856 - protein, 609 aa, unidentified
MIKLIIIFLSIGDILGDFNFQGYSKSYNKYDNLKPYTGKWDQPQRHYGRAHEDFGKYRIVLPTLCNDNWQGVHANSLVCPSRRITGAGGLYNVLLGESWHPHVGSGTEVNGYLCQKTTWISKCEETWYFTTYKTTRIEETDITEEECLAAITALDSGQTIEPFFPPFSCSWNMINENPKDFVTVHSHPVVMDIYDNSLIDPLFDGKCKSKVCNTKHGNLKWIEGSDKERNDICEAQHWETSYIYGDADFDEGNNFVSLGPTIDSDLYGPRDLKGACITNICGIDGIRFEHGEWWGFHTISHLLDWTRFLRRCSNNITVGFSHDSWGVSELIEEITYRDHRCIDIVSKLASKERISPFELSYLVQDYPGEGYAYRAFNVRNSRGVNTKDVYLERKVCKYHVAYLDKLVFNKTNHGDEVYIVGTWGNGYQILLNKSEIGTNSTRGLENGTTWRILMSFNGIMRFGDQLVFPQAAFFNHPNVTGLFEKHSFKLVEHPLELLDTGEDDLHTLYKFYNRSNSTSVVPLVTRWFKGIGSSVSSFFTGTKNLIWWIVTLLISGLATLIALKLGLFSWIKKKILAEPNKKTKHNIYEEPLQLGKREMTTIRKNPFFD

SEQ ID NO: 15857 - protein, 618 aa, unidentified
MSYLIVKVVILFLIGIDKQVLSWTHDSGRSFVRQYHDPNWFDQTMVYPIECNSTWKEVNTLNLRCPKSLKIDPKNKLNFDLGTVYHPLPSSRYVVNGYICHKQTWISKCEETWYFSTTETNKIENVPITPEDCREAVTIYKMGEYVNPFFPPFYCSWCSTQIDKKTFVIVEPHIVKEDIYNKTFIDPLFLNGYCDQLPCKTIHPDVLWVPQELQKRKDLCNKGTWETGKVFGVLEEKLYQNGDLKDSRFGIDEQWIRSSIYGLRSLVGSCYRGVCRQFGIRFKTGEWWGLEGRDVTEWIKQIIPRCQEKQYVSFHHDNSDENIAEAQLVARELVCEEFLGRAKGGDLISPFDLNYLLPLNPGLGPSYRAFKRILKRDSHGGSSPQFRLEKRDCIYSVVHNVTEKVNITDNKLAIGQLFDGSYVYINESEFSRPDYLNNSDNASRDGWFLLSLNGMIKYGNSVYLPHGVSTGLSGIQDIVERGTLMLLDHPKSIAISNQMDLAKNIYTSYFQMNTTSIGSKIENMIIRAKNAVSSYFSQLTNIAWWIGTGILGLLGFIVIKRFHLIQLICGKKHRNGKVKKKNNRLNNDDQEAHVYDTISNTPKTPPHGKGTGVKYFDY

SEQ ID NO: 15858 - protein, 601 aa, unidentified
MWSDFIIFLNLLVEIIGLGLRTSHRAYVRTLYNDSDHDNALTIPTKFLDPKWTPVTALDIICPTEKQLMPEFRISTELGTVRHPHTQVEDNVDGFFCHKQEWTSTCTETWYFSSTEETKISNLEISEGECEEAITLYVAGEKIEPFFPPFICSWASTQSNSKIFVVVTPHSARVDIYENVYRDPSFPGGECRTKVCKTVNKDIMWIMRGDEKRADTCDVKKWEEGPLYFSIETRDSDWSSISTFSIDESWVRSPLYGIRKLKGSCRTPICGSPGIRFSSGEWWGLKFSEDMLWIQKLPRCAGSKVSFHHDNHPGRELEEEAVVQKLKCKEVIGRILAKDNVTPVELASFVPKNPGVGLAYRLFMTRKDERIGLREYRLEKRRAMYHLVHNITRKLEIGDSKLKVGHWYDGVPVYWNTTEILGENTTKKDEIFLTFNGLVKFHGDLYLPESSAIGGSKLVEMNRPGVLLLEEQTFDKISVKNQFELLDHVYKFEFKKNNTNLIQKISSALESAGQFIGTYFSKISDIVWWIGGGIIGLLITGICIKCNCYKFLYKRKEKNTEPKGQELKPMTAPSKVSDNVYATIDPPSVERRKGSSVFSHY

SEQ ID NO: 15859 - protein, 619 aa, unidentified
MSYLIVRILIVFLSYKRLQVFCWTHDSGRVFTRRYHDPNWFDQTMVYPIGCNSSWQEVNKLNLKCPRSLKIDPKNKLNFDLGTVYHPLPSSRYVVNGYICHKQNWISKCEETWYFSTTETNKIENVPITEEDCREAVTIYEMGEYVNPFFPPFYCSWYSTQVDQKTFVIVEPHIVKEDIYNRTFLDPLFLNGYCNQVPCKTIHPDVLWVPQEAQKRKGLCNKGSWESGQAFGVLEENTYTENGGTGRTFGLDEQWIRSSIYGIRSLVGSCYRGVCHQFGIRFKTGEWWGLEGKDLVQWIQKIIPRCDYKQYVSFHHDNSDENVAEAQLVARELMCEEFIGRAKGGDPISPIDLNYLLPLNPGIGPAYRAFKRILKRDSHGGTSPEFRLEKRDCIYSTLHNVSDNVNITNGKLQIGQLFDGTYVYINQSEFERPDYLNKSDNVSRDGWFLLSVNGMIKYGQSVYLPHGVSTGLSGIQDIVERGTLMLLDHPKSIAIANQMELAKNIYTSYFQMNTTSIGTQIENMIVKAKNAVSSYFSQLTNIAWWVGTGILGLIGFILIRRFNVLQLLRGKKNKSKKEVTQRNRRLSSVGSGIHIYDTISNTPKTPPHGKGNGVKYFEY

SEQ ID NO: 15860 - protein, 623 aa, unidentified
MSFLIAIIILFINIDKLHCYVVQSNFGGIRESKVNILGNVIPYSTTFKHEVLKKQWDYRHDKGHRTVLPTNCHSSWNTVSPATMKCPRRKIIGKDGLYNTYIGDFWHPHSDKGSEVKGFICQKTRWISTCIETWYFSTTKETQIDEIPTFKEDCLAAITLVDSGEYIEPFFPPHVCSWASTNKNAKDFVTVHEHSVVLDIYENSLLDPIFLSGKCKDRVCHTIHKDVLWVEATDNERDDFCVATAWEFSHVFADIDIDHDKNNPIYSIGETIDSEIYGPRSLEDACIIKVCGIPGIRFSHGEWWGIRSLSNRIPMEDFMYKCHNGTNVGFVHNIWTPSELIGEITYRDHKCLDVLSSFLGRRKINPYELSYLVQDFPGEGPAYRIMKQYTGKDKTKATFTLQTKTCRYHVVYIDKLTFSPINESDEVYELGIWGNGRKVILNSTEVGINPTYVNPSKDWELLETFNGLMRFGSDLVLPQAVYTDHPNITSLLEDYEISLIGHPKEILIQDQDELSEVYKFHARSNSTNVVSLAENFVKGIGKSIGNFFGGTKNLIWWLVTIILSTLGTYIAYKLGLFNFLKKILVQDADDKPSNRMSNIYEEPLKLGERKTHLVKNPFFDNGI

SEQ ID NO: 15861 - protein, 665 aa, unidentified
MILIRWFLWISLSLLLLGINEVDGILWDFRINRLVRNKRKTQKTKLDQIGNGVVIQPIDPKEVHYNIVKPSIQIKNQSHPVIEIDDQKEPELKLEDFDWVSGNEFEGVVNMPVNCLTNWKVINPYAIRCPTFYEHDRYGGGRTVIGTAVHPEEIEHNIIPGFMCQKQTWVTECTEAWYWSTTVKNYVESSPVVEMECLMALAKEKVGTYVDPFFPPAECAWNANSRSSKEFVTLHPHDVRFDFYQYSKVDPLFVGGKCNEKSCPTIHQHVIWIGKNPVPLEGTCNLDRWRQSDIFALETHTSEKKVSDKVTIYLEFIESATYGMRSTKNACWTRFCDVPGIRFNDGEWWGIKSGHNVALDFLPECGKKSLITLHHAVNQDSEFKNRLSLKHYKCTEVLTKLISGSVITPMDISYLISDRPGLQSYYRFSAKQKGNGPVMGGGNNYMIEQKECMYQFVLLESDRFNITKQSDQINVGMTLQGDHIYINLTDFQHTKGNKSNDINRFTMTVNGYLKTGNVLVLPVDEITSESVDNTLYTPIGYHLIEEEEIGNYTTIGDAIEKILILDPRLNRTDIVEETVHFVNNIGKTVSSFFQGTSSLLWWGVTSVFFLVIVLLMRKCGVIDWLLKKKKPKSVERMNKYNSESNRMVDNKTSHGNVNGGFFGNV

SEQ ID NO: 15862 - protein, 611 aa, unidentified
MSYLLVIILITINRLYAFSRDADHWYVRVPHDQSWFDNVITFPIDCKEPWQQITSQNLNCPSFNNISAEAKASFNLGTVFHPLASSRLTVDGYLCHKQSWISQCVETWYFSTTETNTISNLPITKSECEEAITMYEMGEYTNPFFPPFYCSWCSTQTDQKTFVIVEPHSVREDVYNGTFVDPLFVDGYCSADYCRTIHPDVLWVPRGQSMRKDVCNKGLWESGTVFGVLEERDEDLYYSIEEQLIRSSIYGVRRLEGACYRGVCNQFGIRFQSGEWWGLAGRDVVIWIKRILKQCARGQWISLSHDNHDERMAETQELMRTMLCENVKSRILSNDPVSPNDLNYLLPTNPGVGMAYRIFKRILLKGNHGGPTSELYMEQRHCMYRILHNVSRVINQTSGTWTIGQMFNGAPISINESVFERPSYLNNSARESGDGWFLLSYNGLIKYGNVLYTPSAVESSVEGLGFFHDRTSLLLLDSPKSVAVSSQMELVNNIYTSIFHSNTTSVFSKVEGAIRAAKNAVASYFSQLTNVAWWVGTGCIGIVALLIWRKCHCYDLLCKKTSRSADEISSKHIYDTIEMKPRTRVQNKASTPKLPPKRAHGKDLAHNYFQY

SEQ ID NO: 15863 - protein, 612 aa, unidentified
MELIKIHLMLISFFTSSAGLERGSVGSISLISTEKLNLSTSHHDKGIFQNREKPLGHEVVLPVHCTGEWVEKPAMSLACPKRKINGPDGYYDEYFAKMWHPPTHASPEVKGYLCQKTTWNAKCEETWYFSTSKSTTIDETPINEDDCRAALILYKTGELLEPFFPPFSCYWNNININSKTFVTIHEHPTVLDLYKDTKKDPIFLHGECDGEVCETVHSNVLWVEAPLEERDDFCDPALWESSNVYTEKGGPQIPIVLESDVYGPRYTQGMCWMRICGVWGFRFSSGEWWGFRMVNKDFQGLWYTGKIPSCYGDFEVSFAHEAIAMTQLLENLSYKDHKCVDVLSTLRGNKVINAYELSYLVPEHPGFGPAYRILMVKNKRNVTQPVFILQTKNCRYQRAYLTNLSFTITGEETSESVKVGVWGDNQPVYLNWTEIGVNSTYKPNITGNWHQLMTFNGLMRFDKTLLFPQSVFVDAPNVSLLLDGFQLDLIEHPHQYFGRDEKTPSSLYKFYPHGNSTNVGEVIEGWFKSAKNAIGSLFSGMSSLMWWIISTVLSLITLLVCYRCGLLSLVKRMFTKRTRPSKKGRTSRSSHRMEHIYTEPNNPSSSSNPFFA

SEQ ID NO: 15864 - protein, 620 aa, unidentified
MDKIIIFLVMLVKMTHGNIQPIIISSLPVVSGILRFSTRSDIVRQSVDDGFMDNTIIFPTQCGQWGPVRPEDLRCPTPQQSSPEDRLVFEMGAVYHPNPSNNYIVNGHLCLKQRWSSICQETWYFSTTESNKIDDLPITDAECQAAIVAFKSGENLSPFFPPFYCSWASTQTNSKDFIIIEQHNVQESIYNMTFLDPLFLNGVCNQPICKTIHPELIWVMENEKNRWDLCNIRNWEAGTLHSAIETKDDSMSGPYSIDKHWIRSSIYGIRRLQGSCLMGVCNKYGIRFASGEWWGLDNKEILKWAYRNFKVCGKGTRVSFHHDNHDERVLEDQYVARSVMCSEIIGRILVNEHVSPMDLSLLIPSNPGKGRAYKIYKRVLNKGHHGGIEIEYRMEKADCTYHILHNTTRSLTIEGQEITIGEWFNGELMKLNVSTNFSVPQYIKNDTTNQSRDGWFFYSLNGYTKFSDKVYSPDYMLSGPVGVFNYSQKGQLFLDTDPQILRAKDQMDLYKKVYLSEYHTNSTSIGEQITHIISRAKNAITSYFSQFTSVMWWIVTGVLSLIAIILIKRFGVVSKIKKIAFKNNNKSNNKKSSQTKTVHIYETITPKVAHGKEGNYADFM

SEQ ID NO: 15865 - protein, 633 aa, unidentified
MVTKKIMMITMLFKSNVFCLILPLLPVANSLLRTQNWQFVPLKTDPKYIDNTIVFPTKCGDWKQSNKLDLTCPTSEQAAPENRLITEIGNVYHPSPSNGFVVTGHLCLKQKWISKCEETWYFSSTETNHIEDLAITESECKEAVTAHKAGENLSPFFPPFYCSWASTQINSKIFILVDEHKVLENIYNRSLVDPLFVGGNCQGDVCKTIHPETMWIVENDQVRSDICNEKNWELGTLHSAIDTDDDYNKGQYSIDLHWIRSSLYGIRKLDGSCRRRVCGVPGIRFSNGEWWGIKDPKALILSHNLLSECPVGTKVSFHHDNHDENVLEEQYVTRRMMCAEIVGKIMVGETVSPMDLSLLIPTNPGRGKAYKLYKRAIYKNTHGILDVEYALFQSTCYYHLLHNSSKIYNITENEELTIGYWFDRKEYKMNISQNFSVPDVLKKNHNVSRDGWYFYSFNGYTKYSGKLFSPSSVLEGFVGMLDYTQRGKLAVADIPPQNVIKNTVDLFKNVYTSDYRVNSTSIGEQISIFVKNAKNSVVHYFSQLTNVMWWIGTGLISFLIIMLFRRFGLFGKVTNLMRKKGRKNAEHAPRELKKINTQSHKRSNSASTSQNVYETIKDRQTAHGKESGFFDFV

SEQ ID NO: 15866 - protein, 575 aa, unidentified
MLKLKQLLTLVIMICGFGISRLLNNLIHRSPNVSYSHPPKKLSAMSLLLVFIILNLNLNSVSPASHEVLFPTMCESQWKDLSIRDINCEESSILESSDFAYANPIVSKIPRSPNFPKANGYLCSGQIWSIKCEETWYWSTSIVRTIDTQIISSVECLAAIKSYKEGTLIEPFFDEPNCAWNSINALERKHIIVHEHPVNIDPYEDLYLDPLFLGIGCQKSPCDTIHKDLIWITDEPNNLPCTTDMWMTDIYKVSQDKLLVKSEAMGIRSLKGSCIMKLCNHPGIRFSSGEWWGTYYNHPQQADKIPNCNPNEKISLSHRSTITEKLIVESDLSEYSCYQSLSKIYNKELISLLDFYYIVNKSSGEKMAKRLIQHKHDRRYKIQGRLCHYRFITPQSNPNIQKNPNGLLQIGIDHNSFPVKINVSSYFDVNDPTLNWTVVSMDGITYSPAGLKFPYHENILDLLETILDKPDNLALLNRPEKTIPRLEGGTNNLLKSSTHSNSTNLMTSTLNELSSLGSLISGWFDMTWVRTLIGLVIAFIIIIICFRVFKCFIPNFGHKTHTAISEHASRDNLFP

SEQ ID NO: 15867 - protein, 602 aa, unidentified
MFPLSTVLLPMLFSHVQSWTHDVGRDYIHRPHNPDWFDNVISFPTECYTDWTLVRAHEIKCPSLSSINLDDKLSFKLGTVMHPLPNNKYTVDGYICHKQQWISKCEETWYFSTTETNSIENLPIGATECMEAITVYESGEYNNPFFPPFYCSWCSTQIDQKTFIVIEEHTAQENIYNASYIDPMFVGGKCSSNLCKTIHPDVLWVAKREEIRRDACNRKTWETGDVYGLVEEKKFDNDQRDFGIGEQWIRSSIYGVRRLDGSCYSKICGQFGIRFNTGEWWGLDGQGVKIWLRKILKPCQGGLRISFHHDNHDETMAIAHSVAREVTCEEVTGRILNQGFISAFDLAYLNPLNPGRGNVYRVFKRVIKGRHADEQYEYKMEKKYCMYRTLHNVSDVINQTRGKFLLGYFFDGSPFYLNQSDFEGAGKYGNERNTSRDGWFLLTYAGLTKFQQTLYTNEGVSNSQAALRNLHDPGRLALAEETEIPNVRDQMDLANKVYNSWFKMNTTSVGERITTFINNAKSAVSNYFSQLTNVIWWVGTGAIGLIVVILGRRFYRYRKSSKPPALPKRLDSVETQSTHIYEPVRSPQPVARGNQGHPFFSF

SEQ ID NO: 15868 - protein, 611 aa, unidentified
MSYLLVIILIQVPRLFAIFRDTDQWYVRLPHDKTWFDNILTFPIHCKEPWQPITSQNLNCPSFNNISVEAKASFKIGTVHHPLTSSRLTVDGYLCHKQSWVSQCVETWYFSTTETNTISNLPITRDECEEAITTYEMGEYTNPFFPPFYCSWCSTQTDQKTFVIVEPHSVREDVYNGTFVDPLFIGGSCRLDYCNTIHPNVLWVPRGISMRKDVCNQKLWESGTVFGVLEEKEGDMHYGIEEQMIRSSIYGVRRLEGACYRGVCGRFGIRFPSGEWWGLSGNEVVRWVLRILKRCEKGERVSLSHDNHDERMAETQELMRTMMCENVRSRILSNDPISPNDLNYLLPVNPGIGQTYRVFKRILTRGDHGGPQSELYMEQRPCMYRIIHNVSKIINQTSGSWIIGQLFDGTPVQLNNSIFDRPNYLNQSDGRSRDGWYVLSYNGLIKYRTTLYTPSAVENGAEGLGFFKDRTNLLLLDSPRTVAISNQMELVNNIYTSIFHSNTTSVFSKVESAIRAAKNAVASYFSQLTNIAWWVGTGCIGIIALLIWKRCHCYNLLCKKTSQPAGENSSFHVYDTIEMRPRKTVSTKNHPPKPPPKKAHGKSQGHSYFQY

SEQ ID NO: 15869 - protein, 713 aa, unidentified
MKSTILMTCLLLLHCTIHGDIIPNFYNSYKIGQKQRRKLIYSKKEISSPPPPTTPPSNFILDDSEERKDGGMFTTDSVIPVGPVGGVSFHNTKSQDTKVALVTAGTYNISDFNSHHLMNFPVKCVGDWKEVDLSSIRCPRFSNLDMMNEGRREIGLAIHPVVSDGVIAQGLLCQKQKWISECSETWYWTTEETSYVENEPVSGDECLLAYSQFKVGKHIEPAFPPFACYWNSVNKVHQSYITLHDHDVKLDPYTDKFIDPILYGGQCEGSLCPTIHDNVYWIEKDDGEDLTICNLHHWEHSKIYALTGESSEVLKDDESYDYRYKELIYLSFLESGSYGMRSTKNACKTDICGVKGIRFSTGEWWGIVDREKTYLEVAFPDCTPNIDITLHHLHSGSSHIYEHNVFKDYHCKDVISRLMSGAKVSPTDISLLVPDQPGIGHAYKIDIVGARNTQNQNSPVPYSLQFKQRVCLYQLIDTTGQSFNVEGNPEGGRVKVGVSHSGGDVYINISQFEATMTGQREVADSGDEQVLIWTAEGTKTYSINGMYLRTKNNTPTQLIFPSSAMLEGLYDESLLYPVSLDILQRPRVLIVGPQDDYVKKILENDNTLNRTDIIEGTKKAINSFVDKITGVFKGFTQIIWWGITGVCTIILWKLYRKYKAWKRNKTTKRTTPNNAKKSTTIYKNPTFREDVESQSEHLYDSVDMRRPQTYFST

SEQ ID NO: 15870 - protein, 568 aa, unidentified
MFYLIVILLSLVPNSKPEDHQDAPECTHVIHPYDLDDEWTEITQEELNCTQEGFKSIYSGPSETVRLLYPPSSLPIRKHGYYCRKIIFRIQCVGTWYFTSTVTRSVVYKKPTLSECKEGIAMIKVGNPENFHYPAIDCRWAQTTKKEKNFLQLHSHSVNYDIQSGEYNDDLIIASNCTSTYCPTKDTDALWVSDNLYDSNDFCNKKNWISKDVTIPIAGKNKTLILHLAMTEPGQFWRLDRSCITTLCGLNGLLTEAGDFVYSSDYLIQNLTYPQLYSCTNITVNFLTYQLRGRHDPAIETTMSYPIWVDQCLTVKQSLLLKTPVSPMGVNILLNQVPGNGYTYRASISGVIGADSNKYPMRGILSRKSCKYTWACINETEGEILGEMDYEPIGVDIDGTPVYINQSELESPDIENKQFKCTKCGKGRKETKTYKVRSGLKHYVFDQYIAKNDTYWTHSSTLSNTKVKRSVNQTSIIEVLSEEVNTSTDTHVLVHSVHEVPEYHGHPYLEWADRIIVTTFCVSVSLLVIITLIKLQTARWIKDVIHYLRMKEKLYKLKPEVYSVEANP

SEQ ID NO: 15871 - protein, 623 aa, unidentified
MFWIKFLVFIRASLITTKGYILPGGVGGVRSSKVHILGEIVPYTSSIDHGVLGTKWDFRHNDGHRTVLPTHCHRTWKDVLIGNIRCPSRKVIGKEGLYNTYIGDVWHPHTDSGSEIKGFLCQKTRWVSTCTETWYFSTTKETQIDEIPISKDDCLAAITLVDSGEYIEPFFPPHVCSWASTNKNTKDFVTVHNHPVLIDIYKNQLMDPIFISGKCSDKVCKTIHKNVIWIEANDNERSDLCVASAWEFSHVFADIDIDHNEPGIVNDIGDSIDSELYGPRSLKGACIIEICGITGIRFAHGEWWGLKTVSNKISFTHGLYHCPANSSVGFVHNIWTPSEVVGEITYREQKCLDVMSSLLGHQKINPYELSYLIQDYPGEGPAYRIMKQFTGKNRTKSTVRLQMKMCRYHVAYIKNVSFLPTDESHEIYEIGTWGNGNKIILNSSEVGIDPSYNGSDNDWELLLTFNGLMKFGKELVLPQAVFTDHPNVSNILEDYEINLIGHPKEIFQESQDELSQVYKFYERSNSTNIVQLAGNVVKSIGKSIGNFFGGTRNLMWWLVTIVLSTLGTFIAYKLGLFNFIKRMILSDTLKKEEKRLSNIYEEPLKLGERKANLVRNPFFDHGI

SEQ ID NO: 15872 - protein, 630 aa, unidentified
MSNNKMFKPMIIFALILCLIINVSSYIYSGSVGGYRPKKVRTYGEVIPYTEIVEHRNLYQNWNGKHRTGHRTVLPTHCHTEWKDVTHGSIKCPHRKVIGTDGIYNTYIGDVWHPHTDSGSEIKGFLCQKTRWVSTCIETWYFSTTKETKIEEVVINPEDCLASITLMDSGEYIEPFFPPHVCSWAATNENAKEFVTVHSHPVVVDIYKNEMIDPIFLSGKCKEKVCHTIHKNVIWIEANDNERSDICVASAWESSHVFADLDIEPDIRAQKVEYIGESIDSEIYGPRSLKGACLIKICGIWGIRFSHGEWWGLKTLSNKISFADGLYNCGSNTSVGFIHNIWTPSGLIGEITYRDHKCLDVVSSLLGHQKINPYELSYLIQDFPGEGPAYRIMKQMTGLNRTKSSFKMQMKTCRYHTAYITNVTFQPIDSTQEVYKLGIWGSGHRIILNSTEIGINPTYTNSGSDWELLLTFNGLMRFGSELVLPHAVFSDHPNTSDLLEDYEINLIGHPKEIFQSDQDELAQIYKFYRRANSTNVVSLASNFLKDIGKSIGNFFGGTKNLIWWIVTLALSTLGTFIAYKLGLFKCLKRMILETDNESGNKRISNVYEEPLQLGERGHKPVKNPFFDHGI

SEQ ID NO: 15873 - protein, 623 aa, unidentified
MSFLLAIIIFFFRTQDSNGYVVQSGIGGIRESKVNILGQVVPYSTKFKHSVLKSQWDYRHDKGHRTVLPTNCHATWNDITPSNMRCPRRKIIGKDGLYNTYIGDFWHPHTDKGSEVKGFICQKTKWVSTCIETWYFSTTKETQIDEVPITKEDCLAAITLVDSGEYIEPFFPPHVCSWASTNKNSKEFVTVHEHSVVLDIYENKLMDPIFLAGKCFDKVCKTIHRNVLWVEANDNERDDFCVATAWEYSHVFADIDIDHNNNHPIYSIGKTIDSEIYGPRDLADACIIKICGIPGIRFSHGEWWGIKTLSDRIPLEDIIIKCHNGTSVGFVHNIWTPSELVGEITYRDHKCLDVLSSFLGQRKINPYELSYLVQDFPGEGPAYRIMKQYTGNNKTKATFRLQTKTCRYHVAYIDKLTFDPENGTDEVYKLGTWGNGRTVILNSTEVGINPTYINKSFDWEPLETFNGLMRFGAELVLPQAVYTDHPNITNLLEDYEISLIGHPKEIFEPEQDELSQVYKFYERSNSTNVVGLASNFVKTIGRSIGNFFGGTKNLIWWLVTVALSTIGTYIAYKLGLFKFLGRILFQGSESKEDKRVSNIYEEPLKLGGRRSHLVKNPFFDNGI

SEQ ID NO: 15874 - protein, 543 aa, unidentified
MDFWMLICVLAAVAQARHDYSYEGKTKDIIGLIPNDKKLHWKTTKLDAIRCPEMGLVSNKGEQVVERWIIERPRTTGELKNKGKLCHLAKWVTKCEYTWYFSKTVSRTIQNLEAHEADCKQAIQDYNKGILTPDSFPPEACYWASTNEESVTAFTITPHEVTYDPYEDRYLDPLFVHGSCHTDFCETVYESTVWLTDSPGSQSSCKLVGDEPVEILESYRRNKAGDYKFGFWMRGSHIHHMPVSHLCKKEYCGRLGYVNQQGVWFHVTSVKWSYNETISFRHLIDNCPQSSDLVVLDEEFNDDDLVATMEEMMWDINCLNAVENIQKHRRASLHDLYQISQRHPGPGVAYRLKNGHLESAQASFVALYAPEDHVQTRECLGTILDSKHDRCHSWEDWTHIANSTYHAVNGITEVDGKIVFPEFRVLKRRWDLEYSLKHDLKQINHPVIHDITGKVHENIVHKEIKSHSVNAGDLIGNWVTVAESKIGEFFKGFSHSFVTISVFLITVLAIWIIVRCCQMCQRKKPTKINSAKDDIPMVTTSFG

SEQ ID NO: 15875 - protein, 548 aa, unidentified
MKKTTRNNNFINMIKYIIILLSMFRLMGGVTKLSPYRNLLLPINSHSEWKPVNLANLTCPKPKLDWTIDFHQLATEQVYRLRDLSIGEIKGYLCHKAEWITRCEYSWYLSKTVSRRIRELSPSQSECEDGIHYIKEGRETSGSFPPEECYWNSVNDESEVKIILTPHSLTYDPYTDRGLDANLLGGFCKSRYCQTTHSSVMWIQDPESHTEPCTHMIAEKLTVLSSKQGETGKRWVKTTATPAMSLEKACKLRYCGVEGILLASGLWFGLPEESIEGHDNLGVKEVCAASSEVGVLQPDYFDKSLEFKMEDLQREILCLQLLDKIKIQKIVNMFDLQYLRPHSPGFGHVYQVVNGTLMSASAQYAITTYPGEKTISRKCLGQFKDPSLNTLCVNWSSWLPMKDGVYQAFNGIIEKDGVILLPEDQLLEATWSPDMFDYIPLDKIHHPVYINISDIIHDGVDEGLIHDKTENPGDTLSGWVTIAKNKVLIFFETIGESLLIIIMIVILAWILLRLIKLSIMCVKNRGTRNDRYEEDGNYFKNRQLNVFG

SEQ ID NO: 15876 - protein, 534 aa, unidentified
MKFLIVSILYILKISTNASKERKLILPLDHHLDWKPAHFDKLTCPKPELDWSEEYKPINVISVLRPPNHKIGGVSGYLCHKVEWITRCDYKWYLSKTVSRRIKEETPTEAECRDAVILHKNGRETSGSFPPEECYWNSVNDESDIKVSVTAHDIGYDPYLNVGVDSLLVGGYCNNSICLTTHSSVIWIRDQVSKPCEGMRLETMTVYTSLYGYTNDKWVGTPSMKMSSLNDACRLSFCGVQGTLLTNGLWFHHNVREGPGSQIQITRNCPPNSEVGVVQPDFEIKLMDYKLADLQREMFCLQTLDRIRLQQVVTLNDLQYLRPHRAGAGPVFRIRNNTLETTHGTYIEASMVGTTQVNRNCLATYLGEDKKPKCIGWKSWHKMNNHKYQGLNGVLEINGLIKFPEDQLLDAEWEADMFEYFKLDKIHHPFLSNISSIIHDDTDESLIHDKTVNPGDAINNWVEVAENRVSTFFKTTGGEIIKIVYIITLIGIIYLLYKIITMCCKMKRTGKKNRRLTSDLIDLDLKPMNSSVFG

SEQ ID NO: 15877 - protein, 549 aa, unidentified
MGFLIVLCLSVALGHLEDRNHTPAPFYEPSDSEKELRMDGEILFPVTVGEVWKPVPLSTLRCPKRAKRGSQFGKTYKVFNLTRYESFKPGSVSGYLCHKIKWVTKCSETWYFAKEVSRHVEPVLPTEDECKMAMKAEQSGLSESGSYPPEECYWNAVNEEVNTEVHLTVHPTGLDPYTMEWVDEIFLKGRCSHDYCETDHSTVTWIRDAEKTNHVRCGDKVVEHAELSLIDGTSSPSKLSDLAVISHHIPLSSLADSCELTFCGEEGIQLANGIWFQTPNLAGLGVDYLSECPSNTKAGMISQDYKEDEIIYDMEEIRQDVECLNTLESIQATGTITYRGLQYFQPRSVGVHPVYRIRNSTVETNTAKYVLAFIPDTEPNSSCIGVITENRRPRCLAWNEWLDEGNGLYQGFNGLMLDKGKILYPIRYLLDADWNPEMHVLRYVTYSPHPLLHEYARQVIDEGRNEVVKDGSKNIGDAVAETAESLSNRLTTFFQKFTSQLSGIVGILAILMISYGIFKIARRVKKAKRPVMVKPQEIEMETSEGEGFG

SEQ ID NO: 15878 - protein, 548 aa, unidentified
MKKTTRHYLTPSMHANLVHLTLLVASVQCITKLSQYRNLLLPINVHSDWKPVEIHNLTCPKPRLDWTVDFHQLATEQVYRLKDLSLGEVKGYLCHKAQWITRCEYRWYLSQVVSRRVKEETPTQAECEEAIHHFDEGREMSGSFPPEACFWNAINDESETKIILTVHDLTYDPYTDMGLDSNLVGGTCKSRFCKTTHSSVMWIKDPKSQTEPCVHMIAEKLTILSSKQGETGKRWVKTTATPAMSLEKACKLRYCGVEGILLSSGLWFGLPDSSKEHHDNLGIRDNCPTTSEVGVLQPDYFDNSMEFKLEDLQREILCLQLLDKIKLQRLISMFDLQYLRPHNSGFGHVYQVINQTLMSTHAHYAVTTYPGSNSLTRNCLGQYKDSSMNTVCVNWSSWLPMKNGVYQGFNGIIEKDGVILFPEDQLLESSWSPDMFDYIPLNKIHHPFYFNMSEIIHDDIDERLIHDNSTNPGDAISDWVSVANNKVVHFFKQLGESIFIIILIILGANLTYKCVKLCIRWRLGLKSKKTQFLEEGHVMNMARETVFG

SEQ ID NO: 15879 - protein, 563 aa, unidentified
MLITVLLVIIVSSQAQIHYSGTPKPGKGYVKEDSPKLKYNDVELYHQPPLVLPLENDREWRAANLSALFCPSEAPVGPNEHIHIESWIVTRPRQQIKDPVKGYLCHKSRWITKCEYTWYLSKTISRKIEPLPPSKQECEEARRKFEQGSLTHLSFPPAGCYWASTNEESNTDIEISEHPATYDPYKDKLVDPVFVGGECDSKLCDTIHDSTIWIESDRNPRPEQCNMNEEEQLDVVQGIRAVGGTKKNSQHAIWVIGNNYPYLDARGLCKKTYCGKVGALLGNGLWFHVLHVVNGTGGDTVWSTARACSKEEEIGILGEEYEIESLQATMEDIMWDLDCFRTLETIEHHKRVSYFDLFKLARLTPGQGPAYRLIKDHLFMKDVEYVKLRPNKKPTKDCLGLWTDSRHQNQCVKYKDWQKLSNGKEHSMNGIMAFNGLVDLPHDRFHKRNWDKDFILKMDLQTVHHPVLKDFSSKIHDSLQDGLIKNHAANAGDLIGNWVEVASSKFGSFFKEAEKIILSVIIIIIIILIIGMCIKIRKRQNIQYIKQNSDSNPKLEQAELQIF

SEQ ID NO: 15880 - protein, 573 aa, unidentified
MECIMFWTILALSISFGFSYPIEDQMTIPLKPGIHRTLDGDLDYNDDEHYHSPPLVLPVPNNRSWKPVNLSTLKCPESSHLGPDTHRTLEKWLIFRPKSSILTKIEGVLCHKSRWLTRCQYTWYFSKTISRKIEPIPPTFQECQEAIKLKEEGILENLGFPPPNCYWARTNDEENILIEISEHPMTYDPYLDGVIDSILVGGKCSQKECETVHDSTIWIETQRDTRPSQCDMGTEEQLELVSGLKQIDGNKQKYQHSVFVVGTNYPFMDAKGACKLRFCGKSGMLLSNGLWFNIAHTILPKPEANSNFWSALPDCSSDKQVGVLGEEYEIEKLQATMEDIMWDLDCFRTVDSLAHHKKVSMLDLFRLAKLTPGPGPAYKLIEGTLMMKEVQYVKARRDTKEQANPLCAAYITESTSNQERCIDYSNYDQNGTYKGQVMNGILVTDGVLIFPHERFHLRQWDPEFIIKHDLQQVHHPVIGNFSKKLHDSIHNSLIKDHSANLGDVMGNWVKVAASKVSGFFKEIEKFLIGGLLLVVILLMVGLLCKCKCRRKPKAKNLKANSSGDEMSPNESIF

SEQ ID NO: 15881 - protein, 549 aa, unidentified
MILLIILSLLARRAAGTSGGPTPAPLQDPSIVEKSDHLDGTILLPLRLSESWKPISVSSLECPHRAKRTGRFGVRHKVFNLTRFDHFSSGLVEGYLCHKIRWVTSCQKTWYFSATVTRRVEPLLPTEAECREAVNLEQHGILESGSYPPESCYWNSLNEEAVTEIHLTTHNVGLNPYTMEWVDSIFLKGSCKDQICPTEHSTVLWLKDPDQQTHNMCGTEVTEHAELMKRASSGSNISWSDYTLVSHHLPATTMEGACYLDFCGKEGIHLHNGIWFALPDISKLGPETLSRCPEDTKAGSVSPAYAEDDLQFQLKDMKRDIECLNVLETIQATGTISFRSLQYFHPRDVGVHPVYRIINGSLEMATARYAIAHIPLEGNESCIGLVTENTRLKCVGWNDWIPVKENLKQGFNGIMSDHGRIIYPIRYLLGDEWNPEMHALQYVKFMPHPLLHPYSHQIKDKGRSELVMDHSQNVGDVIVNSAGTFFSRIGSFFSQAFDQLIHIAVILGIGLACYVAVKMFLKWKRNREPFKAVERGQKEQEMTELAGFG

SEQ ID NO: 15882 - protein, 551 aa, unidentified
MAGFYLLALTLVCYLTLVESDGTPAPVVKNETGDFLWGLGTELILPVEVISKWVEINPEDMRCPSDPVTDHVIGAIVGHTRFSRYSGFHKATQKGFLCHKMRWITACTTTWYFSHDVQRRVEAQEPGTQECLDQVKKRGEGTEEEGSYPPSQCAWNSVNEEAEVVIHLTVHEVRVDPYTMELLDPVFPSGRCNTTACDTVHQSVLWIEDPSKTRPSCGDRVVDEGNIIRSGWTDNVPGAYYLISQHLPPTKIDGACRLSFCGESGLLFENGIWTHDIKLETVVANQTFQNCQADRRAGAVGPTYEIDKLRFDWEAAKEKIKCLDMIEIISATGALSFRRLHHFNPRTPGIHPVYRIVNKTLQMAKAHYVVTNNPMSHKGTRDCLGTYMDHDTRKCVAWHHWVDVGNGTEQGPNGLLVTGDKVSYPHWFIREKTWDPALHIINYLQNADHPIVSHLGRYIDNASRDSLRKDRSENVGDAASAAVTKLAGSIGGVFKDVWHVITTCVTVGVIIIIILIFRRMIGVFWRGREKHPLPKTPNNIYQETHELKSFG

SEQ ID NO: 15883 - protein, 573 aa, unidentified
MWIITALICSFSINPTCLYPHGHEDSPTVRHGISRVLSGDAERNDDEHYHSPPLVLPLQNERTWKPANLSSLKCPEASHLGPDEHRVMEKWLVHRPKSSVLTKVEGSLCHKSRWLTRCEYTWYFSKTVSRKIEPMPPTKQECEEAIKRKEEGLLESLGFPPPACYWARTNDEENVQVDVTDHPMTYDPYSDGVVDNILVGGKCNQRECETVHDSTIWLETQKEKRPSQCEMDVEEQLELVSGIKRVGGSKSKAQRSVFVVGTNYPFMDATGACRLKYCSKSGMLLSNGLWFHITRKISPESNENSKFWLTLSDCSSDKQVGVLGEEYEIGKLQATMEDIMWDLDCFRTLEDLSHHKKVSMLDLFRLSRLTPGTGPAYKLVKGNLMVKEVQYVKAQRDQGELANPLCVAFMTESKNADRCIRYDEYDKEGPYKGQVMNGILINEGMVVFPHERFHLRQWDPEFIIKHEIKQVHHPVLGNYSSQIHDSLHESLIKDHSANLGDVMGNWVQVATSKFSWFFKEIEKFIIGGALLLIFILIALMVCRGGCCKVRRKAGGEKGGDSSGDEMNVSESIF

SEQ ID NO: 15884 - protein, 541 aa, unidentified
MQLSLLMVMASLAQSVTGRAAGRELHDVIGFVPDTDTLQWKPANLDTLRCPEAADPGPDDGAVVEKWVISRPRVNTFLGIKGYLCHYAKWVTRCEYTWYLSKTISRSIQPLDVTESGCQDAFKEYDAGRLVPGSFPPEACYWASTNDETVHAYTITPHEVIYDPYSNAKLDHIFLHGSCNKDFCETSHDSTMWIAKRKGEGSVCQFVGREDVEIIEGAKFSLRKFQTKVWLRGPSLHNIPLDKLCKIDFCGKTGYRNQQGIWFSIDRVSWSKNHSLPIRQKAVGCKPGENVAVVDTNLPDSDLEATIEEMMWDMNCLNALETIQHHKKVSLHDLYQIAPQKSGPGLAYRLNDGHLEVAQAHYWSVQHPKRGKLSRTCLGARQADETSSCVKWNKWTHVANNTYHAVNGITEVDGQILFPKRRVLHRKYDPEYATRQSLRFIKHPVIDKFEDKATENIEHKDIISKDVNAGDLVGNWVVVAEGKLSEWFGGLGKSIISVVSLIVGLLVLYVIVKLCLYFRPKAKEKIGDMEMKLKKRSESFG

SEQ ID NO: 15885 - protein, 551 aa, unidentified
MDIVRFFFFVGATANAKVEDTTRAPLHEPHELGMMLSDIPTVILPVSVGEYWREASLKELRCPLSNLDEGPDGRTVAAFNMTRYDHFNPALANGYLCHKTKWITRCEYTWYFSKTVTRRIVPVLPSHHECHEERQREISGIPHEGSYPPEECYWNSVNEEVEETILLTEHSAGYDPYTEEFVDEIFLKGRCHEEDCLTDHSTVRWIHSEMKGNKPKCGEKLVEEAELISLNPNRDDQDFSKLYIYSHHIPKSPLKNSCLLNFCGEEGIQLENGFWFRTPDWKKGKGISIPYCSEGTTAKALGDGFTRAYIRFELDELRDDMACLDALESIQVTGAISYRKLHYFHPRKSGIHPIYRMRNGTLESNTAKYVTAYAIGNEKGCLGMVKNQSDMICIQWNDWIEVEKDLLQGFNGLMRDKGRLMLPWKYASDERWNPEIHKVQFLTQAQHPFYSHISHMIQDDIIDEIRKDKSKNVGDSVVKAAESLWERFSNFFHKVKEVAFGAGILITTLVLVLLIKKCITLRRVKSTKRKKKAGRPMVEELEMTESDASFG

SEQ ID NO: 15886 - protein, 535 aa, unidentified
MKIITILIIFICQINLNLTENNRKIILPKETHYDWKPAHLDKITCPKPELDWTGEYKPVVVLNVLRPPNHKIGGINGFLCHKVEWITRCEYTWYLSKTVSRRIKEETPTEAECKEAIELHKGGRETSGSFPPEECYWNSVNDESDIKVSVTEHKIGYDPYRNIGLDDILIGGYCKDRKCLTTHSSVIWIRDGDMNPCGEMTLETLTVYTTLYNYNTKKWVGSSTIKLSSLEKACTIKFCGVDGIMLSNGIWFHHNQGTDNRHLDVKEKCPENAEIGVLQPGYEIKWLDYKLIDLQREFLCLQALDKIRLQKVVTLHDLQFLRPHKAGPGAVFRVRNKTLETTHANYVEASMVDENELSRDCLAKYLNEQKKPTCIKWDNWIDLGSNKHQGLNGILEIKGSIKFPEDQLLEAEWEAEMFEYFKLDKIHHPFLQNISDMIHDDTDEDLIHDKTVNPGDAINDWITVAENKIGMFFKGIGNDLIKLFYIALIVILIIVLVKICLICKKCCKTRRKRTRNQDELIEFDSRENRNRSVFG

SEQ ID NO: 15887 - protein, 568 aa, unidentified
MCSLRSKIAAISVLIGLHAVLGEPRNFTGGRSIVLEGTRKPNYDEHYHSPPLILPLQNDRDWKPANLSSIRCPDPAHLGPDEHRTMETWIVARPRETIKTQISGVLCHKARWVTRCEYTWYFSKTVSRKIEPLPPKESDCKEAIKKKEEGLLESKGFPPAACYWASTNDEAYEQVEITDHPATYDPYVDGVLDSIFVGGRCKSKICETVHDSTLWIESTRATRPAACTMHEEEQLELISGIKEAGGSKTWMQYSVFVVGTNYPFMDAKGSCKLKYCGKNGLLLSNGLWFHILHTVRTEGEAVAGFWDSLPDCTPNREVGVLGEEYEIEVLEATIEDIMWDLDCFRTVEDLQHHKRVSLLDLFRLSRLTPGIGPAYTIKGKTLFTKDVEYVKANKIKDADSTPKCAAHFLKTNAGQRCVEYTEYDKNGPRKGHVMNGIMIVDGKVKFPHDRFHLRNWHPDFILKHEISMVHHPVIGNISSKIHDSIDENLVKEKDANAGDMIGGWVKIASSKISWFFKEIEKFVLAFVILIIFLLLISVLFKIRKRNKTDSKNEKRATERLKKIEESVF

SEQ ID NO: 15888 - protein, 546 aa, unidentified
MIAFLILIACANGYINDNDTEYVWRARPLGSVADKGVLYVPLDHSKNWRPAKYQDLKCPKPQGDWQLKFIIHTRWVTWRPDDISLDHIPGFLCHKAEWITRCEYTWYLSKTVSRKLKEETPSESECQDAVRLYEAGKQEAGSFPPEECYWNSVNDESVVKTIVVEHSIAYDPYKDCGVDEALVGGSCKKKFCDTKYSSVKWVQDVDHESQRCHNIIQEQLEILKRNDNKEQDKSWVRSKSFPITEMDDACKMSFCGLDGIRLKNGIWFGFQKSRTDHSDMGDIPQCVSGTEIGIPDKNYKEKEFEYELEDLQREILCLNVLDKLQLNQVISLYDLQYLRQDAPGYGNIFRVNNGTLEVTTGKYIKVYHAKNDLSPDCIGTYKDHSGDDVCVDWDEWLPIEKDKDQGFNGIIRIKNKIIFPDDQLRASEWREELFDYFKVDKIHHPFLNNVTDVIHDDTDDENLIHDKTVNPGDAINNWVKVAENKVVNFFKELGIGIIIIVWIIAGIIFLFILFKLIRFCIKLRYKKVNTGDKEIEMRHYDSPIFG

SEQ ID NO: 15889 - protein, 535 aa, unidentified
MTGLLMLALALTLCHGLNIYQEGGVLLPLSEDITWRHVKLDQVQCPFKGDQGPDEGQILEKWTVGRPRQRHDLKLNGYLCHKARWTTRCVYTWYFSKTVSRQIENLKVSDQDCASALKQQQEGQLPTGSFPPESCYWATTNDETVEAVTVTPHPVHYDPYTNEAVDTLFPNGRCGNLLCPTVYDSTVWMQGQNDLLEICSFKEDEPLEVVEGVKISGGMGINVDLWITGPHLPHEKLLGICHKNFCGKSGLLTLSGTWFYLQQIVYKKNNSLDVLKRVPECNSTRLVGVLDEMEPYLQMRATLEEITWDMNCLATVDSIHHHNRASPHDLFQISPTHPGTGPIYRITKGGLEMGTAEYVVAEPERRPTRQCLGRYSTNTGKQCVGWKGWTQMENSTFHAFNGITERNGQIKLPKDRMATRDWGEEYIKKHPLSFYHHPSLGNLTRKITENILHKVIKSHNVNAGDLIGNWVTVVEDKVSSFFSHLGGSVVGLLSVILVVGVIYMLIQIIHKIRTPRPQFHSRDMELQKPTHSVFG

SEQ ID NO: 15890 - protein, 541 aa, unidentified
MLPLCLWVTCVLARAEEYRHFKNPLYEQHSVLVPLTSPVNWLPASLASLRCPTHTELGPDAGHTLERWLIQRPHNPDVPKVEGYLCHVAKWITRCEFTWYFSKTISRKIEPLDVSQTQCSDAIREYKTGSLTPGSFPPEVCSWAHTNDETLIAVTITPHSVTYDPYKNTYLDQLFIGGSCKDVYCPTLYQSTAWLTMSSGTPKYCDFPGNEPVELVLGYKDSMSGRFHEGLWLRGPHLAHEPFQRLCKKGFCGREGFMTDRGFWFFIDNVVWQYNKSVLFMADITECSSDEPIQVSDDVTDPSTIRATIAELMWDLNCLNTLENILHHNKISLHDIFQISPQEPGPGPIYRIKDGSLETATVQLVRVVLDSKPRRECIGKYHTKTNEVCLGWSDWLLVGNQTYQGYNGITEVNGQLVFPPMRVIGRRWDEEYITKHHLHRIAHPVLGNLSRKVHENLHNVDLKHNPSNLGDLMGGWVVSAEHKVGAFFRTVGGTFMSLGVVLAFGIIVYLFIQLCRLLQKRRPSIPKAEGNELKATTAFGA

SEQ ID NO: 15891 - protein, 550 aa, unidentified
MTISQLFLVLLPTVLGSLEDTSRAPVVNDPDGVGLTEMDNIILPISVGDSWKETSVKELKCPKHNIEKLQDGLTIGVFNMTRYDHFNPASVLGHLCHKTQWVTRCEYTWYFSKTVSRRIIPTLPTLQECETQRNLEINGIPLEGSYPPEECYWNSVNEEMVESVHLTEHKVGYDPYNGHFVDQIFLKGACDSSLCETDHSTVYWLKDPDVENLPECGELVVEEAELMTEARRNYADEFKDLVIYSHHIPKTSLKGACALKFCGDEGIQLVNGFWFKSPDWKNFKGSDVQRCPEGTTAKALPQGYFLDHIRFSIEELRDDMACLDALESIQVTGALSYRKLHYFHPKEAGVHPIYRLINGTLQSNTAKYVAAYTHWNTTECLGMLKSQNKMKCITWSDWIHVKDDLWQGFNGLMKDGNKMMIPWRYSADIQWNPEIHMAQYLTSAQHPFYQHISHQLHDEILDQLRKDRSANIGDSVAKAATSLWTRIIAFVDQIKTGIITVGVFVFTMILILTIRRCLGMRRLNSRKRGGKGKRKALQEIELTESDASFG

SEQ ID NO: 15892 - protein, 523 aa, unidentified
MLCLILLLTFSSLSPSVSLHDVLGFFPDVYTGWVKAKPGDLKCASSFLPLPKNQLLIEHTTVQVQSSHHELVPVIGQMCMGLRYVTHCSEGFFGTKTITKRIEKVTPTSRNCLDAIEIRRDGHSIPPYFPAESCVWMSEDEAKKDFFVLIDHTVKFDPYKVGFSDSLLLDDICTSMVCKTEHENTLWISPIDPLQHCSIFLNEHVLLYTNQSNPNEHWVRVKEIFFYKLNGSCQMSYCGKAGLRLGNGMFFGGFPPQLTSEYPHCPTDTEIKIASQTTELEILEEEMQEDRDRMNCLSALTQMLLTNKTTYLLLSFMDPRRPGVHPVYRLHNNSLEMAMARWVPFIKFNLNYLDDTIGVTLANETLKFKSWVPSGTPGAWSGYNGVHKLVNRKEIIYPRKNILEMEYENSLMIQHELKPIEHPHIIHLKREGLNNSLEVLVSHNKVNVGQWLASVWDSAWGKVTAIVTTVILIVVGYFVLKLVISCCGKCKEKKNNKSGGAESRIQIEMLPLRQTRAYDPFSP

SEQ ID NO: 15893 - protein, 524 aa, unidentified
MIRIQPGLAILIVFTISPILSSRHSVIMFPHVVTPWIRAKTSDLSCPPSSPLETPNALPITEIDVFIQKDHKELELIPGLLCYGLKYVTHCSEGFFGQKTISKRIDKIAPTLTDCRKSYEIYEKGEQIDPYFPASKCTWMAEDEDSKNFYLLTPHSVKYDPYTTGATDPLFLRDHCKETTCETVHANTIWMTTKSINRCSPFQRHVGTLYHDPRKNVTHIQYKGTHTYSLNGSCLMNYCDKFGVRLSNGLFLGGPLATKIPNGPKCPQGTTVKFVPIEDEIETLEEEIQEDRDRETCLVQLMTVRMSNFSTFFSLSYMDPKFESRGKVFRIHQNHLEMAHADWIPVTNVTNHKQNLIGISNRGKELYFTDWVPSGRHNLSSGWNGVHKTSKGKIIIPRLSLLKQEYEETLLVEHNLREITPVHIHHFDKEGLNDTVVTLTSHELVDVGAWIGSVWSTLWGKITTIVTVIIALIILYFIVRCCVPILSRCCKKKESKHPEFEMVPLRSPSSTPSRVTLTRPKGWQ

SEQ ID NO: 15894 - protein, 526 aa, unidentified; identical to SEQ ID NO: 15441

SEQ ID NO: 15895 - protein, 526 aa, unidentified
MLLQIVLLMSLMVFSPCPGKFPLYTIPDKLGPWSPIDIHHLSCPNNLIVEDEGCTSLSGFSYMELKVGFITTIKVSGFTCTGVVTESETYTNFFGYVTTTFKRKHFRPTPEFCRNAYNWKVAGDPRYEESLHNPYPDYHWLRTVTTTKESLLIISPSVVDMDPYDKSLHSKMFPKGTCSGASVPSIFCSTNHDYTLWMPENPKPGMSCDIFTTSKGKKASKGGKVCGFVDERGLYKSLKGACKLKLCGISGLRLMDGSWVSIQNHEEAKWCSPDQLVNIHDFHSDEIEHLIVEELVRKREECLDALESIMTTKSVSFRRLSHLRKLVPGFGKAYTIVNKTLMEADAHYKSVRTWNEIIPSKGCLKVRERCHPPYNGVFFNGIILSPDGHVLIPEMQSSLLQQHVELLESSVIPLIHPLADPSTVFKRDDEAEDFIEVHLPDVQKQVSGIDLGLSEWERYLIIGASAVVLFALAIIFAVCCRRCKRRKKARTDRIELDRKVSVTSQSGKVIPSWESYKIEAGGHFRS

SEQ ID NO: 15896 - protein, 524 aa, unidentified
MPTQAVLTAFLTTITVCVGKFPIYTIPDKLGPWSPIDINHLSCPNNLVVEDEGCTNLSGFTYMELKVGYITTIKVGGFTCTGVVTEAETYTNFVGYVTTTFKRKHFRPRPDACREAYDWKTAGDPRYEESLHNPYPDSHWLRTVSTTKESFLIIEPSVADMDAYDKSLYSKIFPDGKCSGVSAVSPFCPTNHEYTIWMSENPKPGMSCDIFTTSKGKKAMKNGKMCGFVDERGLYKSLKGACKLKLCGVSGLRLMDGSWVSVQNPEDAKWCSPDQLVNIHDFHSDEVEHLIVEELVKKREECLDALESIMTTKSVSFRRLSHLRKLVPGFGKAYTIINKTLMEADAHYKSIRQWTEIIPSKGCLMAGGRCYPHHNGVFFNGIILSPDGHVLIPEMQSALLQQHIELLESSVIPLMHPLADPSNALKGGDGAEDFVEVHLPDVQKQISGIDLGLPEWKRYFLMGVSALALLALIIILATCCKRIKRKKKMESSPVELIRKVSVTSQSGRVVPSWESYKVDAGGHA

SEQ ID NO: 15897 - protein, 525 aa, unidentified
MASYFALVLNGISMVFSQGLFPLYTIPDHLGPWTPIDLSHLHCPNNLYTDASYCTTEQSITYTELKVGSSVSQKIPGFTCTGVRTESVTYTNFVGYVTTTFKKKHFPPKSRDCREAYERKKAGDPRYEESLAHPYPDNSWLRTVTTTKDSWVIIEPSVVELDIYTSALYSPLFKDGTCSKSRTYSPYCPTNHDFTIWMPESENIRSACNLFSTSRGKLVRNRTSTCGIIDERGLFRSVKGACKISICGRQGIRLVDGTWMSFRYSEYLPVCSPSQLINTHDIKVDELENAIVLDLIRRREECLDTLETILMSGSVSHRRLSHFRKLVPGSGKAYSYINGTLMESDAHYIKVENWSEVIPHKGCLMVGGKCYEPVNDVYFNGIIRDSNNQILIPEMQSSLLREHVDLLKANIVPFRHPMLLRSFTSDTEEDIVEFVNPHLQDTQKLVSDMDLGLSDWKRYLLIGSLAVGGVVAILFIGTCCLRCRAGRNRRTIRSNHRSLSHDVVFHKDKDKVITSWESYKGQTAQ

SEQ ID NO: 15898 - protein, 533 aa, unidentified; identical to SEQ ID NO: 15442

SEQ ID NO: 15899 - protein, 542 aa, unidentified; identical to SEQ ID NO: 15170

SEQ ID NO: 15900 - protein, 526 aa, unidentified; identical to SEQ ID NO: 15319

SEQ ID NO: 15901 - protein, 524 aa, unidentified; identical to SEQ ID NO: 15492

SEQ ID NO: 15902 - protein, 524 aa, unidentified; identical to SEQ ID NO: 15493

SEQ ID NO: 15903 - protein, 524 aa, unidentified
MAQLVTLVLNGLSLLTGPGIFPMYTIPEGLGPWTPIDLSHLKCPDNTYFAEEGCNEGSKVSYLELKPSFHSQNKVQGFTCTGIINMATTYTNFVGYVTTTFQRSHFIPNQRDCRQAREWKKEGDPRYEESLTTPYPDSKWLRTVTTSKESWLILDPAVVEMDIYNKTMFSPVLRNGYCNFSPENPDFCETNHQHSIWIPEDEGRGITCDIFQASTGILLKNGSKVCGFQDERGLFRSIKGACKMIICGKSGVRLYDGTWVSYNSVDNLRMCSRSKMVNKHTVKLDNIEESIVRDLIKKREECLDALEEVMLTRSISFRKLSLFRKQVPGRGYVYTMINNTMMEATGHYKSVDNWTDILPNPICLMVDGKCHPGYDGVLFNGIIRDSRGKILIPEMQSHLLRDHLELLKRNSIPWRHPLVHYSENGEDGSDLTSFAQLYIKDPHLSVSDIDIGFPSWKKYLMIVGGVLIGLIVFWFLVKLLFRVCYTVKRKRLREGSMNETSSGPVIRTSGDKQLSWESYKSSAF

SEQ ID NO: 15904 - protein, 524 aa, unidentified
MSLLTAVIAFLFISTFCSGKFPIYTIPDKIGPWSPIDINHLSCPNNLEVEDEGCTTLTAFNYMELKVGYITSIKVDGFTCTGVVTEAETYTNFVGYVTTTFKRKHFRPNVSACRAAFSWKTAGDPRYEESLHNPYPDSHWLRTVTTTKESLLIISPSVVDMDAYDKTLYSKMFPNGKCFPPISDSPFCSTNHDYTLWLPEKEKLSMSCNIFVSSKGKKATKDGRLCGFVDERGLYKSLKGACKLKLCGMAGMRLMDGSWVSLQRADAPEWCPPGALVNVHDFHSDEIAHFVVEELIKKREECLDTLETILTTKSISFRRLSHFRKLVPGLGKAYTLINNTLMEAEAHYKSIREWKEIIPSKGCLKAGGRCHPHYDGIFFNGIILGPNGDVLIPEMQSSLLQQHIELLESSMIPLRHPLADSSAIFRSDNEAEDFVDVHLPDTQKQVSDIDLGFPEWKRYFLIGVSAIALFSLAIIIAVCCRKFKRRKRPKPGPIELVRKVSVTSQSGKVVPSWESYKEGATSQP

SEQ ID NO: 15905 - protein, 526 aa, unidentified; identical to SEQ ID NO: 15394

SEQ ID NO: 15906 - protein, 522 aa, unidentified
MSQLNLIPFFCVIIVLSVEDFPLYTIPEKIGPWTPIDLIHLSCPNNLQSEDEGCGTSSVFSYVELKTGYLTHQKVSGFTCTGVVNEAVTYTNFVGYVTTTFKRKHFKPTALACRDAYHWKISGDPRYEESLHTPYPDNSWLRTVTTTKESLVIISPSIVEMDVYSRTLHSPMFPTGTCSRFYPSSPSCATNHDYTLWLPDDPNLSLACDIFVTSTGKKSMNGSRMCGFTDERGYYRTIKGACKLTLCGKPGLRLFDGTWISFPRPEVTTRCLPNQLVNIHNNRIDEVEHLIVEDLIRKREECLDTLETVLMSKSISFRRLSHFRKLVPGYGKAYTILNGSLMETNVHYLKVDNWSEILPSKGCLKINNQCVAHYKGVFFNGIIKGPDGHILIPEMQSSLLKQHMDLLKAAVFPLKHPLIEPGSLFNKDGDADEFVDVHMPDVHKLVSDVDLGLPDWSLYALIGATIIAFFILICLIRICCKKGGRRNSPTNRPDLPIGLSTTPQPKSKVISSWESYKGTSNV

SEQ ID NO: 15907 - protein, 525 aa, unidentified
MAYQVTLILNSLSFITGQDIFPLYTIPDSIGPWTPIDLSHLKCPDNAFIVDENCTDHGEINYSELKPSFHSQSKVPGFTCTGIVTQAVTYTNFLGYVSTTFQRSHFVPNPRECRAAQEWKSKGDPRYEDSLQNPYPDSKWLRTVTTTRESLLIIEPAIAEMDIYNKTMFSSVFRGGLCDFSRGNPDYCETSHSYSIWMPYEESRGITCDIFQSSTGRLFKKDDQVCGIQDERGMFKSTRGACKMTICGKSGVRLYDGTWISYNTIDNLKVCPRSAMVNMHTTKLDALEEAVVRDLVKKREECLNAFEEIIITNSISFRKMSLFRKMVPGSGLVYTMINKTLMEAHGHYKSVSNWSEILPTPICLLVKGKCYQDHDGVLFNGIVKDHRGKVLIPEMQSHLLQDHFELLRSNTIPWRHPLVHYPDDTDPSSETAEFIQLHMRDPAKVTSDIDFGLSSWKRYLIFVACLILGLLILWVVIKYSFKVYRVMTKKRSSRRKMQDILPDPVIRSVGGNQLSWESYKNSTNL

SEQ ID NO: 15908 - protein, 522 aa, unidentified
MNIPCFAVILSLATTHSLGEFPLYTIPEKIEKWTPIDMIHLSCPNNMLSEEEGCNTESPFTYFELKSGYLAHQKVPGFTCTGVVNEAETYTNFVGYVTTTFKRKHFKPTVAACRDAYNWKVSGDPRYEESLHTPYPDSSWLRTVTTTKEALLIISPSIVEMDIYGRTLHSPMFPSGKCSKLYPSVPSCTTNHDYTLWLPEDSSLSLICDIFTSSSGQKAMNGSRICGFKDERGFYRSLKGSCKLTLCGKPGIRLFDGTWVSFTKPDVHVWCTPNQLVNIHNDRLDEVEHLIVDDIIKKREECLDTLETILMSQSVSFRRLSHFRKLVPGYGKAYTILNGSLMETNVYYKRVDRWADILPSRGCLKVGQQCMDPVKGVLFNGIIKGPDGQILIPEMQSEQLKQHMDLLKAAMFPLRHPLINREAVFKKDGNADDFVDLHMPDVQKSVSDVDLGLPHWGFWLLVGATVVAFVVLACLLRVCCRRMRRRRSLRATQDIPLSVAPAPVPRAKVVSSWESSKGLPGT

SEQ ID NO: 15909 - protein, 524 aa, unidentified; identical to SEQ ID NO: 15578

SEQ ID NO: 15910 - protein, 522 aa, unidentified
MSNLCTIFILCASIMVSLGDFPLYTIPEKIGPWTPIDLTHLSCPNNLLSEDDGCSSSSTFSYIELRTGYLTHQKVSGFTCTGVINEAVTYTNFVGYVTTTFKRKHFKPTASACRDAYHWKISGDPRYEESLHTPYPDNSWLRTVTTTKESLLIISPSIVEMDIYSRSLHSPMFPTGRCYDFYKSTPSCLTNHDYTIWLPDDANVRLTCDIFVTSTGKKSMNGSKMCGFTDERGLYRTLKGACKLTLCGKPGLRLFDGTWISITRPEIVMWCSPNQLVNVHNNRVDEIEHLIVGDLIRRREECLDTLETVLMSKSVSFRRLSHFRKLVPGFGKAYTIANGSLMETNVHYKRVDRWEEILPSKGCLKLNDKCLNPENGVFFNGIIKGPDGQVLIPEMQSSLLKQHMDLLKASVFPLRHPLIDQTSIFKKDGEADDFVDVHMPDPHKSISNIDLGLPDWGLYAMIGGTVVAFLILVCLLCTCCKRRRRRNSRKPSSEQTPKISSTPPSGTKVISSWESYKGTSSV

SEQ ID NO: 15911 - protein, 524 aa, unidentified
MLLSTALFAFFLNCAPCLGKFPIYTIPDKIGPWSPIDINHLSCPNNLIVEDEGCTTLTPFSYMELKVGYITTIKIEGFTCTGVITEAETYTNFVGYVTTTFKRKHFRPTVSACRDAYNWKITGDPRYEESLHNPYPDSHWLRTVKTTKESLLIISPSVVDMDAYDKNLYSKMFPNGKCLASPPSAICCPTNHDYTIWIPENPKPGLSCDIFTTSKGKKATKDGKLCGFVDERGLYKSLKGACKLRLCGVPGMRLMDGSWVSLQKTEAPEWCSPDQLVNVHDFHTDEIEHLVVEELVKKREECLDALETIITTKSISFRRLSHFRKLVPGFGKAYTLINKTLMEADAHYKSVREWTEVIPSKGCLMAGGRCHPHYSGIFFNGIILSPGGDVLIPEMQSALLQQHIELLESSMIPLRHPLADPSTVFKRDDEAEDFVEVHLPDTQKLISGIDLGFPEWKRYFLIGISVLALLALAIITAACCKRFKRRRRPKPNPIELIRKVSVTSQSGRAVPSWESYKVGTTSES

SEQ ID NO: 15912 - protein, 526 aa, unidentified
MPFQAVLLTLLTIFALCVGKFPIYTIPDKLGPWSPIDLHHLSCPNNIVVEDEGCTTLSAFSYMELKVGYITTIKVSGFTCTGVVTEAETYTNFVGYVTTTFKRKHFRPTPNACRDAYSWKVTGDPRYEESLHNPYPESHWLRTVTTTKESLLIISPSVVDMDAYDKSLHSKMFTDGKCSGVSAISPFCSTNHDYTIWMPESSRPDVSCDIFTTSKGKRATKDGKLCGFVDERGLYKSLRGACKLKLCGISGMRLMDGSWVSIQNHDDAKWCSPNQLVNIHDFHSDEIEHLVAEELVKKREECLDALESIMMTKSISFRRLSHLRKLVPGFGKAYTIINKTLMEADAHYKSIRDWTEIIPSKGCLKAGGGCYPHHNGVFFNGIILSPEGHVLIPEMQSALLQQHIELLESSVIPLMHPLVDPSTVFKGDDGAEDFVEVHLPDVQKQISGIDLGLPEWKRYFLIGVSALALLALAIFIAACCRRVKRRRKAKPNPVELIRKVSVTSQSGRVIPSWESYKGGAGDQSQA

SEQ ID NO: 15913 - protein, 524 aa, unidentified
MSLLTAVIAFFFISTFCSGKFPIYTIPDKIGPWSPIDINHLSCPNNLEVEDEGCTTLTAFDYMELKVGYITSIKVDGFTCTGVVTEAETYTNFVGYVTTTFKRKHFRPNVNACRAAFSWKIAGDPRYEESLHNPYPDSHWLRTVTTTKEALLIISPSVVDMDAYDKTLYSKLFPTGKCFPPISDSPFCSTNHDYTLWLPEKEKLSMSCNIFVSSKGKKATKNGRLCGFVDERGLYKSLKGACKLKLCGMAGMRLMDGSWVSLQKGDAPEWCPPGALVNVHDFHSDEIAHFVVEELIKKREECLDTLETILTTKSISFRRLSHFRKLVPGLGKAYTLINNTLMEAEAHYKSIREWKEIIPSKGCLKAGGRCHPHYDGIFFNGIILGPNGDVLIPEMQSSLLQQHIELLESSRIPLRHPLADSSAVFRSDNEAEDFVDVHLPDAQKQVSDIDLGFPEWKRYFLIGVSAIALFSLAIIIAVCCRKFKRRKRPKPSPIELVRKVSVTSQSGKVVPSWESYKEGATSQP

SEQ ID NO: 15914 - protein, 525 aa, unidentified
MASYFALILNGISVVFSQGLFPLYTIPDHLGPWTPIDLSHLHCPDNLYSDASDCTSEQSITYTELKVGSSVSQKIPGFTCTGVRTEAITYTNFVGYVTTTFKKKHFSPKPRDCREAYERKKSGDPRYEESLNHPYPDNSWLRTVTTTKDSWVIIEPSVVELDIYTSALYSPFFRDGICSKARTYSPHCTTNHDFTLWMPEEENIRSACNLFSTSRGKLVRNRTSTCGIIDERGLFRSVKGACKISICGRQGIRLIDGTWMSLRYSEYMPACAVSQLVNTHDIKVDELESANYYDLIKKREECLDTLETILMSGSVSHRRLSHFRKLVPGSGKAYSYINGTLMESDAHYIKVENWSDIIPYKGCLRVGGKCYEPVNGVYFNGIIRDSNNQVLIPEMQSSLLREHVDLLKANIVPFRHPMLIKSFTSDNDEEIAEFVNPHLQDTQKLVSDMDLGLSNWKRYLLIGSLAVAGIIVFLFLGTCCLRCRSRGRRGMNHSKQKSPSLDVIFHKDKDKVITSWESYKGSNVH

SEQ ID NO: 15915 - protein, 540 aa, unidentified
MSNCAITIIVLLRCTLCFGHFPIYTIPDKIGPWSPIDIRNLNCPNNLIVEDEGCNTLTPFSYMELKIGYIKAIKVEGFTCTGVVTEAETYTNFLGYVTTTFKRKHFRPSMNRCLDAYRWKVNGDPRYEESLHNPYPDSSWLRTVTTAKESLLIISPSVADMDAYDKQLYAAIFPDGKCTNLLPGAFYCPTNHEYTIWMPRDHRLNLACDIFVNSRGKMAIKDGKMCGFIDERGLYKSLKGACKLKLCGISGIRLVDGSWVSIQRRTPPEPCAPGQLVNMHDLRTEEIEHLIVDDLVKKREECLDALETIMSTKTVSFRRLSHFRKLVPGFGKAYTLINKTLMEADAHYKSIKNWSDVIPSKGCLRIGGYCHPHYDGIFFNGIIMSPHGDVLIPEMQSALLQQHIELLESSVIPLRHPLADPSTVLREGNDVEDFFDVHLPEVQKHVSDINLGLPEWKHYFYIGVALLALIALSIIAVVFCRRFKRRKKSPQAPIELVRRASVTSVSGRPVPSWESYKTGRQTNLEVVPSPHETPTNPLRK

SEQ ID NO: 15916 - protein, 540 aa, unidentified
MSSNIIFFTFIMNCGFCLGHFPIYTIPDKIGPWSPIDVNHLSCPNNMMVEDEGCNTLTPFSYMELKIGYINAIKVEGFTCTGVITEAETYTNFIGYVTTSFKRKHFQPTVQSCRDAYRWKITGDPRYEESLYNPYPESHWLRTVTTTKESRLIISPSVANMDAYNKQLYSPMFPGGKCSNTLPSAFCCSTNHEYTIWIPVNPRVEHSCDIFTTSKGSMATKDGKMCGFVDERGLYKSLKGACKLKLCGISGIRLMDGSWVSIQRKEPPVQCAPDLLINMHDFRTDEIEHLLVDELVKKREECLDALETVMSTKSISFRRLSHFRKLVPGFGKAYTLINKTLMEADAHYKSVRNWTEVVPSKGCLKAGGRCHPHYNGIFFNGIILSPSGDVLIPEMQSALLQQHIELLESSVIPLRHPLSDPSTVFKRDDEAEDFVDIHLPDVQKQISDINLGLPEWKHYFYIGVALFVFMILAVVIFACRGKFKRRRRPKSGPVDVTRKISVTSRSGKPIPSWESYKNELQESPKTVSPLHEITVDSPVH

SEQ ID NO: 15917 - protein, 508 aa, unidentified
MLRMMLAIVGICSFAEGLPVTHHGRLYIGPTGVVTPWKSISPESVDCKASVPRLGLELTPEHKFVETKRWSPHVTAPTSGYTCSLIQKRTTCSRSFFGYDGIKKETKISLPSAQACREAFQRFRENHLEEIEHPYPTCHWLGDDTAEAKGLKISLVPVEYNPFSGKYTDHILAGGVCDSVPCMVADRSGYWFNSSEPVGECFPDPAIKIFFVDRNDTLTPKTEFVSLSLQARSFKGACKAKYCGLDGFLLNTNEWIENSRSFLNRYSSSSAIRDCYNMSKSYAYLTTQAIIGQVLGSSQSDALLAECRKVKDKLMLGEPISRTDLQLFSPESEGRGPVYRFFNGSLQVATAKYESLVFPDDTAASLHGYSLGATVNTSTPVLWPHAIRINRDIVDGPNGMFWFRGRLIHPRTWEGRIQEVSQHLVQLYSLKFKTPGVPDIDQGNIVEPLSNWEWTSPALIRPVAHLTLLESLALLAGGVLILILCIKITVWRRTKKPRLSAGVRPSWR

SEQ ID NO: 15918 - protein, 503 aa, unidentified
MISLLIQLLALIATCSADLQVYIGPERVTQPWRILSPGRIDCSAIGTGLGLESLEGAREFNVSRWTPHMVGSVTGYTCSKIIRRTRCSRSFFGYDSVTKESQISLPPASACADAYQRYREHVNTDVEHPFPECRWLGDTVAESEAVEITISPVSFDPASGSYRDHLLAGDTCVKAPCLMANRKGYWVNTSDPESLCIEPEVIGLFIKGSTNGSVLMDKTFTSLSLAATSFRGGCLKSYCGKPGILLNTREWISGEPSLLAKLPGLAMLPSCSPGTAGYSSVSSGGVLSHVLHAYAVSSELKECSRIRTKLMLNETVSRSDIYHLSPRVIGIGPVYRYNKDHWESSIAKYIPIRLPKTTDGHHGNSLGLQGNTSMHVVWGHPVAFSQDVVDGPNGIFWYRGELVVPGLYGGDISEITESLTKALTRSSKTSGAMAHLPDVLSRLGEETSWTSPEVIRPIAHLSVFWSVVLIIMGILTTWLIVTWLKSRGGDKKPSTKGFPMYQW

SEQ ID NO: 15919 - protein, 526 aa, unidentified; identical to SEQ ID NO: 15415

SEQ ID NO: 15920 - protein, 522 aa, unidentified; identical to SEQ ID NO: 8638

SEQ ID NO: 15921 - protein, 522 aa, unidentified
MINHTNLLINTVLVMAYLNKPIFAASQQNIKILFPTSFKIEWHDVSSSNLKCPNTNVHQNIDHGTSFIVHRPHIGKDPMISGTLCVSMELITTCSKGFFGGLDIMTSTSPADLSEEDCRKEIARQNQGEFSSSEHPQPVCSWMKTSSTSRTVIHLNNMDVHYDPYSERLCLSLFIGGKFRIPGVDIVFENRLWVPHESLTKYCSEEHLVESSLIIYNTTATKSALWSPDFDVAEDELPCIMSFCGQRGLRFGSGEWVAYPGRMFLLEPWVGEYFYHLQFCDSHTTINLVEANQDLKHMTKEVLTEFLDEQCEMTINKLKEGNLISRIELQTMYPRTPGFHPVYRYTPGKFLMGMAHYSWVSIEPSDIFPYVLIRSSLNKTIEYPYWTLDNRTNIIDGPNGLYILDRTLIYGLEEEQTFKRTLSKSSLHIFPIVSEQKNITKSFLKLISHKSYSFSDDASLVDVIWHPTLKYAITTSLIIAILLILICCARRQIFIKRCKYCVKTDARRPDDLSEEEGDYFDP

SEQ ID NO: 15922 - protein, 517 aa, unidentified
MSKYAKFTLLPIVSYFIWHSPDVLCQSVLFPTTNTIEWIPLDPNVISCDFPYYPSYSNSNLKIRGRSPILHTKYEINGFLCNAVTTVTSCDKGFLGGETVTHSEYRPPLEFKDCENAIRKFKSGTLDTYEHPPPSCSWMKKSDNLKSTVTVQERTVLFDPYSNQLISSWFKDGKCEYSPCSTVKQNMKWISDVNHPPECISDHLDEVIMFLTDSNSTNSYTIWSPDIHITDFNEICTMKYCSVNGFLFPNGEWVGINKNDIPSIPKLGEFLYNIKECNSSTHLHIKDHRYINRETEQTEFSILLSVECSKTKDDLLSQTSINRVQLQSLTPRIPGRHRVYRFHNNTLQMGYSEYKWVRTEKSVTFPFIKMILASGKELRWPYWYLDPNTDIIEGPNGLFIKNKKLAYALSDLINYNRSILINGKISYDIPHVHLPKVNPISNMISTRDFNTINDADLISVIRGWSPFHNITQSIFWLSATVMVILILKYTVPLLINKIKHRRKSNDQDDEPSVFYKP

SEQ ID NO: 15923 - protein, 522 aa, unidentified
MSLRTHIVFKLLLISGYVRDQIHAVSSDSLMMLFPTSPNIEWHDVSPSNLICPDASLHREMEKGLALPVHRPTIGKTPNLSGTLCIAMELVTTCYKGFFGGVDVSISSNPSVISEDNCRKEIASQAQGDYRSTEHPQPVCSWMKTSSVRRSIITLNPLDVHYDPYSDTLYSSLFLGGKCQTNVCPTVFENRIWIPHESLTEFCSAEKLGESKIILYNTSNTQANLWSPDFVVSDDEIPCIMDFCGHKGLRFSSGDWVALSRDDIPKEDWVGEYFYHLRDCAPNTVVNVVDSSQDFNYISETLLDEFINEQCELTISKIKEGELVSRIELQTLSPRTPGFHPIYRYKPGTFQMSMTHYSWTLIRSTDVFPYIELSSHSNESIRYNYWTTDNRTGIIDGPNGLYILNKNLIYGLREEQTFKRILSKSSKQKFPLFNHKQSREPNFVKLLSYSSYSFSDDATLAEVLWHPIWTGMIVTGAGGLLVLVVIVYLKRDFVLKKVISCMKKSTKSTDDMSEEEGDYFDP

SEQ ID NO: 15924 - protein, 522 aa, unidentified
MISDIRIIIKSVLIITYSGGLISAGQMLNIKLLFPISQNIEWHNVSTSNLICPDINFHKRVDSGLSFTVHRPKIGKDPSIAGTVCAAIELITTCTKGFFGGVDVMVSANPATITEESCRQEIASQARGDFRSSEYPQPVCSWMKTSTVKRTIVNLNSMDVHYDPYLDTLYSSLFLGGSCKGAVCPTIFENRIWIPHESLTEYCSSDHLIESKLIIYNTSESKTAFWSPEFRIVDEDNPCIMDFCGTKGLRFSSGEWVALSRQHVPKEAWVGEHFYHLKDCKKETTVNLVETNRDVTYMTETILEEFMNEQCEITIDKIREGSLVSRIELQTLYPRAPGFFPVYKYTPGSFAVGMAHYAWVSVQPSNTFPYVSIRTSLNKSVDYKYWTMDNRTNIIDGPNGLYILKGKLVYGLEEEQTFRRLLAQSSKHIFPITSETNNIKRGFTQLLSYKSYSFSDDSSLTDAVWHPFITSVGVSVLVIIVLIGSYIGVRKKIWHNLCIRNRESKRANADDNSEEEEDYFNP

SEQ ID NO: 15925 - protein, 531 aa, unidentified
MDTLIKVLLIIVILKSLRAHIEFVPPDLSKWREISIGHLDCPIYGDLSNQATRPVSVKYSSVQWGLKNNIDGYLCISAKWSVTCDYRWYGSKYISTSIEYVPTKESECRDAIKSSKNGELVSPHFMPENCGWNNVLTESVTYTTVSSHEVKLDPYQMTFVDSLFPGGKCSSSVCNTIYHQGVWINLNDNLGFCREPVDHQGQLYMAGLVGAQGNIVKEVWNLRSVFKPEIGRSKHLTGSCWMTYCGQRGLRFSDGEWAGFQIPEISALKQVLLGLPECKDDVLVHAHDTNTELREILEHMDESALNAICQQEVRRAKERGVVSDWLLSMMTPFTEGLGPVYRLNKGKLEASMGYYRKVYIDSSNAPQAFGQTEDKESVGWSDLVPKDADGAISSMYNGNVVINNQIKWAKNALGSHILDEISALEFETPVVHHPHLTILSVNHSDLVSSTHPNGQGVNLIESVSHWAGGLWASIGSGLMILVLVALVGFCTIKVCLAYVPSIWAQKNRNGKRRGTTSQRSTEQEMFELSAV

SEQ ID NO: 15926 - protein, 531 aa, unidentified
MDTLIKILLIIVILKSLHAHIEFVPHDLSKWRDISIEHLDCPIYGDLSNQATETTPVKYSSVQWGLKNNIDGYLCISAKWSVTCDYRWYGSKYISTSIEYVPTKESECRDAIKSSKNGELVSPHFMPENCGWNNVLTESVTYTTVSSHEVKLDPYQMTFVDSLFPGGKCSSSVCSTIYHQGVWINPSNNLGFCKDPVDHQGQLYMAGLVGARGEIVKEVWNLRSVFKPEIGRSKHLTGSCWMTYCDQRGLRFSDGEWAGFQIPEISALKQVLLGLPECKDDVLVHAHDTNTELREILEHMDESALNAICQQEVRRAKERGVVSDWLLSMMTPFTEGLGPVYRLNKGKLEASMGYYRKVYIDSSNAPQAFGQTEDKESVGWSDLVPKDADGAILSMYNGNVVINNQIKWAKNALGSHILDEISALEFETPVVHHPHLTILSVNHSDLVSSTHPNGQGVNLIESVSHWAGGLWASIGSGLMILVLVALVGFCTIKVCLAYVPSIWAQKNRNGKRRGTTSQRSTEQEMFELSAV

SEQ ID NO: 15927 - protein, 519 aa, unidentified
MNTLIKILLIIIILREARSHIVLVPLDLGDWRTTEADQLDCPMHGDLSNQGTQAIELEYHTASWGLKNNIAGSLCVTAKWSITCDYRWYGSKYISTVIEYLPTTPEMCKEAKRASDRGESLAPHFPTENCGWNNVLTESQEFTTLTSHPVKLDAYSFILIDSMFEGGRCQSKECPVVFHQGMWIADQEAFGFCKDLDKHRGLLFKTGLRNSLGEIVRQEWNLNSVFQPEIGREKHFKGACKMSYCGNSGVRFSDREWFQLGTPSDNGIKKIIEGLPECGEDNLIHSHDTSNTLKELAEHVDEIALNAICLQEVRRARDTKAVSDWLLSMMSPFSEGIGKVYRIHKGRLESTVGFYRKVVLEGDGTPERLGVGLDKKPVSWDQFVVKTNDTRIQSMFNGNTVVNGKIKWVKNVLGAHILDEISALEFDVPLIPHPHLDGLKFNESHTISSHHPNGKGVNFVESVTHWAGGLWESIGSSAVIIVVLLICAFVAVKFCQRLIPSRRPPTRESSENVFMLRTV

SEQ ID NO: 15928 - protein, 525 aa, unidentified
MRACLKTLVLLASVNILFSYDPPLYTIPSHISPWRKINPNGIRCPSDVYLPDDNCSTEREITYTELGLSSNLKNRIDGYTCTGIRYSATTYTNFVGYVTTSFSQDFISPSLIRCKESYIWKFHGDPRYEESLNHPYPDYSWLRTITTQKDSYIVTEHSDVEIDLYTSDFISSLFPGGACKRNVNQEGYCPSIHEKTIWIPEGRSLNAACDIFMKSKGKILSKDGNLCGFIDKFSNFRSLENSCKISICGKKGLHLYDGMWVSFKDEVITGECPASTLVNQHTRDLDEVEYTIHRSLLDRRERCLDALEDLMLTYQISFRRLSLFRKAVPGRGKVFSLLNGSLVEADATYLPVKAWRDILSTPDCLIVDGSCYPPSEKVLFNGIFVNDAGHVIIPERVFGDTPDQLPLIESYQIPMKHPHVDMMDIKNSVESHITESITSDMMKGIKRVSDIQLGLPDWGRYLLYTLFGLGTLFFIWVILKCCCNKKKTKDKTMRIEKERSNLRNANQSWEDYKSGKSELLPKSLL

SEQ ID NO: 15929 - protein, 506 aa, unidentified
MLWSILFLVSAVYASGWEPELGEYWVPTPVSPWRPATKSDFTCPTLRVDPVPPLKLINETDGEYPTTGGARKEHPGWLCVRKTYQTTCDTNFWGHQTIKREEWPISADPDECRQAISHYQLGSYEDPKHPDPTCTWMAIAHTYRAGTLLLPHSTVVDPFSYTFMDSLFPGIHCKVLPCATVHPDILWHSESTIVEDCPMTQAIHLKLYNDKSARKKAHEWLSVHDGPLIPLGGSCALSYCGRSGVRTPGGVWYPYPGNRVYPECKDAWRATSTPAVDGVKIDIELQEIMARRECINVLQQIRAGIAPTFHMLSHFQPRHTGYYRVYRMNNGLIEYSLALYAPIFNITVPPRLDFGVRRNKSHYHLPLIKSGHPGVWSAFNGIHVMHNKTVIVPELEFYKEHYSETLLYYRAQVVEHPTQVRQANSTELTPHKKTSLIVNRPTLGNWLSLIWDSFWGKLVSILGIVSAVVITGILIRLLPWGRLLRKPHPTRPKIVHYTPATNNVSW

SEQ ID NO: 15930 - protein, 506 aa, unidentified; identical to SEQ ID NO: 15406

SEQ ID NO: 15931 - protein, 505 aa, unidentified; identical to SEQ ID NO: 15166

SEQ ID NO: 15932 - protein, 506 aa, unidentified; identical to SEQ ID NO: 15167

SEQ ID NO: 15933 - protein, 525 aa, unidentified
MGFSMTLIALAFSLAYSEVLYMPDSRNIRWVKARPSVLKCPRKFTYEPSDTTNETDIEVQIPLLRNAHQPGHFCHKTKWVTTCSEGFFGSRTITHAVRHQRVSSAECAVAVKELTSGLAPVPAFPPENCGWLATNTEEQSFVVATPHEVKVDPYNLQFLDKQFLGGVCKGKFCETITDSLMWYSENGALASCPSKKTTLRVYPESTGRWGKFSTVWSDSFVRTNFVDACKIHVCYKDGVRFKHGSAFMYGDNIDSAVKKLIDSHPNCEADQGIIFQDVHTEESMAILNMADSLAVLECIDAVDIAKATGSITQMTLNHMMPDHARIGPGYRLNNGYLEMATVNYIPITVHPRSYSEEVLGTDEEVNNYAWSDWVPSGVKGVESGINGLVKVDGKIHLPWMTIKYQLAEATFDQVMEAQIVHHPAIEYVSNTQNLTDEQLDQHYNGGDLIETVTHMFGTLGQTIGAWIGIFALFVVVVLILVAAICCCAKCSCKRSAPVRPVMYRAPDPLMGDEEGMIKLNPWASV

SEQ ID NO: 15934 - protein, 521 aa, unidentified
MEIVIPILNLTAWSIVDPFNLTCPQMLDYNHSPSDISVPITIKYPAHNEGKRKVPGFLCSCFSLTTRCTEAWTWSTEVSYHSSTIECDLMSCKAEIEKFKAGKLDVKMYPREDCVYARTNEVEAKYIQITPHSSFMDPYNGYICDEIFLTGRTPGNKSETIYSGTLWVLDDGWAKESLCEDWTEISGKLILPNETVEQDLLHSKGTVWAHEMPIHKLSEACSIKYCGTVGLVFPDGMWMNIEMQRDIDSRLRMFLYGGKTCEKDQMIKLPTSNHDLVYTEMNTLNAMYLMKCHECISKIRMGAQVTNYELSFLSRSYPGIGPIYRISEHGIIQAVGLYKKIKTDSRNGKQNILGLDKDGSSVTFKDWVTIRNVTYGIGGTIKDRNGEIIFPSDIVTRTQVSSELMMSTHLHQIYHPLDDHLRRRLNLSTPIRLRHDGSTNVIQEAGKAILKTGNEFTAWISKTWEGFRMYVYSVIGAILILIYTKFKKTINRDKTQGDESQGLPLSVNPRREAQVPMQWRT

SEQ ID NO: 15935 - protein, 562 aa, unidentified
MSNRSIKNFKMENIINKYRLVIYFSLILLDKFNTIKSESFSYPTSRILNWNPVSYNYLTCPQHHTSYDSTIHKHLDEILVRKPIYNDNLFVDGYLCRKVAYITRCVTSWTFTSSINKLIHGLSVSRTECLEKIKQLEEDELIQERFKEPDCRWNKIYDVESINFEIINHKVKLDPYTNNLVDPIFPGGITHSSKSATIHNDVIWISKVNTTFTCNRHIEMKGIVYTKLGVSERNLSGEIAMLHIEGFKDKSFQGACLLMYCNEQGVRFSDGEWISISYDLNFNHSFTNLLSDLNPCSSTVSLSLSNNYQRNIITMELTLETIFRLRCEDTIAKLINHIPITPYDVSFLAQSYPGPGNVYQIRDNVLMQAQGLYELLLVNSSESNGDVIGYHVNGTAFIEDRWYTDNHKSIHGLNGIVKFGGRIRYPGDIFKRRRTHDSLLKAKPLLKVSHPTVLDLSKIINSTDIEYGYHPNSVLDNSILEDTISEIKYLWSHLFDFSVLGQILWVALVVIVLVIGLSSYKVWRRVRETQTLDDIESINRRQNLHFRDIDSLRSLGVDSLSP

SEQ ID NO: 15936 - protein, 547 aa, unidentified
MKKINTREVKITKMYAKLLIANALLIVTILCDILYPTDFSHNLLPVVPEKVLCPVGHLHRYPEAVNQFKVSYSRLAGFSEKKVKGKLCHKFILTTTCDEDILWSKSITYTMQNAKIDPSECYSAVKKAGDVLDTVVEHPPPACSWAQTISMSSEFVQVKDHPVSYDPYSGNLVDAIFPEGKTFDTEHHTIYDSGYWVIGESLDPEKYTQFEHGFGVIYFPDDWNPRELLIENARFWSERFRERDFVGACRLKFRGEEGVRFRNGEWFSFSFVEERHKSYFVWWSNLSICRSAESRVKIADTYENEHHTVESLAALMFYDRCQSSLSKLRNNMALTPLDVSYLAQTYPGVGPAYIITNTGLKMFLSHYELIKKYSTYDGQSIGKTSAEKNVIFGNWTVRSNITHGPNGLILKGNQLIFPAFSEMRSQIETELTQEITLEEVHITEIVNGTHKIMTSFDTIHRNPDQIDVLHVVQTGVSSISRWIGSIGAKIVTYTIVIVVLSLTAYLAGLLAKRYCRIRSQTNSQVLIPLSTIRPQIRTNSDTPMWFN

SEQ ID NO: 15937 - protein, 537 aa, unidentified
MLLQTLFFMLNVQVSFSILYPQFIGPSWSVANPSHIYCPRITTNYDASIHTKVADLLLLETSIDDHIETPGYLCHKTVYTVTCEENFVGAKTVTYHVIGAKVKKEECLEAIEEYKEGEQTLESFPAPVCHYMEKTDTSSTVITVSPHSVLLDPYTMLLIDPIFVTGRSKGNFSNTIHQDVVWVRSSVENIDVCKIGSVVSGFLFRNVQKEETRDPKNLSIQLDTGRVYHLEGSCSLMYCGENGIRLPSGEWLNVQPVTTSVRLQTFIELSPCKSELLISIDHNHGARLEDISPLSAISHVQCLNTLSKLLEGSPVSQYDISFLVQTTEGPGVIYWLKEGTLLQSRGNYLEVTLNSKDFNSGVIGSDKDGHIVIEQNRYRVDPSKELYYLPNGFTITNNELITPPGLILTSTLHNLLLHPTQLVPIHHPIINTLPTDPNILPSWKDLSTNSTMIPWLSWDGSTPWWLNWKIYVSGLLSLVTVILSIFISLKLTICLCKNAFKRKGRKQTANIEIQEGDPIPLAVFKRHTPQTNDTYTF

SEQ ID NO: 15938 - protein, 536 aa, unidentified
MLKLIFIGFTITSINCHMIVLPSRFNNSWHIAHFDQIQCPFGELDVPPELGEKIGVEIMKPSSEIISDIRGFLCHKISLLTTCSFSFWGTREVEYATKTVSISKTECESAIFNYKIKGPEIFEHPSSLCIWMDKNTVEKEVITVVDHPVHLDPYNMELVDTIFINGHTNIFEPLFIHDSSYWISESPIQISQSCPDFEIYTGVLYNTNNAKIDGFRPTTRLWTNHFRTFSFQDVCKMNFCNKTGIKFPNNEWLKIRISNSISQNYQSWTHSLPTCGTPEEINLPKYRDVEQHTVESILGIFFHSKCVETVSRLRNKQSITPFDLSFLAQSHPGKGLAYRLGPHGLESQWTNYIRARPLQNHTDKNVIGETTSGELIKFHDWYTIGNIIHGPNGIIQKGNVTLFPPHQSLRSLIDQDITHTIDHSRIHVKIPRYVQNHQDISVLQTHGPTDRVNVGEKITEKITDGFQHVSNDWQNYLFYGIITLTLLCIIVPLLKLIVMRFFDYLVCSAQPPDQRSIPLTHSSENRISRPTAQSWF

SEQ ID NO: 15939 - protein, 545 aa, unidentified
MLRGYIVALLPFVVAGVFLPEFDKNSLRPAVIHTLTCPAFIPERPNFNYDQRNNQDVTLFKPKPDFQKVVDGVVCTKIELTTQSEDFLLSSCRIVRSQRELPLSQSECDLAIAKYQRGDFLDTNYPVPDCSGYSKHIQEKVFVTVKYHSVKFDPYTMMFLDSIFSEGKTPFAYSTTAHESTLWKMTGSKPPCSEFEEIQGELMFSVNSTFSRGQDIHLWALGIQEQTFENACKVNFCGLPGTLFPNGEWFNLRDDPKSGNTSTVTERLDPCVGDIEVKTESADQELQNMFTNSYQTSMRLWCLDTLEDLNSGIPIPHYRLSFLIPNAVGLGPVYKIINQTLFTTIGHYKSVTLNKLTQLNVIGTIGNGSDFVISPDQLTPTGHDNTFDWVNGLMYSNGKWSVPIVDVLRNNIHHLLSRPLNLSTIRHTMANSVLPSISMNSDEILTIHQSNDKSSRGNWITSYIHNMHTTATLIIQIITGLFILIVVGVVIRVIVWSRVFKLCKRQSSGKSKHSQNENRIIRYIGEPLGSHSAADLETSGRVVWN

SEQ ID NO: 15940 - protein, 539 aa, unidentified
MARLLKYLIVIILVLKFVNKSHQLLYPFSKGGSWSIIEPTNIKCPNPYQVFDPEIHVRLDEYTANEYSFSSIPVVPGYLCHKVRHFVTCTENLFGSKTLHRKISPDKISEGECLEAVNKYKQGTLIIGDQPDPICHYFEETEVSKSEIYISDHNVLFDPYTLNLLDPIFPNGRGSGKIVETIHSETIWIKSRRKTEVVCDDMIQTKGFIYQEKQYLNSTKSKSTFLQLENGRTFDLSKACKMNFCGIGGFRMKTGEWYQFTKQNKIPSMKFSENLPICELNNTIYFERDPKVNPEKISSLAISTHLKCLETVSKILEGRAISQFDISFLTQPRKGNGIMYWIKRGKVFQSQCVYSELIPNGKNSSSGVIGTDTKGNIVIEQNMDKIPGTTGTYNLPNGFMIIDGKLIIPPGLILSETIHLSLLKPHKLIPFHHPMVTKAQVSSDFPENWEDIHFNSTSSKWLSWKYHIPWWLNWKTCIQVGIGIIVCLLLLLMILSCIKSFFIKFAQSTLKFRYSREKVKTVNTLEADQSLNPMTLSEF

SEQ ID NO: 15941 - protein, 561 aa, unidentified
MAHYELHVLFVHSWMLALILITTLVWLAASQKAFTPDLVFPEMNRNSSWSVANYGEILCPTSFQSYDPKKHQILTRVLVERPSLNTDTKVEGYTCHKVKYETICDMPWYFSPTISHSISPLRVKESECKDAIAEHQLGTHVPLSFPPEDCSWNSVNTKEYEDIIVKEHPVMLDPYTNNYVDAIFPGGISSPGMGGTIHDDMMWVSKDLAVSPECSGWQRSMGLIYSSRLYGEREPMLEVGSIHIEGHRDKNLTLACRISFCGEIGVRFHDGEWMKVSVNLDHPNSVTFQVTDFPPCPPGTTIQTAVVENINPEIQELTVNMMYRLKCQETISKMVSGLPTSALDLSYLIQVQEGPGIVYKREKGILYQSVGMYQYIDTVTLNKEENQLGENSRGQKVFWTEWSDSPTRPGLQEGINGIVKYEGQVRVPLGMSLRLEAATELMWGHPVHTVSHPILHVISNHTEQSVTTWNRGVNSTNLIGLATRSISGFYDNLKLYLILALIFVSLIALVVLDVIPFKYILFVLCPPLLLCRFIKCSRRKPETRDRYHVEYNRPGQVSSAF

SEQ ID NO: 15942 - protein, 567 aa, unidentified
MESTLIYVIYFVMLPVVDSRLVVIPTTKPKHMIPVDPGTIRCPYGYIHSIPEQYYKFSVTINRPEPIIDHKVAGTACYKFKLTTKCDEDLLFSKTIKNLKANSPISKEECLAAIRKSKTTPSIVEHLPASCSWMQTIEVSIEYIVTRDHPVGFDPYSSQFIDSLFVGGKTDLLETTTVFDSVYWIADEDSIGINCPPMEKVSGYVLAPDTWNERNMFDETVTLWSSLFRTKSFSNACRMKFCNVTGIRFSDGEWIDLEFTQDKDKGKAMWIKAIKICSPDTTISLASPYELEHHSVQTVLAIFFYSKCQDTVSKLRNKFSISPLDISYLAQSYPGPGPVYQITDHGLMTYYSFYKLCNISMYTVGSDKQTLLGYSLDGKTVESPEWTESGGLTHGPNGLILKNKQLLFPSLTDLRAEIEAELTQTIEIHEIKHLTLESFKNTINTSTVEYHHNPDRINVLEVTRTGIAQFSHWLSDTWGSMFHSTFNFTIVGFIILTLILLGYRLYKHKRRFNRPADIEILELQQIPQVIPRNRNRPIQRLNKRSDSNMYEDEENRMQHQEYSNYFG

SEQ ID NO: 15943 - protein, 571 aa, unidentified
MKKTTEFTWPLKMYSSKFLLVTLSILVPRVISLFLPDYNPELFKPAVIHKLTCPNLSATSQINKYASMDTIYVNLGRPKPNFKVTVEGYLCTKIVLQTVCEAFLFSANEVNHIRKEAPIDKSECDSAIYRFIKGDVIDETFLPDYFSGYKRTVRQRIYIKVITHEVSYDPYLEKYVDSWFPGGATPYNYSTTIHDSTLWKMKGQKPPCTDFETINGEYTVLPDPKDLEHPLRFIWALGIKEKSYKNSCVVKFCGRPGILFEDGEWFSISTPESPTNYDVFITNLPACNSSASIKTRTVEQEMDAEFSNEYQLNLRFWCMEVLQGLTSGSILPQYKLAFLTQNSPGLGNVYKILNGTLMVTVGHYKKVKLNQLDSLHEIGADDAGNPVYVTDTQLTPGPIPDSYEWINGLVFSDKRWSIPLVDLVRNNLDNLLTMPLKLQAIEHSAASFMSASSSHLIEGDVITQYGGPTSKHDNWFVNYTTKSWEWLHWIVYIGVIVGGIFVLIILEKLGCYKIVYYLLKKLCQSKSSKKTKQPKVEYKKASSNQAQQIESRHEVIPQEDSVIVSLDRFDW

SEQ ID NO: 15944 - protein, 534 aa, unidentified
MRAIFYMSCVVFMVVVFGDIIYPVDFSHQLLPVVPDNVLCPVGHLHSYPEARNQYKIAYSRLSGFGEFKIKGKLCHKFILTTICDEDILWSKSITYTIQNARIDSSECFIAIRKAGEVLETIVEHPPPSCSWAQTVSVSKEFIQVKDHPVSYDPYSGNLIDGIFPDGKTEETHHETIYDSGYWAASEDIDSDKFTQMEHGYGVLYFPDNWDPRDLIIPEARFWSERFRERDFVGACRLKFRRTDGIRFRNGEWFAFNFIEEAHKSYFIWWSRLDVCRGEDLKLKIADPYESEHHTVESLAALMFYDRCQSSVSKLRNNMALTPLDVSYLAQTYPGVGPAYIISESGLKTFMTQYELIKKSVVYERGVIGTTSANKEVRFTNWTERSNMTHGPNGLVLKGNKLIFPAFAEMRSQIETELTQEISLEELHRSEMINGTHRILTSFDIIHRNPDQMDVVHVVETGIKSAKKWAGAVGTKIITYIIGCISILCITYLVGILIQRYYRSRSPRSDSPNLIPMSSFHTERNSPNPNIWFH

SEQ ID NO: 15945 - protein, 614 aa, unidentified
MNRYILPILMSALLTSGMGALLPGAFRIDPGTWRGATEFEPGNERSKLVFPVYDRCPWKPVDLNQLKCPVGGQVYPGLENPSTLSMPLSRPFYKDTQRYGGYLCTKYRLTTTCESNWAAVETVTHMTQHIPIQVSECLKANMDKEGVDHKDILEHPLKDCSWWTTKSVYKDHITVEDHPVKYDPYMGKYVDKLFPSGYYMGPGINCVQPSKVWIPLSSADPAECAHFQNVQGTIYFKAKTEITPEEIIKAGILWTDVTREKKFEHACSMQYCGHPGIRFQDGEFFSLIPPDNMISFTTDLLNSLPVCNPDLIIKLQDPFEEGHFSSNVGLAEIFLMKCHDTVSKLRNCEPVSQVDVSYLGQNFPGHGLAYKWVNGTLYDCMVDYIVGYLGDNNKKIILSHGGTKNHIPAGYVYTDWSQGAKGDISIGPNGMMNITGVIHIPIDTLFREYIHDELTREIGFHNVTHPDLRPIVDISPEDIEWIEQAVTAKTGEQAPGLVGYVKGHWHTWAIYVYVWIGLMGGGLVLYLLLAYPELRRFLKVTFICLFGWIYLVPKGCCYCVCCLTKKLNRSVHAAHQSDQRDTLGEDQRYTKVKFVRTYPPRGLPGGQPMITFTQ

SEQ ID NO: 15946 - protein, 530 aa, unidentified
MHSLSILILSSIIFQIIQNSNLVVVPKSLNLKWTAIHPELLKCPATKIHFYPLAEYSYNITITRPTFDEQQRAEGILCHKFELTTTCYVGWLGSQVVTKSITASKIKISECQEAYRKYAEGDYESGEHPAADCSYFSTTPVTKIHIKVTPHPVHVDPYSDMLIDPIFPSGRIGFNQHTTIHDSAIWFMTSDINRDICKSLDPIEGILYFPSELAEPRHLHDGAIIWSDEFPEKTFKDACRIKFCNHVGIRFNDGEWLMLNFTDAVDQSKNIWWSNLPACRPDVVLRTASVISDIRHRFDSALELLLNLQCINTIQKLRQRQPITVSELAYLIPLNPGPGNVYQLTPQGLLVGQGLYVGSRRPLVDYIKLTQNYSKWHAVEDVLIGPNGLTKSRNGTVRLPEVLTLRTEVHADLSVPVHFHSYNHNPSIENTSFVNESINYLFHNPSLKFNTSFISTEFGELWHSLSNPFKTIYSKVLYGIVISVLLIIVFKSRKEIWNLLFNRTNRKNHSAPVNEMPLAVLPSRADPWND

SEQ ID NO: 15947 - protein, 544 aa, unidentified
MKKTNRNHKLYLAIMEQLKPLIRIHILLTMCMIQSTLTEIAYPSQLLTNWVPANYSSIKCPTTIYHLNLEHQQDKIPVEILKPTSIKKLRIDGFLCHKVVKTTHCNENWLFISEISHELKTAKILKSECSDAIINYNNNLNVDDDYPLPSCAWNMFNSVSRTIIHVIEHSVRYDQYSMSYIDNIFLNGHSVDSFSNTIYDSTIWKAKEENDIDKCVELSPEPGFIYQLDNNWFIWGETVKEQSLSEMCELTYCGYHGMMSKKGEWIYINSTSNLIKTKDILNPKLSCKNRVNIRKEYKSQQTNTGIMNTMGLIMKMKCQDIINKLLISNQISNNDLSYLVQQYQGIGPVYRLENKTLNVATGIYKIVRTDEMNNQSRLLGSDLSGNNIYLKDWVKVKDNLYYGINGIMLYNDKIILPLNMYYSYDINRELRHEHKLRTLPHPVITILQNKTLESNLIFYHQPNRTDIVVTLYHISEKLSSKISRYVGRIFSSFNFVSVLIYTFFLLTVMLIIIKIHHLIVKPSFDQHQRSNFVDSNKKNQNSWI

SEQ ID NO: 15948 - protein, 548 aa, unidentified
MKKTNSNLKRFLLSVNINYVNIKMELKHLSIFLYINISLGSEIVFPTKILSNWHIANFSNIQCPFHVQHLNLDHQPLKIPVSIYRPHSVNSLKVNGFLCHKVQKITHCNENWLFISEIKREIRPVRVTSQECLNALESKKLGRLSEESFPLESCAWNTVNSNSNDIIYLSYHPVSYDQYSMSFVDGIFIGGSTKEYNSRTIYESTIWIKDDNRNLRDCIELNPETGYVYQYKSHWYLWGETIKEQPLNHVCELRYCNRTGWMFRNGEWLTLNITKNDDLHYQIWNSHLEKCPETMPIKFAHEFDHTNTGLNMMLGLVLKLQCADVIEKLLSLNQINQLDISYLVQQYPGIGPAYKIEDSQLFTATGMYTVLDTRNLNLKENMIGNTLSGDEVYSDFNMVSTNVSYGINGLIKYKGRIILPLSSVYNYEISKELNRNLKMDCLDHPMYRIISNTSFEYSEMMFTKSNKTDLSTSIVTLVESFGNKLGAWIGNVFSSFNSLSIILVVTILLSILILLYKMVKFGVSYNQQQSLKRESNTLLRDSHQSSWF

SEQ ID NO: 15949 - protein, 508 aa, unidentified
MKSIIALTLISQVISYPLFVPTRLQGWHDVKLDTLMCPSYASELNKEAAWPQIGLRHLAATDHYEVTGTICHKTTWVKTCDFRWYGPRYITTKISYAPATGLECQQAIVKASKDELETPYMPEANCNWATISDNEKTFITVKKSNIFMDPYNMVYVGTILKGGKCASTVCPLEMHGGIWIPSEAPRESCKLGNSIISHINPNNASRLVTEASYLVTEYRRQLPFLGACKMSMCGEVGMRFKSGEWYKIESSDGRVLSFFDSVPMCNGELTVSVHDSSTTYHNLNQEILDLSAQIACISELRRAKEKKAVSNYLLSFLTPNHGGFGTAYRVLNGQLQASKATYARVKLGDLPTATKWGQLDDGSAYSSEDVTGKIFDGPLFNGNRMDNGTLRVVQNAILGQTLEDEDLYEHSAKEILHPHLTVLSSNESDVLSAFRPVGAQGDIIHAVGEWVGTGVSGFINTIVYLVIFCGIIFLLYRCLPYFLKKRKSQSTSQMTPQMIPLQQYQFVP

SEQ ID NO: 15950 - protein, 537 aa, unidentified
  VARIANT 477: note = Any amino acid
MKKTNNASTDIMMNTLTFCTLVLSVVLTVRGFSLYVPTQIQEWHNVGIDDLRCPSYAMAAEVEASWPVVELTHLEHSDHIDATGYMCHKTKWIKTCDFRWYGPKYITTQIKYASLSRSECEDALVQSKDGTLTAPYMPEANCNYAKISDNELSFVTISPLKALLDPYLMVYVSPIFKGGKCYSQTCSAVEHQGLWMSAQPPSQICKLTKTASSHINPNSASTRVTALSFLVTEHHRQVPLQGVCKMSVCGSEGHRLVSGEWYNIQTNDNRASRFLNSIQPCPSNSIISIHDSSETYHHLAQEILDLSGQIACMAELRRAKEKRLASNYLLSFMMPNHAGLGTAYRIQEGGLQAAKVYYQRLRVNSHYIMDNWGQLDDGSVYTSTSIIHHKENDNLFNGNRVENGTLVLIHNAILGQTLDDEDTFEHEVRPLIHPHLSIVISNDSDIIKDYRPTGSSGDVIHQFTEWVGAGMSGLVHXIVYFVLILLLGVVIYKCSPLCFRLTKRTKVPERRSPVWRSSRGAPREEEDMEMGMMFSNN

SEQ ID NO: 15951 - protein, 509 aa, unidentified
MSIISYIAFLLLIDSNLGIPIFVPSGRNISWQPVIQPFDYQCPIHGNLPNTMGLSATKLTIKSPSVFSTDKVSGWICHAAEWKTTCDYRWYGPQYITHSIHPISPTIDECRRIIQRIASGTDEDLGFPPQSCGWASVTTVSNTNYRVVPHSVHLEPYGGHWIDHEFNGGECREKVCEMKGNHSIWITEETVQHECAKHIEEVEGIMYGNVPRGDVMYANNFIIDRHHRVYRFGGSCQMKFCNKDGIKFARGDWVEKTAGTLTTIHDNVPKCVDGTLVSGHRPGLDLIDTVFNLENVVEYTLCEGTKRKINKQEKLTSVDLSYLAPRIGGFGSVFRVRNGTLERGSTTYIRIEVEGPIVDSLNGTDPRTNASRVFWDDWELDGNIYQGFNGVYKGKDGKIHIPLNMIESGIIDDELQHAFQTDIIPHPHYDDDEIREDDIFFDNTGENGNPVDAVVEWVSGWGTSLKFFGMTLVALILIFLLIRCCVACTYLMKRSKRPATESHEMRSLV

SEQ ID NO: 15952 - protein, 508 aa, unidentified
MSIYYATLVVALASNCLSIPIFVPQGLNISWQPVVRPFDYRCPIHGNLPDTFGLKSTKLTFRSPSVFSTEMVTGWICHAAEWKTTCDYRWYGPQYITHSIHPIRPTIEECKRSIQQLESGTSEDLGFPPQSCGWASVTTVSNQNYKVVTHPVHLEPYHGRWIDHEFIGGECNAPVCEMKGNHSIWLTDHTLQEECNQHIEELTGVMYGNVLRGDNLYVNNFMIDQHHRVYKFEGACRMRFCGKDGIKFLRGDWIEKQGEIVKLYENIPNCADGTLVSGHRPGVDLIDTVFNLENILEFTLCEGTKGKINRQETLTSVDLSYLAPRIGGFGSIFRVRNGTLEKGSTVYMRIDVDGPVIPELEGFDPRLNRSRVFWDDWELDGAIYQGFNGIYKGQDQMIHIPLNMIESGLVDEELQRSFQADTIPHPHFSDEGVSDEGIFFDNTGENGNPVDAVVEWVSGWGTSLKFLGMTLVALILLFLFIRIIIAVIYCLKRPKKIQAESHEMRSFV

SEQ ID NO: 15953 - protein, 508 aa, unidentified
MSIYYALFVVSLAAGCWSIPVFVPQDQTIAWQPVVRPFNYQCPIHGNLPDTFGLKSTKLTFRSPSVFSPGTVSGWICHAAEWKTTCDYRWYGPQYITHSIHSIRPTIEECKRSIQQLESGTNEDLGFPPQSCGWASVTTVSNKNYKVVVHPVHLEPYQGKWVDHEFVGGECNAPVCEMRGNHSIWLTDHVLKEECNQHIEATTGIMYGNVLRGDNLYVNNFIIDEHHRVYKFNGACRMKFCGVDGIKFLRGDWVEKQGELARLHENVPDCSEGTLISGHKPGVDLVDTVFNLENILEFTLCEGTKAKVNRQEALTSVDLSYLAPRVGGLGSIFRVRNGTLERGSTIYMKIDVESPIVPELEGFDPRTNQSRVFWDDWELDGTTYQGFNGIYKGQDQMIHIPLNMIESGLVDEELQRSFQADTIPHPHFSDDSISDDGIFFDNTGESGNPVDAVVEWVSGWGTSLKFFGMTLIALVLLFIVVRVVIAIIYCLKKPKKVSVESHEMRSFV

SEQ ID NO: 15954 - protein, 513 aa, unidentified
MDFKYGIFILLCLLGSTNCNYVLHWPTEKVDGWHPASHTQLRCPIRTASHPITERRGSVSFLVPTFAYSTHVDGYSCHKTEWVSKCTETWYWTTDISQIIRTAPVSKEECLEAITKKESGISQTPFFENPVCQWVNTVEKSHFFVIVNKKKVKIDPYNLDAIDSLFPGGRCSQDEDGAYNCPTIQAGVKWMTKDPDDYKIRWSMIRADYSYEESTKKFVLWGGGLPTTYFNGSCQMTFQKQTGVRFPNGFWAMPPERKWTDTDFVTMWNNLPACKEGTEVYYPNAHEEFSEHGMEIDDLILSLKCLDIIREFDETGKISFLDLSFFSPDKPSFGHVYRLNEGKLEVATTNYGSCVMKSGHEYSGNELCHDTNDRVISYRDWVPSGIQGRMSAFNGVYKDNGKIRHAGYQLWANRLTESDIQRYQMARVSHPIENVISKLVPGLNVTFDATGQRGELVDDFLSGVSEGWRKFLKYGAMTLILLAVLLLFLFMCNLLPKFKPKRPALERYAMTEF

SEQ ID NO: 15955 - protein, 565 aa, unidentified
MTLNVRILFFMFLISKIWGLEYMYFPTSLKSDFRPIHLDHLNCPYDIDDTEIENPVEVNCKILVTNLIDLDGEVCYKQRWITNCHENFLGQQTIHHSIEHLTIDSNDLKKKLPLDKNLLPPDAECKWLSDTETSDIRTICQPVTIKYDETLMAGSHPSLGTFHCPSPPCKIDDQHIFVSTNVSTTQKGYKDIKVKFSTDKGGFIHDTSFVKSSIFPKLSLEGACVDLTKSPSNNNHFAKIILRSGLLLELKDPFDLGAGKSYRDGESIHVNHDIVNLKKLLLRKYDKTSIWGQTMFNQNSRSKMTFSNDVTGRFKQFGKLFVDLRICQIQDFNRIMVPTIDFQRSMTEMFVESKVDQLTCKRRLYDIMSSGIISGADLGLLAQNHEGIGPVYHIYKNDITVAYGNYERFTWEPKVQNGTRFLGYVHQGDNKRWIECPEWVKDPEHKGLEWCVNGIFSRNGSLYHPVFGGDNIEDLKIAYQTKNLRKVDHVSLLLRIENRNLTRWEEFFNLKSKRNFFGIDRVTNWFDGLSKEIKYIIWSVVGILALIMIIRVLRSRHRSNTYNHY

SEQ ID NO: 15956 - protein, 552 aa, unidentified
MFFTRIVFLIISILVPLIICKESIYFPVKIKHEKFDEIPLSKLNCPYDIDDTELRNVVKFQGKILTLNQIDVHGKICYKHQITSKCSENFWGKQDYTHAVDHLELSTSEVNKTFENRDLIIPDVKCQWMSDAISVLTEIRCDPAEIKYDESLQIGYTPTFGGFKCDSEKCQIDKHHVFLLDKKRDLTKGYTVAELEFSTTDRQTVTPESFVKSNYFPKTSLLGSCVSGEEVGNKMRYKLITKNGLLIELDHNADKYGDKYTNNNLHEHHNDEDIKHLIGKKFKKNDVWGQIMFNSDGKTRYTWSGQNLDPFHKKFHKILIELRLCQINDFERVRVPALDYDRVMTEMFIESKMDQIECKKNLYRIMMTKKVSNSDLSMLAQNHHGPGVVYKIVGGKLLAAHGAYKKIIWSPNENRIGLDAENNDTVVCPKWENDPENDGVQWCLNGIFRRNNNVYHPVFGGDNMDDLKLIFEEKELKNVDHISLINLKKDSWKEHYNLESTTKFKGFELSFDFFKKIELTILHWAGIGLGLLFLLLLIKKCLQKKNNDHFIP

SEQ ID NO: 15957 - protein, 554 aa, unidentified
MLPSTILLIVISIQLSVGIEYVYFPTQMKTDFKPVLIRDLSCPYISDDSTLGPSIKTTAKILKTNLVTESGKLCYTQKWITKCEENFFGVQTITHHIIDLPIDKHPSSFEENPTFPDPNCRWMSSDTTEKINTICKEESLRFDTTTGKGVDEQYGTFTCNEEFCRLDKYITFKPHKNVTQTYNDGFQYVEVEISLDPDHYVIPSSTIKSKHFPKMTFRNACTQWVHQSSNQYFIRIIFNNGFLIEFYDKYNLIDHKSVKEYLTKKVDHVDRIKEILGAKKSKSNEIPKFSDQKWININTHLREFPHTGKFIHLLSMLRTCEDSDIAKVKVPTLDFQTTDAEMYIESKIDQIFCKHRLYEIMTKGKISLNDLGLLAPNHGGVGPVYHKYKNDITRGIGIYRKIIWDPNPKDDVLGYYTENREKKIVKCPEWVNGSHALKWCVNGIFKLNNKIYHPYFSADNFDELIQSFMEEDVRLAEHNFILHNKNRNITTWEDYYSLTDNYSWKGFELSWLKGFKNIGFFVSIIFGTIISIMIMSLILKCVYPGRRRQNRIDW

SEQ ID NO: 15958 - protein, 539 aa, unidentified
MKKTTSVTMNQLIVFTVILSVAACDYIYYPVKIQTPFKAVPLSNLQCPRHPSERTLRNSRFGKGWILKQNIVDVPGLFVVKQKWKTACHMNFLGIKTIKHEIISEELTATDFTNYTTTPTFPNEECNWMTDTVKETTHFIASRGTLAYDISTGRTADPVYGTHLCAVNYCHLRKDVIFRSDETFKIKEYGFKEILYEVELDQNHQVTESSVIQSRDFHPLSIRGACIDEQNLGGRKFSLIFPNGFYLVLDIAVKSGGLNIRYQTGSDLVARASHRLTGSGGTPVRGVKDKDVVVKTDVSDRGCSSWCSAINGLPVCPTHARHHIRQTGMLSMEFQQERRMLARVESFICREKLHEVRTTKKINAIGLGMFVQRHGGPGPVYRIKNQTLESATGIYKRIFWEPRDDQIGMYYNGTEEKKVTCAEWITDRNGMSCINGIVKYGNKIIHPSSLANTAPEEERLFKKSELIDAYHVPTKAVNPWADWNPMHPPEASRKFIGWNFPDFLGPMKLYLEWVVVGIIGILTLMMIVSCNHRRTRHYY

SEQ ID NO: 15959 - protein, 568 aa, unidentified
MKLLIIEFFAIITSFFASRCLSLEYMYFPTSVTKGFTPIHLDHLNCPYDIDDTEIENPVEVDCKILVTNLIDVEGEVCYKQKWVTNCYENFIGQQTINHRIHHLPISADDIVHKLSLDSNLVPPDANCQWMSDTETEDTKVICQPVTIKYDETLNLGSHPSLGTFPCVKPPCSIDKQHVFNSTDFTATNKGYKDTKVQFSTDQNGHIYETSFVKSDVFPKMSLEGACIEMTKSASNNNHAAKIILQSGLLLEVRDAFDLGSDDSYATGNSIHVNHNLAELKKLLLKKSKKNSTWGQVMFDQNSRSKMTFSSDVTGKFKQFGKLFVDLRICQKNDFKRVVVPTLDFQRSMTEMFVESKIDQLSCKKRLYEIMSTGSITGADLGLLSQNHEGPGPVYQLYKHDVTMAYGTYERFTWMPKTEGGKQYLGYVHIGNTKKWVECPEWVPDSESTDIKWCVNGIFERNGSLYHPVFGGDNIRDLKVAYQVRNLRKVEHLSLLLQTNNRTISNWEEYFKLESKHTFEGWNRVSHWFKGLSDEIKYIFYGLSFVFVLFCIVRLLRWRHRSQLYLDY

SEQ ID NO: 15960 - protein, 539 aa, unidentified
MKSQFKPVKIEDLSCPYNQFERDHNNDLKIDVEILKNNLITKTGNLCYKQKWITRCEENFFGIQTLNHSIIDLPLDDHPTSSDSNPLFPPPDCRWLSSSEVSRDYIICKQETIRFDEVLGIGVDEQYGTFKCGEKFCRPDKYITFLPIGGVDKMKLEGFEKVKGYLTLDQDGFVTPSSLIYSNHFPKMSLEKACLRWVEKETYKYDVELIMNNGFLLRLPLNLVFKERGKPDTPFKPVVETNMIGHKYQIHDVLELLLARAKGTNQETKPFGFTRNNKWLKLDNGQKFDDYFGKSKPLAHLLTMIRDCEEKDVQKITIPTMDFQTIEAEMFVESKIDQMFCKHRLYDIMTKKRANLNDLALLSPNHGGLGPVYHRYAKDITRGIGLYRRINWQPSEKGLGYYFQNGSQIWVKCPEWVNGSEGFRWCVNGIFELNGKVYHPYFGADNFQELIKSFEENEIRKVEHNVILHDMNNRIHETWESYLGTKEDYHWKGINLGWIHSIQEWAKNIWIIIIVILTVFALLMLIKLTRGKRRNRHDW

SEQ ID NO: 15961 - protein, 552 aa, unidentified
MILIKIFSIVVITLFTFGSGKESIYFPVEIKEEGFQEIPLKKLKCPYDIDDADLINPVRFNGKILVRNQIDVQGRVCYKHQITAKCSENFWGKQDYTHDVKHLNIGKEEVDSTHQNDAFLAPDVKCQWMSDTDSTVIKIFCDPLVIKYDESLQVGYTPAFGGFKCDAEKCRIDAHHVFLLDKNRTLTKGYKAAVLEFSTSDKKTVDQNSLVKSNYFPKTSLIGACVSGDEISGQMSYKIITRNGLLIELDHNAVKHGKAFNKGSIHGTHSSNDIKNLIGKKFEKGGVWGQTMFSDDGRASYTLSDDSLDTFHKMFHRILVELRLCQKNDFERVRVPTLDYERVMTEMFVESKLDQIECKRNLYKIMTTKKITNSDLSMLAQNHHGPGVVYKISQGKLLAAHGAYKKIIWSPKGDRLGLDFENNQTVNCPSWEKDPENPDVEWCVNGIFRRNNLVYHPVFGGDNIDDLRLIFDEKILRNVEHLSLINVQKNTWEEHYNLTSSTKFKGFDINFDFLKNFESNIIHWVVVGFSVIIGLLLISKCVSRRRRDHFIP

SEQ ID NO: 15962 - protein, 534 aa, unidentified
MDKLIILTACLLGVVIASHDYYYFPVVQSKSFKKLPVGQLRCPPHSSEKPLSHKKIWGGYVLTQNIQTMPGTFVVKQRWGTTCTMNFWGVKTIRHHIIDEQILDARFTNITLKPVFPDEDCSWMTTATREITYYVGTKGELEYDISTGKTSDPVFGAFSCTEKLCYVDHRVVFIPDVAIAATSKGFKFVVFEISTDPDGVIRENSVIQSRDFPRMSLRKACVTEESVLGQRRLAFILRNGFFLVLEMGVKSGSHMLKKSTETLGSELILRASLRLSNDKFKGRDLSMLYTQEKISGAGSIDNLLNGFRVCDASDRSRIKQVGLGFNSLEQDERIMSRVDSLFCRVTLDRIRKCKKLTSVELGMFAQNYGGPGPVYRIKNDTLEVAQGIYKRIFWDPDTKNRLGYYVNETTEKEVNCPEWIKISEGFESCINGIIRYKNVTSHPLSPVNDLEQEEALFKEHFLEDVYHVPTQHLNPWAGWNPLHPPEIDRHFLGLKLPNIFGFMHNFEIYLVTFIVGLISLPLIIFCCRRKSSRY

SEQ ID NO: 15963 - protein, 565 aa, unidentified
MLLSTIIVIFSLILPQCWNLEYMYFPTKIDGEFNPIHLDHLNCPYDIDDTEIENPVEIPSKILVTNLIDVSGEVCYKQRWVTSCYENFFGKQTIHHKIEHLPVTQDDLAHKMSLDSNLVPPDANCQWMSDTDTEDSKVICQPVTIKYDETLNLGSHPSLGTFHCKTPPCSIDSKHLFVSNNITNTQKGYKDVNVKFSTDKNGHIHETSFVKSDIFPKMSLEGACVSMTKSASNNNHAAKLILQSGILLEIKDAFDLGSDDSYNDGTSLHTQHDIANLKKLLLKKFKTNSFWGQTMFNLNSKSRMTFHNDVTGKFKQLGKLFVDLRICQTPDFNRVVVPTLDFQRSMTEMFVESKIDQLSCKRRLYDIISSGSINGADLGLLAQNHEGPGPVYHIHGNDLTMAYGKYERFTWMPGTVGGKQYLGYTHKGDVKQWVSCPEWVQDKENAGVRWCVNGIFERNGSLYHPVFGGDNIEDLRIAYQNRNLRKVEHISLLLQTENKSLSTWEEYFKLESKHTFEGFSRISDWFNSLSTEIKYIIYMCCTILILFIVVRLLRRRHRAQMYRDY

SEQ ID NO: 15964 - protein, 548 aa, unidentified
MDCLILFCLLTLTSGLEHMYFPTSMSTDFKPVPISRLNCPYDIDDTRFNESEAIPGKLLVTNTAKLPGLLCYRHKLISRCSENFFGHQTYSHQVDHLLINEADSLEVIENDARMPDVTCKWMSDVEAERVVTLCDNLDIEYDVSMEIGLHPTLGSFKCSSEKCSVDQFHVFKPSNKSDVIKSYTPVSLEFESRDGVISQDSMVKSDLFPKTSLRKACVTMESKGKKDKLKLITSNGLLIEIDEEFNVDRSSYGTWSKSSVHDPHTEEEVKHFVAKKFDDKGVWGQVMFDGNGKARVKVNRWTDKHLRTFHKLLFDLRICQKNDYDRVKVPTLDYNRKMTEMYVESKLDQYECKRKLYDIATSNIITHADLGLLAQNHEGVGPVYHIYKQDVTVGFGRYERLIWDPKGDELGYTEKDGKKSRVKCPEWVPDEVDQNVRWCVNGIMNRGDSYYHPIFGGDDIEDLKKSFEEINLRPVTHISLVMKDRNSTSWSDYYKLKESTDFRGLTEVTNWFSTIGMEFKLYFLGGLTICISVLLLLSCCRRRPDYRY

SEQ ID NO: 15965 - protein, 531 aa, unidentified
MAAKLLIVISLCGLVLGDYIYYPVTIQTPFKATPLSNLQCPRHPSERSLKNSGYGRGWILKLNIVDVPGLFIVKQKWKTHCFMNFLGIKTIRHEIISETLTHDDVKTFTTTPTFPNEECHWMSDTVTEKTYFIASRGTMAYDISTGRSADPVYGTHLCSMHVCHLRSDVIFKSDEEFKIKEYGFKEVVYEAELDENKQVTESSIVQSRDFHPLSIRGACIDEQNLEGKKFSIIFPNGFYLVLDIPIVSGGLNIKYEQGQDLQKRASMRLKGTGSGPLRGVKDVGVIFNTKVTDSKCGMWCSAINGLPVCETFARHHIRQTGMLSMEFQQERRMLAKVESFICREKLHDVRNRKRINPISLGMFVQRHGGPGPVYRIRNKTLESATGIYKRVFWEPTDNRIGKYYNGTTEKEIVCKEWIQDENGHSCVNGIVRYGKKIIHPSSLANTAPEEERLFAESELVDAYHVPTKAVNPWADWNPLHPPPSHRKFLGLHFPDFLGSVKYYLEWILIGSLGFLLMLLIISCRNRNRGYY

SEQ ID NO: 15966 - protein, 550 aa, unidentified
MKKTLVFALLWSIVATYEYIYFPTKLLTDFKPTKTEHLNCPYDIDDTEIENYVKIKGKILKQNLVNIDGLLCFKQKWTTKCEENFFGHQTYSHKIDHVSIDDIPSNYATKEEGESPPDVDCKWMSESKAEDTRTYCVPTQIKYDEMYNIGMNPTLGSFKCNKNVCRVDNYHLFKSNITDLDKGYQDIELTFSVDENKHVTEDSFVKSSSFPKMSLNGACIDFVTKNSKFDFKMILASGLLFEFNTQFDFGNSDKYSSNVHVLHNLDDLKKLLYKKGSNEVWSQYMFNENGKAKMRVGSDVTGTLKTLHQILVNLRVCQTNDYNRVKVPTLDFQRTITEMFVESKIDQLSCKKRLYEIMTENKISGADLGLLAQNHEGVGPVYHRYKNDITVALGKYERFYWSPSNSSLGYTQHGDKKEWINCKEWVPDEVNSEIKWCYNGIFKRGDKFYHPIFGGDDIEDLKIAFQEKDLRKVDHISLAMLDKERNKEKWIDYHKLETTYKFTGLEKINKWWESLSEYIKYSVYGIGVIISVYSLFKIFNRKKYNNRRFL

SEQ ID NO: 15967 - protein, 547 aa, unidentified
MFSFVFMCLLVSGYGYEHMYFPTSMTTDFKPVPIDKLNCPYDIDDTYFNESIAIPGKLLVTNTAKVPGQLCYKHRLVTQCSENFFGHQTYTHEVEHLPISSTDKIEVIENDDKAPDVTCKWMSDVVAEKIVTLCDNLEIDYDVSMEIGLHPSLGSFKCSDQVCSVDKYHLFKTSNISSIVKSYTPTLLEFEGRDGHITQDSLVKSDIFPKTSLRKACVSMESQGKQFLMKLITSNGLLIEIDQKFNVDKDSYGTWNKGIQDSHSEDDIKHFVAKKFKSDSIWGQTMFDGNGATRAKVGKWTDNHLKRFYKLLFDLRICQQNDFQRVRVPTLDYNRKMTEMYIESKLDQYQCKRKLYDIATSGKITHADLGLLAQNHEGVGPVYHIYKSDVTVGFGKYERLIWDPKGDELGYTEINGEKKRIKCPEWVKDSSDPEVRWCVNGIMNKGSTYYHPIFGGDNIDDLKKSFETVNLRLVPHISLVLKDRNSSSWVDYYKLKEYTDYRGLTQVTNWFNSLGSEIKYYLIGVSIILLSLILLLTCCRRKSQYRY

SEQ ID NO: 15968 - protein, 567 aa, unidentified
MSLLGLAVVSFISILSNVGSVEHLYFPVEMKSQFKPVKLEDLTCPYASDDMGFPSSVKADVQLLKTNLIRVPGTICYRQLWTIKCSENFFGVQTINKDIKDLELGHFPEKGDDKVYFPDPTCRWMSESETTAEFAICKDEEILFDETTGLGTDNQYGSFFCQKDYCPINKYVGFKPKRPLAEIIKEGFMDIEAEFSVNSRGFVDIHSLTRSHHYPRMSMKNACVRWRDHESKKKFDLILNNGFLIRFKSEFDIEVSPRLESNWVTKDYNTDDEVKKLINAKSHPNHGTHFSFQRDPWAKISDSVIKKEKFKFAHLILSLRNCEKEDDKRIKIPYIDFQTTDVEMYIESKIDQIACKRRLYEIITEKKFNLIDLGLLAPNHGGLGPVYHSYSKDISRGFGHYRRIIWDPQPEIGILGYYFDGGEQKNVTCPEWVRKNHSLSWCVNGIFKMGGKIFHPIYGADNLEELKIAFEERDVRSVEHPAILHDLHNREATTWKEYHKVTDDLRWKGVNLGIWDFFDSVIGKIVACALGGLMFLILFWVSASVIMRCCVKRSFHNPNAKRRSEEW

SEQ ID NO: 15969 - protein, 538 aa, unidentified
MKSQFKPVKIEDLSCPYNQFERDHTSDLKIDVELLKNNLITKTGNLCYKQRWSTKCEENFFGIQKLNHSIIDLPLDEHPSSSDSNPLFPPPDCRWMSSSEVSKDYTICKQETIRFDETLGIGVDEQYGTFKCEKSYCRLDKYITFLPIGGVPQMRLEGFEKVKSYITLDQEGFVTPSSLIYSNHFPKMSLKESCMRWVDKGDYNYDIELITNNGFLLRLPLNINLKAKSGAILTPTIENNHISHTYHINDVIELLLARAKGIQKERKLFTFTRNHRWLKLADNSKLEDKFAKKDTPFIHFFTMIRDCEEKDEKRITVPTMDFQTIEAEMFVESKIDQMFCKHRLYDIMTKGKASLNDLALLSPNHGGLGPVYHRYANDITRGIGVYRRINWHPSKEGLGYYFKDSKQVWVKCPEWVNGTDGFRWCVNGIFELNGKVYHPYFGADNFQELIKSFEEDEVRRVKHNVILHDLGSRSHETWESYLGAKENYTWKGFNLSWIDSIRKWANNSWMIVVGVCSGLGILLLIKITRGKRSGGADW

SEQ ID NO: 15970 - protein, 685 aa, unidentified
MKKTTRRSSSETMILLIHLPVILTTLTKLISGDLINFPFHCTNLENIKYSNLSCPTVWETFKIKTGDKVERGSMCRPSLHTHDLEEGYLCYKDTWTTTCDESWYFSTEVKYKIIHEEVHDIDCLDALIEYKVGKLKAPFFPVATCYWASSTTESITFMMIKPHNAPLDPYSNRIVDPIIQADSGDNLKIYRTTFPKTRWIREVNTTLEERCNVATWECHDMTLYSGWLTHPSGAFKTSLRTGLVVDSQIMGHILLRDTCKMDFCGRRGFRFPDGGWWRLTTENEVSLQDFELNDTVVPKCDDRSRNHVGYTDLDYNPEKIALEQKSLLKTTMCREKLAELGQGKGMSLYDTTYLIPNAPGRYPAYYIYPVGLNKTLETQILKEKTISNPLTAKRKEHMPIMLYMAQCHYTLIEFPNLDSTGTLRYTSLEDPVGTILESGKNVSLADLGFEDINLDNTTCKGNDSDCFNTTTPKEPLLDRKFNMTNHTLPWRRYSKRELHHRVTYNGITHSPVGHWVQIPYGASLTANLPEHLIEKHSTHFFDHVTKQSIFERELQNGEISIDDLEQLIGRKTNHTDLPKKVRNWVQNAKESVVGIFREFGHTIRLGLSIVSFLIGLIISFKVWKKCRKNKKETQQQSRSSPIYRPQNIYELEEGPISPPPLARQREHDNSNIFRKTDPRNPFYSR

SEQ ID NO: 15971 - protein, 659 aa, unidentified
MFIKNLPVALILNCLGLTLSQLLYNYPFNCNPGPEMTLDGLTCPLDFNTFNLDNKDTIEAGTMCRPNPLSKDVEDGFLCYKDTWVTACEETWYFSKTVKNHIIHEHITKDECVEALATYKLGKHVEPFFPAPSCYWSAVNEERATFINIQPHGVILDPYSGKIKDPLIDPETCDNDFCITRSHQTHWLRNLKPDIMERCNNETWECHPINIYYGWVSKRKIQETSTTFNYVQTGLVIESQYIGHILMTDLCHMKFCGRDGYLFPDGSWWEIKYSVLHALTKDHTILHNVYNCDDRTHGDYLTDVQKSKKVGYEDLEINLEGLEMRQKSRSINMMCLNRLAEIRNTHHINVLDMSYLTPKHPGKGLAYYFSQDHNNASKYYVKTLKCDYKLIHIHDADIRGFVNISKYPEPNVTILGLQDNLTFANLGIARCHDFTQLNDSRNVSCEDSPGPFFNNNSRLSNGKRFWTRHSFGGANFHEHPGVRIGVNGIMYDLKKQILRFPSTSNLLWDLPSYYSTKHKVHFFKHPTKHNIRKNFTGSDKQDIDVLDDLINRHINRTDFPTRIRNWIGNIEDTVEHFFSNVGGTIKTMISLALFIIGTLVSIKIWRKCRKQPKNTPIIKQIKLNDYEKPHSRAEQTQDANEDLYENIETRGEIYSPFHV

SEQ ID NO: 15972 - protein, 630 aa, unidentified
MQTMKKTHLLAFTIFGQILLASSLVVNLPLRCNGRKDLLVNSLKCPLPSTEVKVDGKVKVYEGDICRPQINAKDVEAGYLCHKDIYKAICDETWYFSATVKHEIEHAPISDIECIEGLTELKLGIVPNPQFPSVDCYWNARTEEKRTYIILTQHDPALDPYSNKIKDNVVDPDCDFNLCKTNFINTKWIRDKNTTEIERCDAKNWDCHPYKIYQGWISKSEMIGWGDPTQSYSYTGLVLDSHIYGHIPMSKLCHKTFCGKEGYLFPDKSWWQIRSKTPASPLFRELTLNGSRSAFPDCETIKTYGYAEVEEDESSEIIRESAEIRHEMCLETLSTLASGYEASFRDLMKFIPQRPGPGKAYSLNSNGKPSYYNYHWAGHPASSASIQEQDCYYYLVDIPKIQDDGILNITGIGNTDVCGKLLVNGSSMTLNSLGFKIDHHYDDHIVETGTDVHDEMNIKERMVWIKPDKIHPLLWVGPNGIVIDHQHKQIHFPVFSRGVDRIPHYWTQKHRVVKYRHATQLKIYKQYLDNPEKSNPYDFNAWTGRHVNRTEIPVAISNWFSGVKDTVFDKISKIGSWLKWSFYLCFIFVLFKGGLLVWNKYKTLRHQTKRTPKGKNSQDPEKLDIFGQTV

SEQ ID NO: 15973 - protein, 658 aa, unidentified
MSSRILSVINLIAMFISASLSQLIYNYPFNCKQEINLLPFDSIQCPMDYNTFNLKSRSSVEEGTMCRPNPLATDLEEGYMCYKDRWVTRCEENWYFSKTVTNHIVHEPVSKDECVEALALFKMGQTKDPFFPAPSCYWSAANEESVTFLMIKKHPVVIDPYSGKIKDPLIDNDLCKDGFCKTRAHQTHWMRDYKTDIVERCDDKTWECHPIKVYYGWVPKIKNGTSSVTTSYVETGLVIESQYLGHVLVTDLCQKTFCQQDGYLFPDGSWWQIKISLTKLLLKNHNALEKAKTCGDRDHGSELTDEQRSGKIGFEDLEINLENIEMKQKSQTLNLMCLEKVAKMRNSQSVNFLDISYLTPKKPGPGLAYYIVEEPLMSGQTKVKVSNCQYKFVEILGSDKSGIVNVTEIGSQQIFKLLETGQVFNMSELGIPICEDHTQDNETRNITCETDFGISANRGVKGLSGKPLWTVRSFKGSNISNLRGLRIGSNGITYDMTKKILRFPQAGNMHWDIPSYYSTEHKVHFFQHPTKHEIYKNFTGDKKSDIDFLEDLIHRKLNRTDFPTRIKNWIGNIEDKVEHFFTNLSGTVRTAISLVIFVIGTLLSIKVWRRCKKQKPKTRKIDRSNQAKEENSFALDLHQNVYEDIEPNMRGHNPFHRS

SEQ ID NO: 15974 - protein, 629 aa, unidentified
MTRLSHAITKLLLLFCLTAIHAIVINYPTACHTYQEVLYQGLECPEPAISYKLDNNETVAYGQICRPQLASKDILEGYLCYKDTYISSCEETWYFTSQVKQTIVHEHVSDAECIESLAYYKSGIVETPMFLNVDCYWNAINSIKKSYLIIVYHPVPFDPYTNSIKDAVVKNSEDVNSWIRDTHYPFTKWIRDFNGTAEEKCDAQHWECFKVNLYKGWIYSPPHTKNTIGSSTQTGLILESDIYSHTLIRDLCRFQFCGIHGFVFQDQSWWDLQLNVSLSSLISTEHLSGAPDGHCKKVNEIGHAELEPNWEKILSVDDYDIRHQLCLDTLASVLGGGFLTARDLLKFAPMRPGLGPAYFLFNPNKRERAVHVWTAGATTSSILWKSTCKYELIDIPQLNDTGIITYEKLDNIIGKILRNDVGVSFKDLGFTENELTDDDVSQSQLNSSLGIYHRNTSMKGIPWKRHRASTPKLKMGPNGILHDLNAKIIHLPQASSSVFKLPPHLYEGHRVVFFNHITKKKIYEDLSKREGNDPYNVDIGDLIGRHLNRTTIPDQLHDWVSGIKRHIFSVFEQFGSLIKVVVFIIMLVLCIKIINLIYRFYKVRKSNHKKLASRKEKLHLSDPFSVNSK

SEQ ID NO: 15975 - protein, 662 aa, unidentified
MALNKLIFVILINEISTQLLYNYPFNCKNEVKLTLDGLQCPLDYNTFNLRSDELSEVGTMCRPNPLAKDLEDGFLCYKDTWVTKCSESWYFSKTISNHIVHEPISKSECIEALATYKMGKHVEPFFPAPSCYWAADNEETVTFINIKEHPVILDPYSGKIKDPLIDNNLCDDDFCPTRAHQTHWLRNLKPNIMERCNNDTWECHPIKVYYGWVAKKRPTNVGHDLNYVQTGLIIESQYIGHIVMSDLCTIKFCSKLGYLFPDGSWWELKFPLDHLLLKNHQLLENSGSCSDRSHGDTLTKDQRGNKIGYEDLEVDLEGLELRQKSRNLNLICLDKVANIRNRKEVNILDISYLTPKHPGHGTAYYLYEDTSNASITHVKAYSCNYKLIQIHGADMNGRVNMSNSEDLNITILDSGDNMTIADLGISKCKDLSHLTVNQTRNISCEKNVGFKYPEQVKLSNGKVVWTSRSFGGANFHRLPGVRFGVNGITYDLKQQMLRFPTVNNLLWDLPSYYSTNHKVHFYTHPTKHEIRKNFTGERTEDIDFLDDLIHRKLNRTDFPTKVRNWIGDIENKVVHFFSNVGGTIKTAISLIFFVIGTLISIKIWRKCKKCKGQSKRSESEWVAKKQYTAKHEMKSFPSNFKTDNIYEDVKSELDSTYSPFHV

SEQ ID NO: 15976 - protein, 661 aa, unidentified
MEGINIEIILILTMSYPILVAPQLLYNYPFNCRKGPKMTLDGLTCPLDFNTFNLDSKDNVEAGTMCRPNPLSKDIEDGFLCYKDTWVTTCEETWYFSKTVKNHIIHEHITKDECVEALATYKLGKHVEPFFPAPSCYWSATNEERATFVNIQPHGVLLDPYSGKIKDPLIDSDNCDNDFCVTRSHQTHWLRNRKPDIMERCNNETWECHPIKIYYGWVSKKKNQETSTTFNYVQTGRVIESQYIGHILITDLCIMTFCNRDGYLFPDGSWWEIKYSLYHAFTKDHTVLNNARKCSDRTHGDHLTEVQKDKKVGYEDLEINLEGLEMRQKSRSINMMCLNRLAEIRNTHHINVLDMSYLTPKHPGRGLAYYFSQDQKNSSQYHVKVLDCDYKLIHIHDADIKGFVNITKYPEPNVTILGLKDNLTFADLGISRCQDLTPLNGSRNISCEESPGPLHSDDSRLSNGKRFWTKHSFQGANFHEHPGVRIGVNGITYDIRKQILRFPSTSNLLWDLPSYYSTKHRVHFFQHPTKHEIRKNFTGSDSRDIDVLDDLINRHINRTDFPTRIRNWIGNIEDKVEHFFSNIGGTIKTIISLVLFVIGTLISIKVWKKCKRHPKKTKKVTQIKLNDYEKTYGRRDTSNNNNDDLYETIENGGTVYSPFHV

SEQ ID NO: 15977 - protein, 662 aa, unidentified
MEAITIEIIIIILTISYPILVAPQLLYNYPFNCKKGPKMTLDGLTCPLDFNTFNLDSKDNMEAGTMCRPNPLSKDIEDGFLCYKDTWVTTCEETWYFSKTVKNHIIHEHITKDECFEALATYKLGKHVEPFFPAPSCYWSATNEERATFVNIQPHGVLLDPYSGKIKDPLIDSDNCDNDFCVTRSHQTHWLRNRKPDIMERCNNETWECHPIKIYYGWVSKKKNQETSTTFNYVQTGLVIESQYIGHVLMADLCIMTFCNRDGYLFPDGSWWEIKYSLYHAFTKDHTVLNNAHKCGDRTHGDHLTEFQRDKKVGYEDLEINLEGLEMRQKSRSINMMCLNRLAEIRNTHHINVLDMSYLTPKHPGRGLAYYFSQDQKNSSKYHVKVLDCDYKLIHIHDADIKGFVNITKYPEPNVTILGLKDNLTFADLGISRCQDLTPLNGSRNISCEESSGPLHSDDSRLSNGKRFWTRHSFQGANFHEHPGVRIGVNGITYDIRKQILRFPSTSNLLWDLPSYYSTKHRVHFFQHPTKHEIRKNFTGSDSRDIDVLDDLINRHINRTDFPTRIRNWIGNIEDKVEHFFSNVGGTIKTIISLVLFVIGTLISIKVWKKCKRHPQKTKKVAQLKLNDYEKTYNQRDTSNNNNDDLYETIENGGTVYSPFHV

SEQ ID NO: 15978 - protein, 630 aa, unidentified
MQTMKKTHLFAFTIFGQILLTSSLVVNLPLRCNGRKDLLVNSLKCPLPSTEVKVDGKVKVYEGDICRPQINAKDVEAGYLCHKDIYKAICDETWYFSATVKHEIEHAPISDIECIEGLTELKLGIVPNPQFPSVDCYWNARTEEKRTYIILTQHDPALDPYSNKIKDNVVDPDCDFNLCKTNFINTKWIRDKNTTEIERCDAKNWDCHPYKIYQGWISKSEMVGWGYPTQSYSYTGLVLDSHIYGHIPMSKLCHKTFCGKEGYLFPDKSWWQIRSKTPPSPLFRELTLNGSRSAFPDCETIKTYGYAEVEEDESSEIIRESAEIRHEMCLETLSTLASGYEASFRDLMKFIPQRPGPGKAYSLNSNGKPSYYNYHWAGHPASSASIQEQDCYYYLVDIPKIQDDGILNITSIRDTDVCGKLLVNGSSMTLNSLGFKVDHHYDDHIVETGTDVHDEMNIKERMIWIKPDKIHPLLWVGPNGIVIDHQHKQIHFPVFSRGVDRIPHYWTQKHRVVKYRHATQLKIYKQYLDNPEKSNPYDFNAWTGRHVNRTEIPVAISNWFSGVKDTVFDKISKIGSWLKWSFYLCFIFVLFKGGLLVWNKYQILRHQTKRTPKGENSQDPEKLDIFGQTV

SEQ ID NO: 15979 - protein, 506 aa, unidentified
MWIILLHVSFVASQVIIAPLREPQEWRVATKSDFKCTPGMLDDIEGPIDFWRVSTIKADANLHIEGYACQAEIWISKCEETWYFSKTITHSVQFPEGTQHSCQDELRKQKAEGAPVFRFPDVECAYASTTTATSYFLRLTPMNVELNPYASTLLHPSFRDGKCTDLEVCPMLHHHGLWIPKEPIAKTEEQAVFEKVTIKYKLSYRHSKAYGYISGPAVPFSDLRDACKIKFAGTAGMRLGSGMWISLGGDHEQGGLGWSSKHTTNIFNDLQIDDCAPGTKVSVPHAGHIGDLLEIKMNHMAMQFLCLDALRNVFRENSTSRLDLAKLSPSDAGEHPVYQLSERGIEVGITMYGLINWAPDARENRLGYHYGTSKAEGKNPITWKRWTRTQDGKLNGPNGVYQSNNTIVHPNLALLGNLIMEDLAADFDLDPIKEPEVTHYDANWETESIGRGEDTRYMTHRNRFFFWGPWNSLKNILLASIITLIALITSTLLLCCVCKKRQHRSV

SEQ ID NO: 15980 - protein, 533 aa, unidentified
MFRTLFFSLLGLCTGLGNQDEGHTVVLPVQVPRNWKPATESDFTCNHPPQWEPDTPFVLLNAKMLAKQEPIQVRGWFCYKSKWTTGCGTNLLFSKSVTHKVTHLPVSEHECREAVDRERQGRSEPETFPDPVCAWMSDTTKDTVYTHVLPHAAQYDPRSNRLTSPGFPQGVCDNLRWCSATTPDRWWLPDSDLEVQKQLETHMDSVILKLFPMPFPAENPYVGPHSVVSGSRIPPTVVEGSCKLTLLGDEGIVLPTGIWLGIKYGDYQLLHGGRKMGKKLQVQQANLGFITKQCKAEDHRVIPTTESPFYRVQLSTLHYMQYQFCLESLDKLNNNQTLSRVDLSRFAPRLPGLGKVFQLRDSAVWVGMTMYEMAVIPTGDETSKDIIGYIQDSTEAYTVAIHWTDWSMGSNRVENGPNGIFRKTGKVYHPQGLYQDLSLDLELLLTHSVDIVRHPVLEHVKEIPQIDRVVKDQSQTTIHLNSGISHFWENFHWLGGVKDKVILGIVGVVSFVGTLIGGMWVCKSRKRDQKRGY

SEQ ID NO: 15981 - protein, 531 aa, unidentified
MAPQTISLLWAMVCVSVYTRANRVVAPIHEPQNWKPATVDDFTCRTGFNLDFDSKFIKTKALVLKRVGQAKVKGYLCMKNRWTTTCETNWLYSKSVSHHITHVAVSAEECYNKIRDDASGNLKIESYPNPQCAWSSTVSREEDFIHISTSDVGYDMYTDTVLSPSFPGGTCKLKTCCKTIYPNIVWVPETPAQTQVRDALFDETMVTVTVEAKKVVKDSWVTGATITPSVMEGSCKKTLGSKSGILLPNGQWFSIVETGQITIQPKGSVEEKETWVNLINDLNLSDCAETQEAKVPTAEFTVYKTESMVFNILNYHLCLETVAKARSGKNLTRLDLARLAPEIPGVAHVYQLTSDGVRVGSTRYEIIAWKPTMGLDKTLGLTIVPSGNRNSETIKWIEWTRTDDGLLNGPNGIFIADGKEIVHPNLKMVSFELETYLISEHSTQLVPHPVIHSISDEIYPENYTIGGKNSYIKIHTPTAYFWSGIHWIEGAVQKLFIVVVATALIGLFILVVWLCCGCCSKSRPVRNQKWE

SEQ ID NO: 15982 - protein, 527 aa, unidentified
MSSLIVFLLLVLMASAKDMGPKIIAPVTEPKNWKKAELRDFSCSSGWEWNHRGQYIQFDASVLKRWEQIEIRGYLCMKNVWKTTCQTNMFFSKKVTHQIRHEPVDVGACNYQLEDLEHGNYQEEQYPDPTCAWMSEISTEKSFIKLTPHNIGYDLYTNTLLSPSFPAGSCKIRSFCPTIYKSVIWIPTQAVPAQTKAHMFDSAVVKITVRENKIKKDSWAFGSLVTPTTIDGACELTLAGRKGLLLSNGFWFEKDTGNHIIYQNKQVVSQNHAWSTLIEDLNILQCDRSREVGMPKADFVIQKSEAMVTDIIYYHLCLESLQKIREGTKISRMDLARLTPTVPGIGNVYQLTNDGVRVGTTKYEVISWIPKVGLHSMLGLTLVPGPAHESTPVQWNDWKKTSDGFWNGPNGIIKNGTELIHPNLLTLGAAVDTLLISEHLLQLAPHPIIHKLSDFTGKSNITEIDGRVTAHFEHPTFHIWEGVQWFSSKFDKFLMGGGIVITLIIGCLIIWIFSRCFRKNDQHPYYN

SEQ ID NO: 15983 - protein, 533 aa, unidentified
MKIIRLLIIWALAHTLGSSLPDGPKIIAPVSEPKNWRLATKEDFVCNSGWEWNHRGKYVQLKSSILKKWDQIEVKGYLCMRNAWQATCRTNMLFSKEVSHRVEHESVDAESCFEAIREREHGRVEVETYPDPSCAWMSQITKRASHIHITPHPVGYDVYTNTLLSPSFPSGSCKIKTCCQTIYPKVVWVPSSPVKTQTTNLLFDEAVVKVTIAETKATEGSWVFGSLVTPAPLKGACKMTVSGKNGILLTNGFWFHSEETTEIPLYQAKAATETKVQANTIFSDIAQTTCSEGREFGLPKAEFVMHKSEALVSNMIYYQMCLESIQKIRSGEQITRIDLARMNPTVPGISNVYQLTRDGVRVGTTRYEMISWSPKVGLQTSLGLGLVPSTGKESEVIEWHDWKQTDDGIYNGPNGIIKQGTDLIHPNIMILGVSVDAILVAQHDLKPQPHPIVEALSDLVGEQNVTLEGDTTVAYLKSPISYFWEGIHWLEDSVHRAILFGSVAAAILLSILIAYLVSRLVRPKKSTKYMISH

SEQ ID NO: 15984 - protein, 511 aa, unidentified; identical to SEQ ID NO: 58

SEQ ID NO: 15985 - protein, 559 aa, unidentified; identical to SEQ ID NO: 87

SEQ ID NO: 15986 - protein, 523 aa, unidentified; identical to SEQ ID NO: 76

SEQ ID NO: 15987 - protein, 530 aa, unidentified; identical to SEQ ID NO: 113

SEQ ID NO: 15988 - protein, 512 aa, unidentified; identical to SEQ ID NO: 9

SEQ ID NO: 15989 - protein, 506 aa, unidentified; identical to SEQ ID NO: 146

SEQ ID NO: 15990 - protein, 511 aa, unidentified; identical to SEQ ID NO: 108

SEQ ID NO: 15991 - protein, 523 aa, unidentified; identical to SEQ ID NO: 155

SEQ ID NO: 15992 - protein, 524 aa, unidentified; identical to SEQ ID NO: 142

SEQ ID NO: 15993 - protein, 521 aa, unidentified; identical to SEQ ID NO: 8

SEQ ID NO: 15994 - protein, 512 aa, unidentified; identical to SEQ ID NO: 159

SEQ ID NO: 15995 - protein, 514 aa, unidentified
MNVWRFLSLVPLATSVPVIVPAGRDGRWNDVPSGYRYCPAVGDEFSYRRSMSSPVNLYFAQSPEHTGHEGYLCHVAVYESTCDFRWYGVKYRNQRISRRIPTDSECVSRLGQLKEGRSDWVGFPSFSCNYAAVTTEKRSEIILIPHHVGVDDYKGFFVDPTLRDGLCVKSPCKTVYEDTLWLPSEDLDKGGPCDLKFSETKGSINYPPITRGLTLSDLQLVSPLFPTMNLGESCWMQVCGKMGIRTRSGVWVGIKEEPSIAQMKLYETFIHPCPPNLTISAGHFNPGALKMAWDAGRLLGYSLCQKTWDKLERGDQITPLDLSYLNPSSPGPGLGFMSINGTLKMAKIRFKRMELDGGTINNYDRDNANANVFQWQRWVPHGNVLLGPNGITLNGSTVKFPFYMIGMGRLDSDLIESELIDMVNHVEIKHTHILTPIHDRYGWRPSGEAGDLVRDVRNFFHIPDWIRYVLISVVAVIGLTVVGTVVLKVVRKPRTPQNPESPSHIPLNSMSSFS

SEQ ID NO: 15996 - protein, 513 aa, unidentified; identical to SEQ ID NO: 70

SEQ ID NO: 15997 - protein, 517 aa, unidentified
MLSYLIFALAVSPILGKIEIVFPQHTTGDWKRVPHEYNYCPTSADKNSHGTQTGIPVELTMPKGLTTHQVEGFMCHSALWMTTCDFRWYGPKYITHSIHNEEPTDYQCLEAIKSYKDGVSFNPGFPPQSCGYGTVTDAEAHIVTVTPHSVKVDEYTGEWIDPHFIGGRCKGQICETVHNSTKWFTSSDGESVCSQLFTLVGGIFFSDSEEITSMGLPETGIRSNYFPYISTEGICKMPFCRKQGYKLKNDLWFQIMDPDLDKTVRDLPHIKDCDLSSSIITPGEHATDISLISDVERILDYALCQNTWSKIESGEPITPVDLSYLGPKNPGVGPVFTIINGSLHYFTSKYLRVELESPVIPRMEGKVAGTRIVRQLWDQWFPFGEVEIGPNGVLKTKQGYKFPLHIIGTGEVDSDIKMERVVKHWEHPHIEAAQTFLKKDDTGEVLYYGDTGVSKNPVELVEGWFSGWRSSLMGVLAVIIGFVILMFLIKLIGVLSSLFRPKRRPIYKSDVEMAHFR

SEQ ID NO: 15998 - protein, 525 aa, unidentified; identical to SEQ ID NO: 60

SEQ ID NO: 15999 - protein, 529 aa, unidentified; identical to SEQ ID NO: 121

SEQ ID NO: 16000 - protein, 556 aa, unidentified; identical to SEQ ID NO: 161

SEQ ID NO: 16001 - protein, 512 aa, unidentified
MWSAVISSIIPLVLSVPVILPAGRDGKWNDVPNGFRYCPAVGDEYSYGRAQTTAITLLQPKSLEHEGAEGYLCHVAVYEATCDFRWYGVKYKTQKIRRQVPTDAECQGKQKALMAGRSDWVGFPSFSCNYASVTTEKHLEIVLVPHHVGVDDYLGLYVDPTLQDGSCVTPPCHTLYEDTLWLPKDSPKPGGPCDLEFHEHHGTIRYPIPRAGMSMANFQISGPTIPTATLDGACHMGICGKWGIRLRSGVWVGVKERPMLQGMDLYETFMHPCAPNATISAGHFNPGALKMIWDAGRLLGYSLCQKTWDKLDRGDSITPLDLSYLNPVSPGPGLGFLSINGTLKMAKLRFARVELPEGMIRNYDSNSLNPYQFQWQRWVPHGNVLVGPNGITLNGSTVKFPFFMVGVGRLDSDLTEAESIDLLTHHDIKHSHMLHPVDDRYDWSKSGESGDLIKHIESWFTIPAWIKYCVVVGVCILLIIVLGCMILVKLRKRPSPPVRRDPEIPLSSTSFL

SEQ ID NO: 16002 - protein, 520 aa, unidentified
MYAQYITISLFALQAHSVPVILPAGRDGKWNDVPNGFRYCPAVGDEYSYGRSLSLQITLLQPKSKEHEGAEGYLCHVAVYEATCDFRWYGVKYRTQKIRRIAPSEHDCIQRVKNSVTGRSDWVGFPAFSCNYAAVTTEKHSEVVLVPHHVGIDDYQGMFVDPTLKDGSCVQPPCQTLYEDTLWLPVNDLQKTIPCDLEFHQSRGVINFPAPRVGMSLANIQVSGPTLPTTSLDGACHMGICGKWGIRLRSGVWIGFKERPVLQGMDLYETFMHGCRANTTISAGHFNPGALKMIWDAGRLLGYSLCQKTWDKLDRGDSITPLDLSYLNPVSPGPGLGFMSINGTLKMAKLRFARQELPEGVIVNYNRDEPNTLIFQWQRWVPHGNVLVGPNGITLNGTTVKFPFFMVGVGKLDSDLTEAESIDLLHHHEIAKSHMLHPIDDRYEWGQGGKSGDLVREIESWFMIPNWVKQLAYGLTAILVFLAVCFLLNRYCLKSLRCRRKPRSEPPHNRSDIPMSASFL

SEQ ID NO: 16003 - protein, 512 aa, unidentified; identical to SEQ ID NO: 2

SEQ ID NO: 16004 - protein, 520 aa, unidentified
MCTLQIITVIIVSYVTAVPVILPAGRDGKWNDVPNGFRYCPAVGDEYSYGRALSLQVNLLQPKSKEHEGAEGYLCHVAVYEATCDFRWYGVKYQTQKIRRVAPTEKDCIQRVKNTVTGRNDWVGFPAFSCNYASVTTEKHSEVVLVPHHVGVDDYQGMFVDPTLRDGSCVQPPCQTLYEDTLWLPITDLSRTVPCDLEFHQSRGVINFPAPRAGMSLANIQVSGPTLPTTSLDGSCHMGICGKWGIRLRSGVWIGFRERPILQGMDLYDTFMHGCRANTTISAGHFNPGALKMIWDAGRLLGYSLCQKTWDKLDRGDSITPLDLSYLNPVSPGPGLGFMSINGTLKMAKLRFARQELPDGLINNYNKDEPNPSLFQWQRWVPHGNVLVGPNGITLNGSTVKFPFFMVGVGKLDSDLTEAESIELLHHHEIAKGQMLHPIDDRYDWSHGGQSGDLIKKVESWFSIPDWVKNIGYGLITLCLLILMCSIFSRLCLLKVRQNRRPNNDHGPNRSDIPMSASFL

SEQ ID NO: 16005 - protein, 526 aa, unidentified
MSMKKTSRDTMSLIIDSLLVLQVLPVVLSVRVLVPGGQDGIWKKTPLGYRHCPLDAEGFEIEGMSEVDITIMVPKNLNHRPIEGYLCHRVLYSSVCDFRWYGPKYKTHHLRRLAPSDESCHNRISQLAEGRTDWVGFPPMSCNYAASTTTENEEVVIIDHTVGTDDYLSAYIDPIFQGGICRSRTCKTVYEDTLWVSKDHQAHTCGESLVRDTGKVFWPNSGEPKLGDLVIESSTIPRSSMVGSCKLHLCGWNGVRLKNGLWFGLNPNTKIRNKDLLDDILKPCASGLTVRTHAPTMGLVKATWDTDRMLMYTLCHHTWDKIQRGDPLTPIDLSYLSPQRPGPGLGFLLINGTMHMSHLTYKALELANDSVWVLDRADRDNPSQVMWSRWERMAGVMVGPNGIVKQGSKIIFPMAMIQQGRIISELEQSEVAKVTPHHEILGNLTIHPLDTHRDWVHVGDKGDLINEVVEALHIPWMSILFYGAIGIGLVALVNISTCVCRRVSCRQKKSTHVHIPVPIHRDFDFL

SEQ ID NO: 16006 - protein, 514 aa, unidentified
MVSFGLLLLFLSSASGLNVTAPFFLYPELVSPWRNITLDHAKCPISSPVATDQELSSETFPSGHQELHHELAPVKGYLCSGLRYTTECYEGFLGGKDIKKTIDKVQVTGDICLRELEKVKTGSVIPPYFPAPECAWMKTQTNDAVFYIIEEHSVSYDPYKIGFVDPIFLKDICVNKVCPTEHDNMLWVTEADVGHQCSEFLDAEITFHSNQNYSITIIEHQHKMFEDFTKACRMTYCGEKGVRLPSGLFYTHIPPPYWHNINECSVKRNVTFYPLSAELLEIEREMTVDRERMMCIESLQTARRTKVMTFLTLSYLVPKFEGRFPVYRLEKGQLKGAVANWHALKTVKPGTSRQIGTFPNGTNAYWWDWVDSGYPGIDSGFNGVHRTEGKVVIPRLEVLKKEYALSLDILHEMRTIEHPIIKHLARENLTGHLTTLEGRDSIDVGEWLSNLWEKIWGKLLLLGCLCGFLLVVCCCCFGRIRRCLSTTSRQNNDIEMLPLRTNLETVKIDRPVHW

SEQ ID NO: 16007 - protein, 547 aa, unidentified
MILGARLRNQVFVIWFTLLSIALNVQSQVPLYTIPARLNDWHPVQPDKVKCPLNHFDVFDGCAQGSGSRRAKMTILADNHGAELTIKGYTCTGIRMTVTTWVSFFGYLTVTQSNDHIIPTVAACKRLRAKMIENPGIYDDQLIRPTYDSAWLQSLDVSKEALLIHPSVKTKIDPYNDVLTSSLFPGGTCEPGYRTGACPTIHGETLWIMEEGEEQDCAPFEEQEVSIHVKNSVPCGISDHHNYPRSYNGSCILTFCNHDGLRFRDGFWVTPIPRDINPPRCSRDTLIVSPSASYYQNEESLLNLVRGLRDKCLDALEGLQLSGRLSQRKLGLFRPLNPGPGKAYRISNELLEESDVVYKAVYSWSEVLKNSSCLLVDGKCYTEESFFNGITNSGEGGIVIPEREIFTQMFNEELLIQQEVMVEHPIIVSILNSILMPNDTDYITSMKHASQSGIMGLGLSSVWDIILTVVMAIIFLIFGPLIIYAMAKLSIFLCKSLRGKKKPRHDQGGMKPIQIRIDDYHRNSKALRDMKRGNPISWSDFQKESQF

SEQ ID NO: 16008 - protein, 623 aa, unidentified
MPNRDMYGIKIVIILTLTAFSFKLVKGLLPGDPFGPVRARDYALWDCRSSGPGLSSPIPKRPNCTAISHRDKTRVEGQVTIWKIDTSLWKVEACECFSETVTATCVSPLFGLESKSTKREFSPANYTYCLQSCLDIDSGSLTQSEIHGVIVSGKDPEYDCPMWGTRSVIVTITSVMRLTLIVDHDSDVMTGAVNFARPCKYNETKCPTVKGGFVFWKQLMKPSDRCNLKATGLSEICSLHGDTELSIHCPLTKAIYHLGHHQIIPTVACSWVGNESKIDVYKTLEGVWISGRSKAGGNLVDWIKTHQQGDQSVVFTQSSPKTNGSHILGLTGPQLAWLEDSWVKKSSEERSYLELQLCREAQHSWDLAWNLRHIAPMAAASIWTKTPHTISTLFSGFVLSWPCKEVYQYRFLKNENCSENWPIEYSDGIAIHTGFLEPVSYRITQRRGRMSCRISPGFLFRINDSHVVNLATRDFSPVPESYFAVDPVPVFHSHVFYSPSLYSVEELGGQSQYETLVELHHDHLRQAIYALSNSHEISTDEKLDALAPIDKATSIIGHYLGSTMDKILNSITLVITLVILLMTIVYVAKCFCTCYFTPFNCIKYARRPKSSSNENIPLRRRYL

SEQ ID NO: 16009 - protein, 611 aa, unidentified; identical to SEQ ID NO: 8738

SEQ ID NO: 16010 - protein, 610 aa, unidentified; identical to SEQ ID NO: 15405

SEQ ID NO: 16011 - protein, 588 aa, unidentified; identical to SEQ ID NO: 15510
  VARIANT 510: note = Any amino acid

SEQ ID NO: 16012 - protein, 591 aa, unidentified; identical to SEQ ID NO: 15525

SEQ ID NO: 16013 - protein, 615 aa, unidentified
MDKLSVLCIVLLHSSLSTQSFDFGKLIQEGGRGPVIQSPSSSQDIQDEYAPSFIPNPAAKNLYNDPGLQAYSVTHSDTIYDMVPVYSCNTTDEGFSVSEWYGICKAQCSYSSDMRHTALSIFQYSQKIDYIPVMGVETFTITKKSHVSLLGTCMVYVESSVPTVLNISEFSPYLDQIIQLGEDPRKTAIEYQTMDDPECTYWEDIEVSGYKFIIYPDAWGVSSDLEGNLVVKNPYTGNYSSLSDNGVFYGSTWHLWNSSYAYMPHTCPLLLASVEDCLLNPLLGVYHCPDSGVLINTNGVIEKSGTCVGSVNISSNGIFYVEGNKSLSLAITGRVSTLIGSQNPSYTGITDLLTTISDTIGILEDTYCGTLCDLADRSFQQMIYEEDVVDTANGPWLPVQNGGIMRVVPCRVDTRHYFSIPLSYCANKNMFMIRNIDTGDTNWWNPVYSYFDKSDMCNISSINPYKQMMDQGSPIKFNFWRGEAVLYPPYTGPLQWTPRANPNSIRSSKWFPQIKNVSDSIGMTIDKLSDHIVFNVNKTSSQVSQNTPYSTVVTSPIVKILTKIWTDVQIIAGGIWSFLTGFTKWVYILVLTILVLYATRIFISFFRRTNDPGWM

SEQ ID NO: 16014 - protein, 615 aa, unidentified; identical to SEQ ID NO: 15396

SEQ ID NO: 16015 - protein, 589 aa, unidentified; identical to SEQ ID NO: 15177

SEQ ID NO: 16016 - protein, 692 aa, unidentified; identical to SEQ ID NO: 15567

SEQ ID NO: 16017 - protein, 644 aa, unidentified
MLSTCMSFPLLIKTQLPPIRIPQQITMSLVSNPMMTNLVLMILFSVSFSIDTGEFWPMGNTGPVIPPPPPPPPESSGYSPSQIPNPANKNAFNDPGLKAYSASHSDTMYDMVPVYSCNTTDEGFSVSEWYGICKAQCSYSSDTRQTSLSIFQYSQKIDFIPVMGVETFSIVKKSHVSLLGTCMVYVESSTPIVMNVSEFSPYLERILQLGEDTRKTAIEYQTVDDPDCNYWEDIEVSGYKFIIYPDAWGVSADLDGDYVVKNPYTGNYSYLNDSGVFYGSTWHLWNASSIILPSKCPLLLASVEDCRLNPLLGVYHCLDSGVLINTNGVKENVDTCVGKINVSSNGIFYMEGNKSLSLSITGRVYALLGSQSPSYTGITDLLTTISDTVGILEDTYCGTLCDLADRSFQQMIYEEDVVDTANGPWLPVQNGGIMRVVPCRVDTRHTFAIPLSYCANKNMFMIRNLDTGDTNWWNPVYSYFDKSDMCNISSVNPYKQTMDQNLPIKFNFWRGEAVLYPPYTGPLQWSPRVNPNSIRSSKWFPQIKNVSDNIGLTLSFLSDHIVYNVNKTSTQINQNIPYSTVTSSPIVLILVKVWTDIQIVASGIWSFFTGFTKWVYIIGFTFLAIYATKLFLSIFRRTSDPDWM

SEQ ID NO: 16018 - protein, 591 aa, unidentified
MMNIYIVYIVSIMFGSQVISAAKYIYPSRAKGPLHTGQVPPGVDFYPIYFCPVSTDGYSRDAWYNACLGSCSMDKQSSTASISVYYRNDTVGIATVWKILSTYVKKTTHENFLGYCSTMLQGDYSKTLAKEQAVSVFVKLKEDLIQNDRVTYDEVPQPDCKYFDDVTTEGFTHFIVKEQRDVKVDIHGLYFIQDPSTGRNVPYTEGAVQSGREWYVWDTHTSYPKSCNLELAGTSACTKKKSDMYYCHDMGVSFSVINQDTVTGTCVGDINISTDGVLYQLSDEIRLTSISDRLEKLWELSPEAVTSGLIASVNDALNSIERTYCTSLCDIVEVISHHHSDSTHVLETPIGPWMPIWKEGELLMTPCKADIDYYITSPMEGCLNNNVIKVESASTGDNYWWDPSLSYIDDNKSCSRGVTQDIFLRAQMSKKQPILFSFWRGDIILDYPYNTSFRWAKKMVASVRSSKWFPQLTEFSLVKPVSLPDVEKGFREMVLREYNRLGNFSEKSQNVFDEDREFFINSARSLWSGAKVVVNECVTYFESLYNWVKMMVAIAATLIIAVLFQKVFRLAIPKEASTKKRPDIYYELTTL

SEQ ID NO: 16019 - protein, 661 aa, unidentified; identical to SEQ ID NO: 15172

SEQ ID NO: 16020 - protein, 607 aa, unidentified; identical to SEQ ID NO: 15461

SEQ ID NO: 16021 - protein, 594 aa, unidentified; identical to SEQ ID NO: 15261

SEQ ID NO: 16022 - protein, 655 aa, unidentified
MSYARVLVSLTTLIILTQVFLLLEEACSEISYWEKDGKWYAQWVPSPATSVEVPAPSPERIPAPPSPTLDKLPAVHQTTYGTIHVGVPTDTDLYPIYYCPNVSIYDLLPVWYSGCLSMCSITSVQDLVDISVFQINSTLGSTDLYKVSVRSVTKYSHVSVFGSCTVSVTADDYVSPPSDKLSEWVTKLSIDRPSGSQEWDYSSDPPCNYFSDEYSTGYKLYVTHYKVEISVDSAQNRYLRDPTNGLYMSYEQDYYVDGSTFYHWVQNSDVSQEVCYFREIGEDSCTVDSSSGYISCRVLGITFKKDIKNIITSSCAGSLNVSSDGVIYQVLSAYNKTSLSDRLSGLLSSNINMNQLIHVINDALISIEDAYCSSTCDVMEIILSNYPTATTVIETPIGPWLPLVAKGNTVMTACSADTEWYLKLPIEYCAEKNMMKVVHNSTKSEEWWRIMNTYVVSGESCNSSDSGWDEILVEKMQSKREIVFHFWRGDLTLVYPYNVSHWTLYKDEKIQRSSKWFPKLQYMMLDKEIYIDNVTQALHNYTQDIYNHYMGNQTASTGLGSIIPRILDRITLSVGNAVKLVVKISGEVILFIMSHIHLIGDIIITVVCMVIGYYLIYIPTRWVRKRRGDTSARITAVSNSYEMVPSSRTTRKDIL

SEQ ID NO: 16023 - protein, 605 aa, unidentified
MRSIGQIFFVLVLLRHVISEFLPDGYTDGTTILPPPSPPPLPPPPSAPPAQTDPGLAAYQETHTDTMYDVIPIYQCNSTGIGYAVSEWYGICKDQCSYSTERSTWNISLYDYQNYVATIPVFATTVVSVTKTAHVSFFGTCLTYVSDEKDVNLNYTTFRSQIPLLLNHTAGTPGSTAVLDNTVNPDCSYWADNTITGNVYTMDTDSWPLMISITGDLLIKNPYSLSFTPYNDSAVYFNGKWFFWDQSNTHHAPSCALTPAGDDSCKLNSNLGVLSCEGSGVVINLNGAVLYNNTCVGSINISSNSIPFTFTKSLTTPPVKEKLQDLLGSSNPSYTGITDLLDTVSDTIDTLEDTYCSALCDLSDRSFQTIVEDEDVVDTPNGPWLPVQNGGVTRLVPCSVDVNWLISFPLTVCVTDNLIKISRMGSSDVHWWDPSVTYFDPQRSCDHVNVNAYEIYMKKKANISITFWRGTAYLDYPYTGPVRWVPRGNPNSIRSSKWFPQIKNLSDAAKLTMSILGDTITQSVSRSVNTSSGNSYVEYSTNQLSFLVSKIWTDICIISTGIWNFLTGVIGYGTSVLMTLVAVYLGGILLKRVLAPRRNNSWADM

SEQ ID NO: 16024 - protein, 615 aa, unidentified
MDTAGIIMFSILSILTVCRSFDFGKLIQEGGIGPSIHSPSAPVDDQDEYAPTYIPNPAAKNLFNDPGLKAYSATHSDTLYDMVPVYSCNTTDEGFSVSEWYGICKTQCSYSSDMRHTSLSIFQYSQKIDFIPVMGVETYAITKKSHVSLLGTCMVYVESSVPTVLNISQFSPYLEKILQFGDDPRKTAIEYQTMDDPECNYWEDIEVSGYKFMIYPDAWGVSSDLDGNFIVKNPYTGNYSRLSDNGVFYGSTWHLWNSSYITVPSSCPLLLASVEDCLLNPLLGVYHCSDSGVLINTNGVIEKSDTCVGAINISSNGIFYFEGNKSLSLAITGRVSALIGSQSPSYTGITDLLTTISDTVSILEDTYCGTLCDLADRSFQQMIYEEDVVDTANGPWLPVQSGGVMRVVPCRVDTRHTFSIPLSYCANKNMFMIRNVDTGDTNWWNPVYSYFDKSDMCNISSVNPYKKMMDQGSPIKFNFWRGEAVLYPPYTGPLQWTPRANPNSIRSSKWFPQIKNVSDSIGMTLGSFSDHIVFNVNKTSSQVSQNTPYSSVVTSPVVMILTKVWTDVQMIASGVWSFLTGFTKWVYILILTILVLYATRIFLSFFRRTNDRDWM

SEQ ID NO: 16025 - protein, 630 aa, unidentified
MTKVIIILLAGWLAATFAANPFEEFQTAAKNNNPVHEAAKRVGEGMDSLQPYYVCDKEDSGNQLTVSAWHYSCKQSCLDDNTRTAINITRVRWHYIGEDIPVYKVVTNEVCYTAHENMWGYCTQTQTIKPTATTPDDRSKLKDIIFNTRDPIRGTKTITNSHHGDCEYFSDNTKCGRDYTITYRPGKTSKKSDSDPLMLNVYGDGIRIDPTRGEIYQNDVAWFWDANEIKTTTECGWWIYDDETCRITTTSDMMHCPSIGYQYNIHNLTSSQTCKGEIYDIDGPAPFLYKSKGQEPKRQDVIERATEGKGDPDVNMIRGINAAFERLEETYCSSTCDLFARGARADDNQVLDTPIGNWRLVNSSTDHPSLLPCTPTATWRVKSPTFLCHGKNHILVEDSRTKHTCSWDTTKDYITVDDTCIQDSQDATDMDNTIRHKMLKGEDISISFWTGDTYTLGPPYTTPTWTRNNLTRAQNPSWFSKVELNKNMLHNPQDMSNILTVLAQDTKQEIMYNQTTSRSVRKYLLDEILLGAGTVGATIVSFIGAMIGTLPKLALGICLVVVIMWLGKLAITSRIQRRRHMQDPTGKNVRFESDMADSMLETTPKAPSAPKRRPQSRSVRIGNLFEEYGI

SEQ ID NO: 16026 - protein, 630 aa, unidentified; identical to SEQ ID NO: 15370

SEQ ID NO: 16027 - protein, 649 aa, unidentified
MIFKIIRKMNTILAFAVFALYMAVIFKIGNTEFNAEIRQNSPNVNPAKNPHSIKSEGKLYDAHDIYQPKYVCESADPTKAVSHPSWHHSCIASCKDEYEKDLVNITLMDWIPEGPDVDVYRIAMSEVCYTSHENVWGYCSQAQTVDPKTPTREEAVKIVRDITDGWKTVSLGTRIIKNSKEAECDYMSDLRDCANDYTVVHKTGKIYQKSDQSALEITIAEDGIRTEAKKEFLQLNDAVWVWRMRDKEASICGWKESVTISCHHKNESFLLECPDIGHSFSLESAMKHSTCMGDIFGVDNILPFKFAGTEKKDSRKDFADKMEADTTKDRTAVAIVKGMNQALSSLEITYCNSFCDVFTNLYLTRDNDVVQTPLGPWIMSKLDNNEVMYPCMVSADWVIADPITTCGTTNFVTVLNKATKEMCVWDMSKEYITSGATCSDFGIPDLIKTEEALPSKISDRKNVNITLYDGSTLMFSPPDYKPILVPSNSPPKIIPEGWMTKMKLDPSMIHDRADVLSMLTRHVNDTILEYGIPRTRKSSTYIRMVDEVTGGASHVMRSIWDWISQFFTGLKNLIFLMGLMIVIFIILKIRRIYTNAISHFTVSGTIPIEPGVVGQPILKKRRSRSRSVKHARPSENINMHNAESWVLKH

SEQ ID NO: 16028 - protein, 629 aa, unidentified
MKVILIVVAIWVTNIGASPGKEDTRGFFDDHFTDHTKVKTLNLTKGGKKIHHDDLMVPSYECQDRGNETMELQSWHHSCRSSCVSNKEAKRIPITLLEWESKIKEVVMYKVVPSKVCYVSHVNIWGHCSQTQFISPHKLEADDILNARKIVDENQHNELSDLYLRNSKIAGCSYWSDVRSCGMDMKMIPIIAYLYRGKTDEDFMIVSQEHGIKAPFRSGEILLQDTAYIWNSTLDKDHICVWRVIGTTTCQLVKQARVLRCPDIGYNYDIATMRRKEYCGTLVYAGESAIPFMISEGEVTNDVPRNTIFEKAKEGKEEKEVNLIKEINRALTDIEVAYCESICDITMRTAKDSDDQVLMTPIGHWLYIKENRNKGVSEHLSICKLTSDWVISTPFSMCGFSPYVTVRSKTRKDVAVWDIRTDHIRPNVTCSDIIDHKVEHTLKSAYKKKLPYEVTAWNGDKIMSEYPYKNIVVEKPKRVNTHKVSAWSSHVKLDETDLITSDDIGAGIKTVMNETEVELQGTQVNEGIVSSFLGELTTGTVALASWAEDEIFSLLGPIRKIIMLTLCIAVIIATIILSMRVMNIRGKKKVKEVYRSVRFSEAPIELDSAPSVIMKRQDKRTIHDILVNQ

SEQ ID NO: 16029 - protein, 632 aa, unidentified; identical to SEQ ID NO: 15576

SEQ ID NO: 16030 - protein, 638 aa, unidentified
MGLYQAIIIITFCSAVMCIKGDGNDDGKSFDSLKDEIAKRNPIHATSKTLGYGHDSIQPYYICDNMTSGSQLPLNAWHYSCKQSCTDKESKAAINITRMTWKYEGDDIPAYKVSTNEVCYTAHENVWGYCSQTQTITPVATTLEDRAKIPASIFTPASHIEGSKTLVNSGHAPCEYLSDNTNCARDYVVTYRPGKITKKSEAAPVYLTIYGDGIRTNPTTGHLIQNDVAWFWNPVTNADTKCGWYYGPKTTCYVTSTSEVMYCPDIGYQYNIKTIKSTRACENTVYDIDGPSPFIYESKENLPTKEKLAADASAGKGDPDVNLIRGINSALDKIEITYCSSSCDLFSRGEPKDDDTVLETPIGYWRLIGAKTQTPVMSPCSATAEWKIKNPTTVCHGANRILVSNEKTNHVCSWNTEKDYIIIEDMCSNSPAEAEADIALIRENISRNKDISIKFWTGDVLSMKPPYTKPVWTIANYSYRRNPGWFSKVALTSDMVHTPTNLADVLTSMVEEAKQEVSYNHTASRSVKTLLFEEIGRGVGGVVTGIVSYVCSLFGGLPKLILLFLLIIGGLWILKSAIVAFIIKRQARELFPDEKHVRFSPISSEEDDGTMYMTPTAPKLRPRSKSRQLAALAAGLDI

SEQ ID NO: 16031 - protein, 673 aa, unidentified
MKRQFFSLHPANDSMFLCVFIISSFIFFVTVRSEVSEDVFSDFRSTSMNYNPTRTVKPETYAAIDLYQPYYICGGDDDSEALSPNEWHYSCKQACSDVNDRHMVNITRMKWDYIGTNIDVYKVITVKTCWTSHVNIWGVCSHTSSTFPTATENEDLALLKDQYVGPNVTPKLGMQHITNSHRADCSYFSDNLRCDRDYTIYHRKGKVSKKSDTDPAVLNIYSDGIRVSPSEGSVHLNDVSYMWDASSASSSDECGWKETKDTSCSYVETSDTLKCDDIGYTYNLHDMYHKKTCGGDIYDLDGPSPFKYLTKEIMKRREKIVGDAKVGKSDPDVAFITGINYAFSELESTYCSSSCDLFARVNPSTSDHVLDTPIGAWRVQTSPTLHPKMLPCMPTSNWTIKKPMTMCSGENTILVIDKDTGHVNLWDAGKDYIILDQLCGGKQDQARKRYNMLKDKMKRNEKFEISFWNGDAVVVEPPYMSPKWKRSSHHVHTNPSWFAKVKLDKSMIHSKDDISSMLTDYVKTTAEEIRHTNGTSKTVYKFLADEVLEGIESVGTSIWGGITGFFGNMTKIITMLLIIIILLLCGKLALIIRKFSRTKKKKVQKSRTFVESIYQNQDKKRHVTWAPDSSTEPEQEVASGQPQYDSTRNLTMASRRTLTSSNKRNELAKLLNV

SEQ ID NO: 16032 - protein, 654 aa, unidentified
MSDISLDAFKKNQLNCISLSNAGQMGAVSLIIALLQITYILTASDPTFDNKRNLAYKYNPVYQAKDEGGYGQEAYQPYYICEPDNDDSAMPLSAWHYSCKEACMTTHRKQTVNITGARWNYIGPEIDVFKVLTTEVCYTSHENIWGYCSQTQTTRPVKTLNSDRAIMPANMFGTDSPAKYGTHYITNSKEAECSYTSDNTECARDYQVMRRVGRVSKKHSDSDAEMTIVVDGIRTDPRTGFLELDDVAWFWSPMSLGELSACGWEKTNRIVCTFTDSTDIISCPSIGYTYNIQALYPKKTCAGDIYETTGPFPFFYDTFEYYPSRDDVYSKAKEGKPDPDISLIDGINKAFTDFELAYCSSACDLFARQGDPDEDHVLDTPVGTWRFSTNARGRPSLLPCMPTNKWHLGNPTTLCHGKNHLLVVDTETGHPGSWDARKDYIISGEVCNTDQSVMTQDDEDLRDQIARGETINITFWTGDVLQIKPPYDGPVWVNGSKAFRLNPSWFSHVKLTRDMMHTRDDVTLLLTDMVRNTTTELMYNKVPTKTLRRLIADEILSGAESIYEAMWKVLSSLFGGVAKIIMIGTIIFLVFCILKLTSQKNNKRGKRKASQPQRVTFQEAPASLDPMPLVSNPGSALVGSKRKVRKELQNLLMS

SEQ ID NO: 16033 - protein, 626 aa, unidentified
MKLVSLLIVISVCTLCVCDNPFEEFQKTAMQSNPVREAEHRVGYGSNSIQPYYVCDKADAGSALPLSAWHYSCKQACKEDNKKTHVTLTKTNWHYIGKSIPVYKVVANKVCYTSHENVWGYCTQAQTIEPAQMSEEDRKLLPKEYFEKDKKILGVTNIVNSRHAECSYLSDNTVCVKDYVITYREGKLSKKSNDDAVVLNIYGDGIRTTPTSGSLYNNDAAWYWNTDHILDENNCGWNRDGDTVCKITSTSETMYCPDIGYQYNIHTLKPTTTCLGEVYDKDGPMPFLYGSQKELPTREDIMNKAKEGKGDPDVNMITGINSAFEDIEETYCAASCDLFARGPGRDDNYVLDTPIGNWRLINATDKEAMLSPCRPTATWRISNPTTTCHGRDHILVSDSKTGHTCSWDTTRDFIIVEDLCNTDQNQINSDAKTLRNTIADNEELSIRFWTGDKMIMKPPYTKPIWEKLNTTTAVSPGWFSKVGLNRGMLHNQQDISNLMTAMVESTKQEVQYNATRGKTIRTFLADEILGGASDIWSRMCSIIVSLLSAIPKFIIMIAAVIILMATAQWAFTYYVSNRTKRNVLSKSVSFVDDELDGLRGPRDAPSAPKRRSRSRASKLSSDLAFI

SEQ ID NO: 16034 - protein, 552 aa, unidentified
MKYTIILLLLSMATILRSEGRDYKYAIGPVCECLDPAKPLGDFIKTCYRRCMMDPEPTGRKTVQIHQTMDKRKGPNVVECSRVIQEQKFTQMWTFSTEAGYLESHVGSVSEEECRKAITDNCPDFVCNHREKDTLDPEYHYGSTTTVRRETISLVSMPSTLMIESGNLMISPLSTPDLYPASEKKGFHAGKVYLWNDDLESQECPFEPSGSYGCDEYKGSDGKPYYMCAGGRFTITPTRRGDDVAMKICKDLKLSSEGFLYKLTEEGASSDKHSRLYITQTQGMGGDIDYLRHKVQHAVTHLDSEICSNQCELLAVESRLSSAREPVVRVGMTYYKLYDNGTATLCKTVSGCKLTSPVLTCGNPPRIGVSCTTNSGLWDPLKPYMTPGGICSKPDYHEKLSFFLGTESYVVDNDLTIQANSSYAHGVYPTSFSDFHQSGIQMSITDLAKLKPEWEASKGDGSGLSKTEMVDRKIESTSVDIGKKAMSLFKNVSEFFTHIEHAIGVVIIIFVIIISISFGLKLLGRVSGNKSQKRRVRSRSLDGKDEETSAWI

SEQ ID NO: 16035 - protein, 571 aa, unidentified; identical to SEQ ID NO: 15324

SEQ ID NO: 16036 - protein, 546 aa, unidentified
MMSIIITLSITILLTSISTHAELKNYHHIAPVAICDLKKTINAYEKLDECIHRCSQAIGYGGSASIMLMQDFSSEPGPSVVVCQKIRMKQSFEETWTFSTIVHTPEITVEIPSKEECDRYINQNCSDYKCQSYTPHSLKEEYAYASVIHKEETYIVASSHHSTLQEIDGKLMVIPMFSESKFEVSAGYGEDEKGKYYWDKSMTLDKCPLSEGLRMGCDIVNLGQGESYICGGGRLAIDKAGSKTMTGACKDIKISPGGIVYKLVPREPDDNHYKNQKIGMAGFTALTGDAERARILSQHAMYHVDADLCSLQCEVSGIELRVARRAQTLLRSGDEYMLVSQKGHGYPCSVVTHCRLNHPIRVCGSPDRVSIHCNGRDYYWNPGLNYVTNYDYCSAPYTEEAIHIHIGNTRYNLEDDLHIEVPENDTYTHKSRSFLLAHASMFKVEDIDKIRTKWIQEKNSGTSYAQLSSSTSNVEQSSIGFQGLLSPVKNIFNRLVRILNHAEAAVISLLLTIICMYIGYKVWGLKKSKRKRRTAKIPSEESMTWI

SEQ ID NO: 16037 - protein, 551 aa, unidentified
MSFSTGAKNVVSLCFIFSCLLAIKGDFNHSVGPLAICSLQMEDARAYAESCYRLCTRDREPSAHGFVDLYSETSQKGGPDVIRCTKVRIEQTFTETWSFSTISSEPTRTMLDVTRAECDNEIKSICPKSNCYVKAPNSLEAEFHYASDTVVSKDYIELMTLPSGLDYLEEHLRITPALGGESYPASDGQAFLGKALLLWDPNFESPACPFTSVQRHGCDRYDKPADLINCRRSRFVIPNLTDTVELKGHCKGIRRAPSGLLWQWTDVSKSGFPGSKRLALTLPAASETGLEALRYQVAEALDVIDEDMCQTQCEILDLVLRADRKREVLTRIGGSYMVISKSGYLRRCHPAIGCKLVKPHMFCGGPNRVAVSCSGKVFMWNPQKSYLESDMDCPRHTKDSKLTFTVGSHEYNIDDNLHVALPDKEHFGIAHDIVAKTGDMINKELVNPEDLRKSWIAHVERDSSVSITPINEGKNISTWEPDLSFGFEGLKSVGRRVSDFFSRVTLWLSVLLTLAALMLGAKAWGYIRTSAPRSDIKHVRVPTSETSATWM

SEQ ID NO: 16038 - protein, 550 aa, unidentified; identical to SEQ ID NO: 15325

SEQ ID NO: 16039 - protein, 575 aa, unidentified; identical to SEQ ID NO: 15171

SEQ ID NO: 16040 - protein, 520 aa, unidentified
MMLRRATILVMFLWVTQTRSEFSHHILPAPIICGGQFPTSEYNELSCMSSCNLENFAGEPFNITLYDQLHDTSVVMAYCKKVRMQQTFTKTWSFSTFASDLTVVALSPTFAECKMAWDAKCKDSECLIKPDPIVPVYYYASSHEVIQEGIVIEAHKYNTVVKIKAEDQIMIDGEFHPYAKGSLYMQDKMTWVMWNPKAEEKCELTPTVSTQCIFTIKGMLNCDSLGIVINASSAVAATVCGQTSGVLIDNLGVVFKFGHFGQQFKTPSFPITRMDSSDAIEELIMAVQLSSQVLRSETCVRSCLGHDGTRVLENAEFFGDKIVSNRSGVLKLCRYQPTCKLTLPIRICFGTSLVRVKCGVASYWWSLDTLEADTTYYCASHVAEKERAQLIVNGRALEMNSSGIFLSGNVSKSSFYDFVPKNSYTVVSHESLKETLANRNSFSTPWEKSHSSSKTESYNVFVAAWNGITGFLQHVTLILTVLGTLIGLIFGYMLLKQVFPLRRATDYKYGHELQTFPIFA

SEQ ID NO: 16041 - protein, 519 aa, unidentified; identical to SEQ ID NO: 15173

SEQ ID NO: 16042 - protein, 503 aa, unidentified; identical to SEQ ID NO: 15274

SEQ ID NO: 16043 - protein, 577 aa, unidentified
MLLYLIVTSLLSHFLVKKLEEYFYSWFDMFLILAMKVVSSLVKVWTKLKSFFSDRGNRLFYLYLVIVVHLLLLKTAYGEEIALSPPYYCPNKMPTNWMTPSVCYRSCDLEGLSPTPVNLTIHQHDIKDAIGILECKKWVSQITATETWTFSKLPPKREDKPARTNAEECWNQFTKVCKGLECESSRPELKAEYSYAADTVKQYTWFQLRYKIVTVPISYDDGSYIRLDGHNLDYTAGQAVSPNDPDKLLLWKVKTAVECWTSPVTTLQCNQVLSPTGVVSQYICGHGRLIITPGKELSSRHCTYKVPTFISEEGIIYNKASGTVVAKDGLPIFKDSLLPAMKEIVIQHRIHSLMLQEQVCKHSCLSPFPNQTNSMFFYGNKRVARLSAQEFLSCLEDLTCQILRPLHVCSDSNLIAVVCSGIMTWWDPSLIYVNPYHYCSGTSVERQSLRFQANAGVYLANMSGVYYLGGSELQHQIHLPTVERKLTLLGKEEIQRAMLSSASTVKPETESGGQEVNRGSWNFGIVSFIEGIEHRIKAWIIMGLCTVVAVFMFLYIFPVSLRGKKKYQEVPYALREF

SEQ ID NO: 16044 - protein, 602 aa, unidentified; identical to SEQ ID NO: 15174

SEQ ID NO: 16045 - protein, 551 aa, unidentified; identical to SEQ ID NO: 15181

SEQ ID NO: 16046 - protein, 568 aa, unidentified
  VARIANT 15: note = Any amino acid
MVTICIKSTFVFLCXLLMSANVYAGHGKRRTSQTLTSISPVADCTGDILDLGSELKRCYSQCEGYTEPKKGVTLGIHRLYGEGPQVIMCNKLRISQDFTKTWTFSTIDGQKTIERIPTSIEECKKAIDENCPNRACNVREPDRLTPEYHYASSTTVTSEVITVMTIGSSIFFDRSKERMSPAGSHIDLNPKDGNAEIDGTVFLWDPKEEIKSCPYQIIGIYGCDEFDEGSSLFYACSRGGITVTPSNPPHEIHKEICSGVMLSDEGFIYSLNNDPKTIVRPTWKDGIEANEGTAEQADTTYLRHKIQQVATKLTSDICFTQCEIMGLEVRNSNKSTHLVRMGHQHYLSYNNGSAKYCYPAHGCRLPEKVMYCGGPPRLSVSCNGKNRLWDPSKPYTEKHINCTKPAEVEDLEFHMGGLKYSINKDLTIPLEKDELHGVYQSEFLRYHNGALNLNITDLRSLRSGWTAAKGGPSVIYQGSPNKVTINSPHFTLGSWFIDTITGVKNMFGSIETIIGGFLIFLVVMGSLWVTIKVTRLLKVSDGKPVRKASYALVEMEDAVTRDHRAQWM

SEQ ID NO: 16047 - protein, 565 aa, unidentified; identical to SEQ ID NO: 15326

SEQ ID NO: 16048 - protein, 483 aa, unidentified; identical to SEQ ID NO: 15224

SEQ ID NO: 16049 - protein, 478 aa, unidentified; identical to SEQ ID NO: 15373

SEQ ID NO: 16050 - protein, 548 aa, unidentified; identical to SEQ ID NO: 15477

SEQ ID NO: 16051 - protein, 551 aa, unidentified; identical to SEQ ID NO: 15506

SEQ ID NO: 16052 - protein, 560 aa, unidentified; identical to SEQ ID NO: 15276

SEQ ID NO: 16053 - protein, 476 aa, unidentified; identical to SEQ ID NO: 15165

SEQ ID NO: 16054 - protein, 576 aa, unidentified
MLGTCNIRDVAYKKIPTVMVYLTVLLLSSFLIDGRRGATVKSIDKNRLSIGPIAHCKGELLDLGVQQRNCYMKCEGYSEPKKGVTIGIANAKTKGPPVIRCSKVRLSQTFTQTWTWSTVSGDLSSEVVPTTVEECRESININCPTGNCDVRAPNKLEEEFHYASTTRVESLFIILQSVPSVLYIDDSKEWVSPMGTTGRFAAEEGVAQEEHNHYIWNKLSSLTTCPYQVEGTYGCDEFDEGDELFYVCAAGGLTVTPRKSSPLIHPSLCPGLKWSQEGLLYEISKGDPNSDMVGRLGIEAKPDTVESADNTYLRHKIQMVARKLDSDLCYTQCEIMALESRSANKSAHLVRAGHEHYLAYSNGTAQYCGPITGCRLSDPPLMCGNPPRVGIVCVGTSRLWDPLLPYITDEHRCDKPREIEEMHFNLGASKYIVDRQLTIPVNKTDLHGVYHSEFFRYHNSRMMMAIDDLSKLKPDWDKAKQGKPIDSVKTESSRSVDAPHIMLGGWFLRAWQSVRDMFHSVEAVIGCIVIVLAVYMTVMLILKIKSASTDVLYRPVQMRMINKSKVTNEPERVVWT

SEQ ID NO: 16055 - protein, 536 aa, unidentified; identical to SEQ ID NO: 15214

SEQ ID NO: 16056 - protein, 560 aa, unidentified; identical to SEQ ID NO: 15450

SEQ ID NO: 16057 - protein, 561 aa, unidentified
MGELMMPFSALVLVCFVNLALSSRYAMIEEEKHISPQVMVFCDHGSQIQTDSIACLDSCDFRLREVKQLCFHQQTHDESVTIGVCRKQKKSYLFTETWTFSKISEGPIVESLEPNAAECHKAWKDACEKKPCVMLSKNVEPEYHWASDTKVEITEVLVDASTRLMPLSFSDLHLNILGEEVPIDSGAAIIRGEMMIWDPVEMSKSVCKLSEALGAHCYRINKIQGWYCPEIGIKVNSSKYLSNSHRCTKETDRELWLGDNGELFTVGKCIIAKENHPGFPIYVGEQEEIKAVVNSVTEALHQRDIQICIRSCLKKPDIGNLQMFGTNLVLNEEDGMKICHLNNECSLKLPVVRCMNSSLFRVTCGSTTRWWNISSIHSPLIYHCQGSKNEINKELSIPSAIGKILINGSGMFHDTESSPEELMIGNKILSNNILSPKHDILSLEHQNNLMIGIGDLLNHSKNISTPGMLSWMKDKISDIKNFVSNLSHEVKASIIWIIIVSIILMILIKARLTFWNNINKKQTHGNKGKIGTPSRQSISDNEKSSKHEADPFVLRVELESE

SEQ ID NO: 16058 - protein, 567 aa, unidentified; identical to SEQ ID NO: 15178

SEQ ID NO: 16059 - protein, 553 aa, unidentified
MSFFPIFILTAITIGNMVSSEDRFFNATIGPYGICGSETMNIETVLSECYSRCLKPPQPNGGYTITVHQSDVQNAGPLTVECRKVSLEQTFTKSWVFSTSKSEPRVTSEVVSETECRETVQKNCPSYDCNIREPRELPEEYHYASDTISRKTFITAISMPSSLTTDGSKLLIMPLGSEHTFDINLEIGSSGGGVYLWKKRQYEAECPFKPAGRYGCDYYENVPSDKHFVCAKGGFSITFGHDLSYAYPSCSRLYISKEGIIYRNDKGDGLNIHSQRLDLTDVQYKQEDAESFRNKMNHVLANMDSDMCMMQCEMLSLEARTPRTSPKLLKVGKNLILLEPNGTGVACAVAYGCRLSSPHVLCGSPPRIGIECTGKSGYWEPTKPYMVSGDKCVRPHKQEKLVFTAGHHVYTLDDDLTVLVPSGFMHGRQMDLFASDHMEGLQFSRKDISDLRASWSGAKESSGKDAEATSSTRNITVPDMDFPILELPNKLAHYLAQKTHEIIVFGIVVVVLIMSIWMGIKLLTQPLTKNRITRKSTSIRENPQEYQPVARWI

SEQ ID NO: 16060 - protein, 552 aa, unidentified; identical to SEQ ID NO: 8752

SEQ ID NO: 16061 - protein, 519 aa, unidentified
MSGFAIVMVILLCSLKTRSEFSHHILPAPIICGEQFPTSEYNELSCMSSCSLENFAGEPFNITLYDQLHDTSIVMAYCKKVRMQQTFTKTWSFSTFASDLSVVPLSPTFDECKMAWDSKCKDSECLVKPDPIVPAYYYAASHEVVQEGIVIEAHKYNTVVKVKTEDQVMINGEFRPYAKGSLYMQDKMTWVMWNPKAEEKCELAPTVSTQCIFTVKGMLNCDALGIVINASSAVSATVCGQTSGVLIDNLGIVFKFGHFGRNFKTPSFPITRMDSADAIEELIMAVQLSSQVLKSETCVRSCLSHDGTKVLEDAEFFGDRIVSNRSGVLKLCRYQPTCKLMLPIRICFGTSLVRVKCGVASYWWSLDTLEADTTYYCASHVAEKERAQLIVNGRALELNSSGIFLSGDVSKSSFYDFVPKNSYTVVSNEGLKETLARKNSFSTSWEKSHSSSKTESYNVFVAAWNGITALFQHITLILTVSATLIGLIFGYVLLRQIFPPRSATNYKYNQELQTFPIFA

SEQ ID NO: 16062 - protein, 554 aa, unidentified
MPKLSNSASNFCIGFTSIILFCFFHLVNADFNHSIGPLAQCNPDMFDARQYTEACYRRCKRNDKPQSHGFVYLYSDTNPSGGPLVTSCAKFRMSQTFTETWTFSQIASTPQTSPLPISRSECEVSIKSNCPALNCSTKLPTELSPEYHYASDTIITKDFVVLVTMPSGLDYLEENVRVTPAMTSVSFPLSDGMGISGKKWYLWDSNHPASQCPFSRSQEHGCDAYGDPITLINCRRSRFVIPDVKMSKQLQGSCAHILRSSTGLLYSWQSKNELTTDGSKRIALTAVQNEQEQVAMLRIGTTNALNVLDEDLCFTQCEMLDVILRSDRKREVLTRIGGSYLLVTKTGYIRKCNPIIGCRLLSPHSFCGNPNRVGLTCHGKVYMWNPLKGYVEDGGDCNHHISGSKFSVAVGNHMYHVDDSLHIELPDSEYFGISHDPMASSEDKITKEIVDPTELRQSWEKYKNEELGMVPMFSKENKTVSNWGEGYHFGLDVGFIGRVLADVTTRISWWLTLLGSITVAMVGYKLWGWARKTSRTPIPHQVSYSPVQSAATWM

SEQ ID NO: 16063 - protein, 584 aa, unidentified
MTCGKTFSSADIMRLILPLMLALLFIKAGAITTTPAGRILGQDTAPSDSMSVAPMADCKGAMIDVGEQIRRCYLDCEGPPEPVEGSTIGIHQTEVEGPMVVECLKVRLTQTFTQTWTFSTIKSEMSRVVLQADIDECKKELSKRCPTYNCRSREPDTLDEEYHYGSTTTKSRDMILLYSSKSALFYNEGQQHISPAGAQSSFLAADKKGIKDKLVFLWDEDVEITSCPYRLVGEYGCDRFKDSEEDFYSCNGGRIAVTPRKGNPDVLSSLCPGLKLSEEGFMYTMTKGEAKSSKTGRLSINVMSSAAESEDTSYLRHKIQQMAKKLDSDICINQCEILSLEARVSNQTRKLVRSGLDSYLILPNGTAQYCNPLHGCKLPSKIVYCGNPSRISIICSGVTRYWNPLLPFTEPGGECYKPDQVERLTFTMGSTHYEVDAGLKVKVPNHQYHHKYANEFLRYHNSRLNMRVQDLNELKEGWTAAKGENVIPYEEGKDSTTIDAPHISIGSKIVGTMTGIFSSIKTIEAVVGVFVMMGAVGLTVSLINKIFPSTATKRYGDYTNVLQSLPFGSNKYEPTQQSSNIVWA

SEQ ID NO: 16064 - protein, 558 aa, unidentified; identical to SEQ ID NO: 8431

SEQ ID NO: 16065 - protein, 566 aa, unidentified
MDATSIFVNVCVLLLLSNLLTDATKHKDSSAWSKSIGPLVYCTDDSRTVESIIKECYHHCLSDAEPESRATLSLHQIKKDAKGPNVVECTKVKISQTFTMTWTFATVKSEVIHEYLPVTGAECEDAIAKNCPDRLCNHREKDSLAEEYHYASETEKTETTISLITMSSILARDGEELMISPLSATKFANVKDGGLKEDNKVYTWDSSFELKYCPYEHVQRYACDRYSGTDGMPYYMCAGGRFSVTPLSKDEPDMTKVCSGVKASHEGFLYAKVDSQANQHTHSRLAITKTQDMDANADYLRHKIQQIATHLDSEICHNQCEILSLESRVTRRDSVILRIGLDYFKTIKNASELSVCKTLHGCRLAEPKTFCGNPPRVGVSCTHVSGLWDPTKVELETGGVCLKPDNDETLRITIGGKHYSVDDNLMITVNASDQAGVYPLGFSNLHQSGIQLTVEDMGKMRPDWVDNKNAPGGTSKAIDTQRKIKSPSFDMGSRIVQAWKSVTTEFDSIEHYLGGVAIFLCVSIVSYAFWKLKISSQKLKLKKIRRSSVENVPLKSKTHQEESEWI

SEQ ID NO: 16066 - protein, 600 aa, unidentified
MRILRKRNLILTSLESPLQLNCVQISNYHIAGKIMYNMAPNILVFLTVLCLSSYLIDGRKGATVKSINKNRLSIGPVAHCRGELLDLGVQQRNCYMKCEGYSEPKRGITIGIANAKTKGPPVIRCSKVRLSQTFTQTWTWSTVMGDLLSEAIPTTVEECRESINTNCPTGNCDIRAPNKLEAEFHYASTTRVESLFIVLQSIPSVLYIDDGKEWLSPMGTTGRFAAGDGLAQEEHNHYIWNKVSSLTTCPYQVEGTYGCDEFDEGDELFYACAAGGLTVTPRKSSPMIHPTLCPGLKWSQEGLLYEISKGDPNSDMVGRLGIEAKPDTVESADNTYLRHKIQMVARKLDSDLCYTQCEVMALESRSANKSAHLIRAGHEHYLAYSNGTAQYCGPITGCRLSDPPLMCGNPPRVGIVCVGTSRLWDPLLPYITDDHKCDKPREIEEMHFNLGASKYIVDRQLTIPVNKTELHGVYHSEFFRYHNSRMMMAIDDLSKLKPEWDRAKQGKPTESVRTESTRNVDAPHIMLGGWFLRAWGSIRDMFHSIEAVIGCIVIGLAVYMTVMLILKIKAASTTGIYKPVQMRMTNRSKSREEPERMVWT

SEQ ID NO: 16067 - protein, 575 aa, unidentified
MIQSVYKVLGTFGDILQICINLSRGEEEKVLVNIIITIILFKMAKIIGEIKIRYLLLLLAVISFYTRSVQAEISELHLPPVVKCNEKIEIGTDLLLPCLDRCNVMYSTEKVFWAGLYKYTGKNKVQIGICKKKRITKVAEETWTFSNLHIQESEEYLPVNQAECKSEWKEKCDMKECITSPKDWAPEYHWASETKETRDFIFIDSTHTGYKEWIDGKFVLITSSFKADLSSGWSLSKDGKTGYMWSTEIEKNDGKCKWELSDYYDCYNDKNNDLICPSLGETLKRNSPDIKVDNCPDIYGSTRANQLYRIMGDDFKPKKPPMTVRLLTLGDSSSKTDLAVGALSTFVNLKMQQECIASCYEVKVKKMIPQMMGNQLISATGGELRYCSYDPFCKIQYPLTTCADKEDISKIKVDCESATGWWDLNSTVMLTHDSCHAINKKYPLKLKTWHGKYLINQSGIYHVDMADRYSYPNVVPSLKISIKQKDVFNHGFSDVMVRDSSIVDPQPPEITGVQNPLKMIKGFISEISHKIKVYIFTGIVLIISSCIIVAYIKKIISRIEYRQVNNNNPGWVELR

SEQ ID NO: 16068 - protein, 519 aa, unidentified
MLGLATLLMILLWVTQSRSEFSHHILPAPIICGGQFPLSEYNELSCMSSCNLENFAGKPFNITLYDQLHDTSVVRAYCRKVRMQQTFTKTWSFSTFASDVTVVPLSPTFAECKMAWDAKCKDSECLIKPDPIVPVYYYASSHEIIQEGIVIEAHRYNTVVKIKAEDQIMIDGEFHPYVKGSLYKKDKMTWVMWNPKAEEKCELTPTVSTQCIFTIKGMLNCDSLGIVINASSAVASTVCGQTNGVLIDNLGVVFKFGHFGQQFRTPSFPITRMDSTDAIEELIMAVQLSYQVMKSETCVRSCLRHDGTKALENAEFFGDKIVSNRSGVLKLCHYQPTCKLTLPIRICFGTSLVRVKCGVASYWWSLDTLEADTAYYCASHVAEKERAQLIVNGRALEMNSSGIFLSGNVSKSSFYDFVPKNSYTVVSHEGLKETLTNKNSFSTSWEKSHSSSKTESYNVFIAAWSCITGFFQYITLILTVSGTLIGLIFGYIVLKQVFPLKRATNYKYGHELQTFPIFA

SEQ ID NO: 16069 - protein, 569 aa, unidentified
MTNFQVLVLSVFLLQCLSSGYCADVTTAKSMADPKNPPTDSVSIAPVADCAGNAVDFGTLVRACFVRCAGPPEPEEASKVDIFHMFGEGPRVVECVRIEFSQEFTQTWTFSTIAGSMKSKPVYISEAECISAIEKNCVNYDCNMREPDTLTPEYHYGSVTTVRSTMIMLMSSPSTLYVENDIFHVSPTGSELRFDMSKEIGRSKESIYVWKKITAPDTCPFKAVGVYGCDRYKDNDEDFYSCSGGRIAITPRKGNKDILKACVGVKLSEEGFIYNMTKGTQKEASSGRLAIDARPGTVEAEDTSYLRHKIQQVASKLDSDICLNKCEIMSLEARSSNKTHHLVRAGMDNFLIMPNGTAKYCKPNHGCKLPEKPTFCGNPPRVSIICNNHARYWNPLKPYTEPDEPCYKPDELESLSFSLGTTHYDVNKGLRIKVPQSAYHNSYSNEFLRYHNSHLQMSVKGLDDLKSGWRESQSTGGGLGIITNAQSEIKSPHISIGDSIVKTFGSVFSSVKSLEAIVGIIFVLVIVGASLALLERLTGLYSRLRGPYKNVPTTGIEARDASEGGAKWI

SEQ ID NO: 16070 - protein, 552 aa, unidentified
MSSLIHLLIVLCSLSSIVLGDNFFNTTVGPYGVCGSDHLNIETVLSECYSRCVRPPQPNGGFTIVVHQSDVQNAGPSVVECRRVTLEQIFTKSWLFSTSRSEPRVTYDLASESECRDLIQKNCPSYDCNIREPHSLEEEYHYASDTVIKKTFITAISMPSSLTTDGSKIMILPLGSESKFDISLERGLSGLAVYIWKEITYAGVCPFKPAASYGCDFYNNVAADKHYLCAKGGFSITLGWSLERAYPACKGLSISREGLIYEPRKGDNLQLHSQRLDMTDVQYKQEDTESFRSKMNHVLSNIDSDMCMMQCELLSLEARIKRESPRLLKIGKSLILLEPNGTGIGCALAYGCRLSRPHVFCGSPPRMGVECTGQSGYWDPSTPYLISGDSCAKPRKNETLTLTAGHHVYNVDDDMTILIPSGFMHGKQLDLFSRDHMDGLQFTRKDIADLRSSWLNTKNSDASSYHETETARNISSPSMTLRLWEVPGILAHYLAHKTKEIIVFCIVVGVVLISVSAGIKFVLSPLFSSTRSVENRQRAETMQEYQPVATWI

SEQ ID NO: 16071 - protein, 576 aa, unidentified
MLTILITAIFTQLIVRRIEAFFTHWKEFVIGIFIRMLLFGKYLFSRAYDTLKVRGNRLFYGYLIVVVHVLLFKVAYGEEMSIQMPYNCPSKIPSEWMNPSACYRSCNMDGLTSQVQNLTIYQHDVKESMNILECKKWKSTVTATETWTFSKLPYKEENKPEDTNPTECWSKLKELCNNKECETSKPQYSVDYSYAADVVKEYVWFQLKYGSAPIPFSYDEESYIRLEGKNIDYTAEQAYSLKDEKKLILWKVNTSLQCYPQAVSTLQCNQLFSSTNSVSHYICGGGRFVITAGSQLNTRHCTYNVPTYISDEGIIYSRSSGSDLVKDGLPIFKDSLNSALKEIVLQQRVQSIMASEQTCKHSCLVPYPKENGTIFYYGNRRVAKLDDKEFLLCKEDLSCILIKPLQFCAGDNLLAVRCSGARLWWDPSTLYVDHYTTCRSTPSGVPSIKFAAHGAMYTANTSGVFYLGGTEIKKQIDGPSIGQDLVLLGREEIINALRSSPDLTGQTGSVLNQNVKRAGWNFGIIDFLEKLEHEVKVWAMLMVLTVCGVIVVYLFIPTTYLRKGQYRKVQYQMREF

SEQ ID NO: 16072 - protein, 788 aa, unidentified
MSSWFFACVCFVFSLLPLFQRSSSRPIFHYGGSDSRPPPTLPPLQHALQNALAAARLIDPPLFPSFSRPTTTTPPTPAAPPSSRAPTTARPSPATSRTRKLYIVRATSPRTLPHTTPSRTTPSSTLSITTFRPTAPPQTSPSTIRTSPTLAPVTVRYSPPTSTASSTHIRHHHTTAHPTRHTHMHGHGQAQVRETHTDEFRRDGAGRPFAVVWQPSTVRSIGTRTWSTSGASSAVVVRKRASEEQKDPARPVVLRPRRNVMSLQIPSMTAENETIRLENTVWIPVNGAPTVSILEQMSMASVESELWKKVATDVRVFREHALEKEGFGCICEKTSVVDTCTNGWFTVKQEHTSRREEHPAYDECFTKCVAARANELKEKKAIVMKDPGDLDCPSKFFSNTYTLVKSEFLLSWVEIHTGEGGTTARFSRFGIPQACLIETGECTGTQERVIVFQNTLRNVACNHEAVTAQNCTLYAPRDNPVRQTAKVVCEKEEREYFPHERVKSVPACLGRSPGNFFLATTGELLESDSAQTIGEKDMAFSSGTERLDHADFLIREVARLVGRIELSIMRELRQLQGSAGNECPTKQTYLSGHYAVGRGAGVSVGTPLEKAEMCFVSPVVVNATLKVKCTHRGSTHSLYYIPESGMALPKACGARQMAYAVVINATHRAVLTGRQFMLTNKLQTTQDEIALARLSGSSLGSGSDDRGSPVLPHNDVSDKDEARTGSGVADWIAGALDWLLRTDVLIASICIAGGVTVLVLYFFCPCRPRLVQTPTGVSSIALRELLKK

SEQ ID NO: 16073 - protein, 561 aa, unidentified
MSANWFSVCLLIMTSYCLSTLSLSSEPPSEVYLRHTIAPVAICDDNKPVDPHKKIEECHTVCNFEPVSQGKAKVTIYKDNSGSKKYTAVMCEKWKLTQTFTQTWTFSTVKGDLVKERIKPSSDECTDLVGYRCPAHNCDYQLPTSLEEEYYYASTNTKTKEFVVLTTVPAIMLHYDGTFRIQIAHEKEAVRSSDSPWDTGSRVYMWADREAESCPFEAGMVVGCDRWKTGESMNYVCGNGRLAFEASGSIGISKHCAVGTRMSPEGIIYKEEKGEAATGYNAQRIAMVPDNKLSSDSETLRVLTSNSLMHLDSDMCSLGCEMSGLELRVARRQSTLIRTGAGYILLSPKGHGYDCAKAVQCSMVKPYKFCGNPPRIHVMCDGKFYFWDPTQSYILLDNGCHAPSQSENLYIHLGSKKYLIDDDLTIEVHTNETDSVRTVGYAINKGSLINYEDIPEIKASWVQAKGTQRSSIETNTTKDIDQHSLFNYSWLSPLKAVSTWVSNSINNIERGAVVLIIIIACVYISKPIISYILNQRHDVRAFSPVGIRRRRNEGVYEVEMI

SEQ ID NO: 16074 - protein, 542 aa, unidentified; identical to SEQ ID NO: 15152

SEQ ID NO: 16075 - protein, 533 aa, unidentified; identical to SEQ ID NO: 15198

SEQ ID NO: 16076 - protein, 538 aa, unidentified
MSLSCALIYLSSLFIIRGITGMDIVPNTVCSHLGGIHHEEFQHLCLGACESSSSTPDMTKYLVMMSSTDGFKAYGYKITLKRRTVSSHTSFFGECQISASVVDAEPGVAGPSLIKEIIAHGGPGGSMDFTREPSCNYFMDHEVSGILVDYHRSLMEVKDSPKNGYDVTFLESGAQGSGLSGHLYSGNILFAWDITDQIPKCKFRVVGSTMCKITDDLVKCKGEEMKNVESLPVDCGIQIHKLNDGTYIGESPSRLETLPSSLETSIYGLYQRVNDIEGILCQHLCQEVEADGIMQHNEFLMTTPIGNWLSVKADDHRMMYQCVSIVSTITTPPVICGSGPLVQVMMGNKPVWWNVSSPYINPDTSCIPGLSTEMIVDGRIKTWLGEVKLGDNGYTFVGRYTDVHYHPAFRPSQGMSLVKRDDLTPLVHGLVAASKVTYVKHNLAEHSSSMGSSILRSVVGAFDAAVGWVQGLWPSLKAWVIKLILWTILILIIILIIWFLVWLIKLVIKRRLSPNPVIIHQATPNGENTSLMEWAKQK

SEQ ID NO: 16077 - protein, 552 aa, unidentified; identical to SEQ ID NO: 15491

SEQ ID NO: 16078 - protein, 539 aa, unidentified
METMQMIMCQMLSTLFLCFLCGGMSIVPNTACSHLGGIHHEEFQHLCLGACEASSTTPDMSKYLVMMSSTDGFKAYGYKITLKKRTISSHTSFFGECQISSSTTDADPKVAKEPLIREIISHGGPGGSMDFTKQPSCNYFMDHEVSGLIVDYHRSIIEVRDHPTDGYQVTFVESGARGSGISGHLYSGNILFAWDITDQLPKCKFRVIGSTLCKRDNNLIHCKGEGMKEASELPTDCGVSILQLDDGTYLGESSSKTEGPASDLESSVYGLYRRINDIEGILCQHLCQEVESDGIMLHHEFLMTTPIGNWLSVRADDHRMMYQCVSIVSTIILPPVVCGSGPLIQVMMGNRPVWWNVSSPYINPDTSCIPSLSTEMVVDGKIKTWMGEVVLNENGYSFVGRYTDVHYHPAFRPSQGINLSKRDDLTPLVNGLVSASKVTYVKHNLYEHSTSMGSSMLRSVAGVVDSVVSWVQGFWPSLKAWVIKMILWIILILIVILLIWFLIWIVKMLIKRKLSTPPAKVPVLISGDSASLMEWAKQK

SEQ ID NO: 16079 - protein, 596 aa, unidentified; identical to SEQ ID NO: 15524

SEQ ID NO: 16080 - protein, 716 aa, unidentified
MTSLKNFSILLLVAVPLVLSKKEGWVGYLKDPLTPGEIRLEQPPLGAHQKLSTAEMVTEGLVNSTHFLVQFPSVGRWFYLPRVLAPPPLPPSVTVVHSHALVLDSRDKVSSVRGPNSLFLPSTEALRFFPFSPQLTSSPQLIPPISCQLTENPQLVPGVLRVWGPPAHSSTLEGTLVTCKTKSENCTKYFFGAEQISLDWDKPTSCNQFHKSLISQHKSKLKTEQTLTIPLVQAPCLWTGTQTKSEDYLFSQRVKVILSADGYVSYPPGFSLCRAFNDSACSSSFQVLMLDHLIDDPSSCKSLEVKLISKSFVQVDKTKNGTLHLIGIKDPQHQLGFSLEGAKKVCTKEGHQYTHQLLLTKSSYLISLFLLPDNSTTLNISNTPNVVRDLPEDLTYWKDLKSKNQPSPSSHHSISMAIHQWKLHHKIPLRTHYSESEMIYGLSELSEKTSRAMYALFSELCRMSSQIWKLAFQSWTLNPTLMAQVLTKDPTVIGENRAGRLIIHHSLPSGPILIPKDTTCRGDWMFVQMFNVTDQTYAPVWLQKVSGFIVPFTPKIPISVHPENFLIPFNQTHFFDILQKDFLMSLPQNTFKWNHTLPFFSSDLTLERSEITSLEYVSRILDEISLPPTSNDLPQKKDRDQGVDISRHWKNFADWISDFFLSWRVVVFFIIVFILYALFRVGKRALTCCTGKEVPPPPASPLHGPWFSTGRQASPV

SEQ ID NO: 16081 - protein, 719 aa, unidentified
MRTIQNRRVLLVAWLLISPSLGAIWISEGGDSSSPGSIKAGQPSTGHHKKISTKGLKIEGPINKTHSLIRLPYANRWFIIPSQLLKSQIPEAVNLISTRLSTEVRNPSLPLITTSQGHILPSLPNLNFFPLTENFTSKPTLAPPLNCETENSSSLMPGVLRIWGPPSSSKTVEGRLVSCYTKLENCTKYFFGSEQISTLYDRKTECNSYHLQVMDENIPQIWNSIQWTHPNVQAPCLWTGTQSVREDYIHSEKVNVILSSDGFVSFPLGMSFCPAFQQTSCKSKSQVLFLKSLIKDPSGCDSLEIKMISKVFISLRQFNKTNFIMSSIKDPNHQLGFSLENAKQICHKDGKQFFHSLLLTKSLYILSLLPLDKKENGTLGLESLSTWVRDLQEDEDYWKSHHPENNTETSDPKDQTASAHQWRIHHKIPIRTVFTEAEIIYGLNQLSDLTEKAIQQVYLEVCKLTRTIWQLAVQTWKTNPTFVAQLISKSNNVIGENRNGTLLIHHSVPAGPLELKLPLEFRGNWVKASMMNPFSRNAQVVWIQRISGFIVNHTPRATPSTMPPPDFLIPFNQTHYFNILDGSPLVSELITGFMWNSSSAFFSSSLTLERQDTNALEQISKILDEVAQPPSQETVPVPDRGRGIDISHHWQDFVTWITSLFSSWKLYFALILITLCVLIIRCIYSKFRTSRVIPLEPSSPLSFHSWVSHEPSTQLSSPV

SEQ ID NO: 16082 - protein, 508 aa, unidentified; identical to SEQ ID NO: 15530

SEQ ID NO: 16083 - protein, 507 aa, unidentified
MEWNTFFLVILIIIIKSTTSQITQRPPVENISTYHVDWDTPLYTHPSNCRKNSFVPIRPDQLRCPHEFEDTNKGLVSVPAQIIHLPLSVTSVSAVANGHYLHRVTYRVTCSTNFFGGQTIEKTILEAKLSRQEAINEAGKDHEYPFFPEPSCIWMKDNVHKDITHYYKTPKTVSIDLYSRKSPNPDFIEGVCTTSPCPTHWQGVYWIGATPQAHCPTSETLKGHLFTRTHDHRVVKAIVAGHHPWGLTMACTVTFCGTEWIKTDLGDLIQVTGQGGANKLSPKRCVNTDVQMRGATDDFSYLNHLITNMAQRTECLDAHSDITASGKISPFLLSKFRPSHPGPGKAHYLLDGQIMRGECDYEAVVSINYNSAQYKTVNNTWKPWNRIDNNTDGYDGMIFGDKLIIPDIEKYQSIYDSGMLVQRNLVEIPHPSIVFVSNTSDLSTNYIHTNLIPSDWSFNWSLWPSLSGMGVVGGAFLLLVLCCCCRASPPPPSYGIPMQQFSRSQMV

SEQ ID NO: 16084 - protein, 507 aa, unidentified
MEWNTFFLVILIIIIKSTTPQITQRPPVENISTYHADWDTPLYTHPSNCRDDSFVPIRPAQLRCPHEFEDINKGLVSVPTRIIHLPLSVTSVSAVASGHYLHRVTYRVTCSTSFFGGQTIEKTILEAKLSRQEATDEASKDHEYPFFPEPSCIWMKNNVHKDITHYYKTPKTVSVDLYSRKFLNPDFIEGVCTTSPCQTHWQGVYWVGATPKAHCPTSETLEGHLFTRTHDHRVVKAIVAGHHPWGLTMACTVTFCGTEWIKTDLGDLIQVTGPGGTRKLTPNKCVNTDIQMRGATDDFSYLNHLITNMAQRTECLDAHSDITASGKVSSFLLSKFRPSHPGPGKAHYLLDGQIMRGDCDYEAVVSINYNRAQYKTMNNTWKSWKRVDNNTDGYDGMIFGDKLIIPDIEKYQSVYDSGMLVQRNLVEVPHLSIVFVSNTSDLSTNHIHTNLIPSDWSFNWSLWPSLSGMGVVGGAFLLLVLCCCCKASPPIPNYGIPMQQFSRSQTV

SEQ ID NO: 16085 - protein, 508 aa, unidentified
MDTTITTPLILILITCGANSQTVKPDTASESDQPTWSNPLFTYPEGCTLDKLSKVNASQLRCPRIFDDENRGLIAYPTSIRSLSVGNDLGDIHTQGNHIHKVLYRTICSTGFFGGQTIEKALVEMKLSTKEAGAYDTTTAAALYFPAPRCQWYTDNVQNDLIFYYTTQKSVLRDPYTRDFLDSDFIGGKCTKSPCQTHWSNVVWMGDAGIPACDSSQEIKGHLFVDKISNRVVKATSYGHHPWGLHQACMIEFCGKQWIRTDLGDLISVEYNSGAEILSFPKCEDKTVGMRGNLDDFAYLDDLVKASESREECLEAHAEIISTNSVTPYLLSKFRSPHPGINDVYAMHKGSIYHGMCMTVAVDEVSKDRTTYRAHRATSFTKWERPFGDEWEGFHGLHGNNTTIIPDLEKYVAQYKTSMMEPMSIKSVPHPSILALYNETDVSGISIRKLDSFDLQSLHWSFWPTISALGGIPFALLLAVAACCCWSGRPPTPSASQSIPMYHLANRS

SEQ ID NO: 16086 - protein, 512 aa, unidentified; identical to SEQ ID NO: 15560

SEQ ID NO: 16087 - protein, 504 aa, unidentified
MNYTLPTIILILTHHAWSQVTHKPGDAHVVPEGEEWQEPFYTAPRSCILDTFSPVTPNQLRCPHVFDDENKGLVTSTAQITHVEIDESSSHFTVAGKMVHKVQYLVLCSTGFFGGHSVLKKILEVPLGEGEASQYALEDKEYPFFPEPVCAWLTDNVAAKREFHYSIPKDVIKDLYTNQFIHPDFIGGKCNRSPCKTIWNNVVWVVNRDSATYPTKSTEEGRIFTRKADHTVTKAVVPGHHPWGLTKACSLTFLGEQWIRTDLGDLIQIVADSGTKKVSPFKSCPDGSVPMRGHEDDFGYLNHLIMNMKNREECLEAHNEIVTQNKVSPYLLSKFRPHHPGRGLAHYVLNGTIFRGTCVYDGVYGVSDNNSLYMDHEGTWRAWLRTPEGTGYDGMELGEKVIIPDLEKYKSSYDNGMFITTNVKLVPHPSIEITSNTTDEETQEIHPFHEPNMKLSWSLWPSLSGLSIGTLCILGLLWLCCCRGPPQVPTYSIPMHQMTRNTPI

SEQ ID NO: 16088 - protein, 640 aa, unidentified
  VARIANT 497: note = Any amino acid
MERYSLCFPYVFALITLLLCSITGSKSDDGDDFSLKRQSAKDKNPVYLSSSQRGYGGDLYQPYYVCGTTSDPEGMPLSAWHYSCKQSCASQMAKQAINITLMRWDFVGPSLNVYKVTTNKVCYTSHENVWGYCSQTQTITPVPTTKEDHKNLPQEYFTPWGMPITGTKHITRSGEAECSYLSDNTRCERDYTISYREGKIQKRSDQDEEVLVIYRDGIKTDPYASFLQMNDASWFWDVPERPIHLPCGWKSFDLVTCMYTDSTDILSCPTLGYTYNIPKVSKKSTCSGEIYDIEGPVPFKYSSSEDLTDRATLFKEAVPEMSKADIKMIEGINKALNNIEATYCSSSCDLFARSGIANDDHVLDTPIGSWRFSNEDPLFPRLIPCHPTAEWSLRSPTSMCNGANTLLVENKETGHTNSWMTKRDYIILGELCTSGSQDKVMSDLKSQISEGKTINITFWTGDILSLTPPYKSPKWYNASLSFRKNPSWFSKVKLEKXMLHTQEDISRILTETVGNATDELSYDMGKSKTIHEYLFEEIAHGASYAGAYIMTAVSSIFGSLTKIVVGILLFVFIYISVKTLILVMPVMSFFKKKPTMRTSFSPVVSDIQDSRMTWELNEIPSRNIKRSNRALKKELSNMLL

SEQ ID NO: 16089 - protein, 640 aa, unidentified
MDIQPLQTVLVSICFIAFVFCSTMEGSDDTQEDKFAWKKAEAKKENPTYKVAGEIGYGGDLYQPYYVCGNIDDKGGMPLSAWHYSCKQSCVEQNKRQKINITRVRWDFTGPIIHTYKVVTNRVCYTSHVNVWGHCSQSQTITPVPTEESDRERLPPDMLTTADAVPGTVNIQNSGEAECNYFSDNTRCGRDYKIMYREGKLIQKSDDAPLLLAIYRDGIKTTPSLGTLKLNDAIWFWNPPSSSLKIPCGWVGGADLSCSFTDSAEIMKCDEIGYTYNIQTLVSKKTCLGTIYDVDGPAPFIYKSREYYDTRSAILEKAIKDKGDADVAMIKGINYAMLEMETTYCSAMCDVFARSPGGEEDHVLDTPIGTWKMDLTPNKTPKMIPCQATSSWRLQNPTTLCHGGNHLLVNDSVTGHTNSWNVRKDYIVLDEMCNSSPKEISQDLNIIKKRMMNGETINITFWTGDVLVMKPPYNSPSWDKVARSFRQNPSWFSKVKLDKAMIHTKDDIASILTTTFNNITTEMYYKKSLSKTIKTFLIEEIGHGIGTVAERMWGFLTSIFGGFTKLVVFITFCSIIYIVVLIIRATMPNMFQKSRANYKKQTRFNIPETNAVDVPLRGYPENYERSAARRARKEISALLT

SEQ ID NO: 16090 - protein, 650 aa, unidentified
MASFRRTCKTFHVYFIVLIIVALSQAVKIESDTQKQDKFEWKRQSARQHNPTYQSTSERGYGGDLYQPYYVCDKNNDTDSMTSSAWYYSCKQSCTEANRRQRINITHARWDYTGPSVNVYRVVTNEVCYTAHMNVWGYCSHTQTSTPVETLKDDAANFPKEYLTPWSAAVPGTKHIIQSTKAECEYWSDNTKCARDYTISYREGKTSQRSMEEPVFMNIYGDGIRADPYTGFLQLNDASWFWNPPSRHDVQTCGWKTMEDIQCSFTDTAEVLKCDGLGYSYNIQSLKEAETCIGKVYDTTGPVPFIYKTREYYEDRASMTTKATAGKVDADIPLVMRINNALTELESTYCASSCDLFARQIMNDDDHVFDTPIGTWRLDISDPLNAKFIPCKATSSWKLQSPAALCHGKNQILVQDEATQHTTSWDTMKDYIVMDDLCSTLEGTDIGDKNTYKGKIARGENITVQFWTGDILEMSPPYITPVWKNAAKMIRANPSWFSKVKLDKTMLHTKDDISALLTQAFTNIMSDISYKEKKSMSIRNYLFDEMGKGITSAAKSIWGVLTSIFGGMAKIVTCLVVTILLFMVIRLVLLALPLMSLLNWIRPNQHRVRFADELKQDYPGHPVNNIIKQDDRHMRRRPRSARKELASLII

SEQ ID NO: 16091 - protein, 635 aa, unidentified
MHIRHLVRTAFALHLLLILQIATANEDIFAPFKNEIQASNPIYEAAKRTGYGSNSLQPYYICDNASSGGALPLNAWHYSCKQACVEQHQKIEVQIRRAHWHYVGKDVPTYKVSTNQVCYTSHENIWGYCSHTQTITPVATVPDDRSKIPKEYLTEESSMRGVTSIINSGHAGCEYLSDNTKCARDYVITYRPGKTSKRSMDDPYYLNIYGDGIRVDPTSGSLFQNEVAWFWNPKGIEETHACGWEYEDPTVCYITNTSEIMSCPDLGYQYNIKNLVSTKTCIGEVYDIDGPAPFIYNSQINIDNRTHLSDEASKGKGDADINMIKGVNFALDRIEEAYCSSSCDLFSRGHPQDDDHVLDTPIGNWRLAGADSYIPLLVPCQPTAVWRVKSPTSMCHGKNHILVEDAKTHHTCSWDATKDYITVGDMCMDNNEQANQDHKTMRKLMSENQNITIDFWTGDTMLMRPPYDKVEWMNKSRIISANPSWFSKVELNKGMLHNTADLSHILTTMAVDMKQEISYNKTADRTIRTLFFDELTSGIGGVVSKVGSWLSSILYSLPKVALMVIGVVAVLLLLKQSFTYYIIKRERDITRRSVHFLEPEEAAEFVHKHVDPSAPSRRHGSRSRRLAKSLIEMGI

SEQ ID NO: 16092 - protein, 597 aa, unidentified
MAIKAIYFIHLFFILSSSSILSHRQVKITDEASPPTQKELYPIYTCPGEKESVSLETWYGACRAACKMTENVTTVSVNVYIQNDTVGMIQTMKLTPSWTILSSHEDIFGECSIHREANPFKSPAREEVKAVGESLLRDKEYAGRTSFTFSQVGDPPCEYFADHAVSGWVYSVQSENWPLKIDASGNLYIIDTSSGAIALYQEGALQIGNRWLVWLHKPVLTTSCYFKEIGEDTCNFNYDSKTYSCQKLGIAFSTKIQETIHDTCVGNLNVSEDGIIYSIKRKISAMPLKDRIELLWKRTPETHIREIMTATNEGFQMIENSYCEFSCDTIDYMLSDDTKGAHVVETPIGPWAASRVGHHTRTIPCKSDIDLFIAIPITLCHTLSLIKVRSLSTQREYWWNPSKTHVSVSDECNQDDINGSYVESVMLNRDPVRIQFWGGTVSIEYPYNQSYIWTENIQGKVHRSSKWFPKVSLPEYKKHIDIVSVSKELLEATKHIYSIVRAQEVRNDRESVIKKGWTLAKKLQGEIFTEAHIVWNDVVSWWGGLTRDFKIILIIIASIAGAVLLHSLLGATTRRHNKRDGYRARPRDIIIEGNPLL

SEQ ID NO: 16093 - protein, 669 aa, unidentified
MVLLICLFIFCFSSLNAITIHTKDFDLKIESNLRCDPIKFPPRPQCSHLPSSVGYKDSVGIAIWRQDTASLEVPGFCLTAHKITRSCSYKYYLLREEKIIKSEVIDIDKNSIPTRDTLISLQLSSHPRTISGEDTVPCFWPSQNTITTHILSGKACSMRVTKAGLILSPQFPNCVLKNNVTCVGKNKQIFVQGNEVTKFTDCPVSLNSIDVGVIESTTIRGKDKGPADLIVSSDVMKQLFFWKLQNSTPPVHLCVHQETSLKVYEDDGGYLISVIFMEKGINDLSDIVIKWKAKSSNAKRNFSEVSQFFSSGIMHDLKRPKREAISPRPPMTWTELRELILKEAGEFDYPISNTRPKREVLNTTSVHTSLGGVTSLQRSLARSEYQWGFHSLINKMAGTMEPYGQEICHIKIQLWEQLSTNNMKGITTFLTPEPGAFLRQTITGTELCVPMLITGSESFELHLDEVENNHWIRVSQDNKTIGYLENFSGIIKLSTLSVVEKQGIFKSFYIPLKSGCSYDLSDNSISCPDHFPVSDISALDYLFHLPPLYSLQDMSNLVLNKVNSEYQVPLVYKPTENQKFLTGLAGDSFINLVEPLSAIIYSTSRNLWTWVYLILVVVVLIKISLFVVHYRLKILGSLSFKRNNKAIGETTYERGSSDKEIGLHHFSIH

SEQ ID NO: 16094 - protein, 526 aa, unidentified
MTLITIYSFINILNILTNMSPQVSSHLYPLPSETPWLKLNPDNLRCPNSLQSSNIKNLTLPNTYKIDVISPLSHPTMSGHICRKARITSSCSETWYFYQTSTVSTCYLPVSTYECKEAISNFINQPSKIFNPPILTCDWNKDNSISHEEYIIEHHPVLYDPYHNKFIDPIFPTGQSQINDSQTVFENTLWLPNGDITLEMCAKSMSEKAYLVGKQDQPELLIPGYSILDLSSSCRFKYCKNYGIRFKNGVWIGIADLVSYLELSSNFQINLCDETTQIRTKALEKLAVSTTIDIVLLLRCQDVISKLINNDKITPNDLSFLTPAHPGLFPSFLIKDQQLYSKLSHYVEIDLSNLNHKENLVGTTLDGKEIFETHWEVLSDVNNTFISQNGFIKINNSIIPPLSYNLIETYKLELWTELKLDKFQQNEKLSRKKIPLTVNNGTLTITQLETASEIITDIETTITSFLPDFSSRIRELSILLLFIIILIIICIIIKKKSTNNNQRHISLRTELNPQNKDQSSFESMFD

SEQ ID NO: 16095 - protein, 565 aa, unidentified
MDVISLLELSLRLIQSYSTGEILQLICNLLVMLILIRLSSLFLRLPLTLLIIILLVLTISSRNVYGDDHVSLPPAVLCDKNPPEKGDIVESCLTRCNALVDTNKLSYVRIYEYTGESIPYASCRKVIIEKTATETWTFSQLPITTKISYSTVSKTDCLNAWEKECGRKSCHVTYRDFTPQYRWASNTIETREFIEIDATKQGVEEQIKRGHVFRTGGLVVDFKDGGYLDGNKGDIIVWQTKESKSEDCKWKLSSIYQGYTTQESNILCPGIGEVLKIKDMDYLPKNCPSMVLGMTRTGVAYDIRETLSDTEKKILKEDKRPILKASDPAKLDLVADAVRMAMNLDYQRECIGSCYHYDPSKSGIPQLVGGQLMFIEEGNKKKYECSYNPFCKLLHPIRHCAESNLIMINCDGRQNWLNLSTTVASPSYHCSRISTSLPVLIPTWHGVFSLQEGGLVYNKSGLFGEFPRANIPHIISPIKDFNSGLDGITSKLVDSDSKTAKTSGIDIFLFTNVLLWLRRASHYVKVMIVSIFLAIVLIISLVMYLNIAKPLKQRYYQGVEMAERM

SEQ ID NO: 16096 - protein, 605 aa, unidentified; identical to SEQ ID NO: 8741

SEQ ID NO: 16097 - protein, 525 aa, unidentified; identical to SEQ ID NO: 8753

SEQ ID NO: 16098 - protein, 538 aa, unidentified
MKKTSGLSTIKLFCVLVLNLVSSSLAKMVLPTDFSKTPHLFDYSTIKCPLGNLHLPPTSPNQFKVKVTTSSLDSSPKIEGYLCHKTRLTTTCQTGFLGSNSISYSKTNIRILEEECKLATNRFIKNLLPTPEHSPADCVWMKNQDVDVEFITVVSHSVGFDPYSFTYLDTIFIGGESQINSSPTIYPSSWWLSSSDASKIQCLHQRVHDGIAHFPAGWQDNDKYNKGGLLWSSTFRERSFEGACALRFCNKTGIKFRNNEWAMLEYTEPKDNVKNDWVKSLNNCQNVNIKIADPFKVEEHESDSVLAILYFELCLNTVSKLTNNLIVSPREISYLSQPYPGVGPAYQITSSGVKTFLTTYAYIQELTDGESNKIGVFDNGTELEFTQWSNFSNKLHGPNGIIKSGQKILFPKLLNLRYNLEAELITGVQLTPFQEIQKQVVSKQQMLGDPDRHALPVDGTFKTEIMLTRGGQAISDIGNAVSTFWDRAFWVIILVLTFILMGLLVRIVRGLQDCCQKRRVEGNSERQARNEFELIRHV

SEQ ID NO: 16099 - protein, 551 aa, unidentified
MSNKQLFFVISTLVCLCSCTWTQSSLEHYHKISPVAVCNTFKYINPYDSLDECIHRCSNALDYDGSASIQLMQDYSQTESASSVMCHKVEITQTFTETWTFSQIKSAPSFKMMPALKEECSSFIVKNCKDHRCSKRAPSEINPEYAYASTLTKIEYHLVVDSQPSTIFEFDGKLEISPGNSKLTFDLEAGYGLDGDIHYFWDTKQSMKECPLSPGLRMGCDVISTDGMSSMFCGGGRLVVDSGKARKMSGPCSNIMITPSGIIYKIVERLPGDDNNYKNQKIGMNPYTALSGEADRTRILSQHAIYHIDADLCALQCEVSGIELRLGRQRMTLIRSGAEYLLITPKGHGHPCSPITHCKLHKPLKVCGNPASSIAVHCNGRDYFWDPRLNFVTSHSICTDPNSDSEFHIHIGNKLYSLDSNMMLNVSSDDQYTHKSRSYLLSHESMLTPENIEEIRLHWGSEKIKDIAYQAEESKTDVATFSLGLSAIGETIGGWFNSIFRILSHTEITVVLVTVSAIAIIVGWKIWKTGYTRAPRTRVRSRSDHAEMEWI

SEQ ID NO: 16100 - protein, 643 aa, unidentified
MGGKYKVLQMCILFIIVSTSPTTGAEDPFKNEPEEIILKHPNAVQKTDGSFVNVEEIFQPRYVCDNSITDRYVTVPSWHRSCVASCKEEYKKEAISVRLMNWKKTHKTIDAYKVVASEVCYTSHENFWGYCSQTQRTTPISPDIKEVRQMYHEMQLDKTPLQGDKQIRHSKLAECSYLSDNTECAVDYTFMHRTAQVYQETMLSNKEIDIIADGISSNLTSGDLILNDAAWIWNRADIDVECSWDEGARIDCHYKESSAILECPEITYSFPLHRLKKTPTCKGDIYGVDSLLPFQYIESGDVVTKTEQIEEAKKHSSQKSEIELVRTINQALLDMEKVHCDSFCDLFSNVHAHNRGAVINTPLGPWLLVREATQPHERLYACKQTSDWLVKKPLETCGISDAIVVYNTISGKSGVWNMTREFITLDESCNSLRQMDGTIYSQSLATKISEHSKFDISLYDGSVLSFSPPNYQPTWYRGNMVNRGVPDGWFAQIKAHPAGLVEMDDLVHLLVAHVNDTRDRYNISPKSKKTVASLMWDEVLQGAKEAGKEIYNFLIGIITSVQKLLILLIVGSLIYFTIIRLWKSYKDKENRMVKSVKFIASDDAVDYYPPSSPNMQPKRSRSRSRSRNNRRRDSSYDSLKELK

SEQ ID NO: 16101 - protein, 472 aa, unidentified
MVSLFLRLNVMERSSTVVNGNKKLSRKTVYNPRRARFLPLVLIGFLIGLLSSTCGSPCLEAPDKVLDKVQNLLVAKKIVPLAGFLKKSPTNYRLLPVLRPPPCGSQTFSTSSLKGHMATALQLYQYDPSRTPSKVLEVEAVRITTTCRQYWFSTNKQDIVEVIPEAIKSLSQQNFDYLVGEIMKKLDTLELNKDYYETFWQELYSCPTFSFTGTTTILGFKYKKIVSSWAIGGFLISPMYLPTCRYTIKGGNGECAASKSKKYYWKDSPESGGALIPTLTIAGVLETLTSGSSCVNLTRFVSTDSKFQVTLGNILASDLVPEVWHDGTPVFLSQEGHLFSFWPHQGTVVFKAVCPGWPHHSVKQSSRGKREAWSYPFWFPSLAVQSPVNLSLTAPRQKRALSQAAMDFPLEFQTLMLAEAAAWTRSELLGQLSELSNRTVREIIELHFNDCKIRRQISMIAQAIIGLDERPF

SEQ ID NO: 16102 - protein, 668 aa, unidentified
MSLKLLHHIERGIGLLSCLVSNLLENRPEDLEKTKDKYKGLKVMFLLHLIIVVLAHEVAGTETQEMRIRVYHMTEWTQSAVPPPPLCTVRPLNHTNPIPTRLTIWHMIPHQQVGYGYIYSKYRLTTRCRMGLFGQQSHEILEKLPLASTVDEVLMQTSHPSLEAILDLTPDPAYRCVWMSSQDHASTRQQVQTVTLFLAENGCVLANNRVWCETSTRTVWSNGFDLMVADIQISQRCLYEPYRSLEGLMYPASQSAYVFLAPTGHYRVVVNLKNRVTSCESKVKELYTSDVGTPVSLNVSLTYPGRPHMSNNVPSISESNALRLSQEEYANQMNFQAVNAALQTLDAMICSNRLEQWTLAHRLKDANILAAYITKDPFAQGKQENSTFLIRVRASEDLVVLKTHIMVQGGNVIRLLYRGEWWYVAPTSGILSRDPPAASLLPPLLETPDGGMIDVKSGALKHFDWKTVGVNITAISPVIFEDQYTQDTVDNIINLEDRILTITWFPSLFSHHSMAVGVVVIFLISFCLVKNCGPRFLDSYCRWRLACRGPRRRDRGTSPPTPPRQEIVNDPPEEEEEREPAPPAEVFELQESGSEGSVSSVSTGSSDDQSERPLGRVLLRSPPKSQLGILDNALAKRSQAVALTTRHPLAFYRKTPRQVRLPRVPSSV

SEQ ID NO: 16103 - protein, 579 aa, unidentified
MIIPLILLSCLSHLFVRKVERYIQSWVDPVVIMVLHIIVAIKEGSKKIARFFQDRGNRLFYLYLTIVVHLLLIKIAYAEEIEVAMPYYCPKKMPLDWMTPSSCYRSCNIDGLSTTAVNLTIQQHDVKQAIGILECQKWVTTVTSTETWTFSKLQPKEEDVSVLVQANECWTQFDKICKSSECETTRPTFQAEYAYAADTVKQYTWFQLRYKTVTVPISYDDDSFLRLEGQNFDYSSGQATSPLNEKKLLLWKVKDSVECRSVPVATIQCNQILDTDGTVTSYICGGGRLIVTAGKELSSRHCSYKPPAYISEEGIIYSKGSAAGLVKDGLPLFKESLLPAMKEIVLQQRVHSILMQEQLCKHSCLSPFPTSNDTIFFYGNKRVAKHNDNEYLSCIEDLTCSLIKPLLLCSESNLVAVSCSGISTWWDPSLLYVNPYHYCTGQPIEKAKIRFSAHGGIYQANSTGIYYEGGEEVRHQVDPPRLERNLVLLGKDEVRRALLISTGTVKPDTELQNQKIHRNNWDFGIISFLSNIEHEIKVWVVLVISGLVAVCAFFLILPKFGARRSKGDYHNVSYALREF

SEQ ID NO: 16104 - protein, 692 aa, unidentified
MFMLDLEKPRRSHISPRTKEDSDSCSSIPHLKNLDLIMHEQMILLFISVLLSASIADSNMNNKKMIILAPEFANKTIRGYFKRFDNHDPNRYSRHAIPPIPECEFPLHKNQLSIPLHISLWKPDLAARTTVGVVQQWTKEITSCTVYFFGAQESYSLSRVHEPSSTLPEPMTKDEISKQSLHTEVVPDRTERFSCSWTGTTKKELRYWMKTKVEVKFTPDGSVVSPKPTQVCNIYNSSRCLLGGGSVLDLGEPYITPLCPFKISRVAPGFLTIKKDTPYNKMGQITIPQLKLSFRFDFVTAFFYCPHSTNPSPFIHTLDGYLLTASSPVNDVTLNASAAAISPSMLERDLSDKKSTNPYHYSTLSTTSKPPATRALIEALSFISLASNTTNGAFFSSGSNPTQVWAKDSGSAHEIVNVMDILHGLQSSLSRSEYEWGLQTLAETQTQDLTAISHEICNDRRYEWLVARTLLLSSPQLMASLILNEPVSYARLIGTHILIPNPGLETEIKILDPLECYGSLCLVSTLKGEYWLESGTWNLYSDAPPHLTKATTSSFLLPINPGHWVDIISKEEVKTLPTLTRPSSNYEVLLTFTNTPLLSLSDMMDFSLSWEPVAPFHKPSLIEKGDPKYIAPTFSKVFQPIVSWWNDLSSGLKDTVLTGFLILTFTVLAIKILPKCIPRLRSRKGKEELRPY

SEQ ID NO: 16105 - protein, 508 aa, unidentified
MKLIIALTLISQAIGYPLFVPIRLQGWHDVKLDTLMCPSYASELNKEAAWPQIGLRHLAATDYYGAKGTICHKTIWVKTCDFRWYGPRYITTKISYAPITGLECQQAVVKASKDELETPYMPEANCNWATVSDNEKTFITVQKSNIFMDPYNMVYVSAILKGGKCASKVCPLEMHGGIWIPSEAPKESCKLSSSTTSHINPNSASRLVTDASYLVTEYHRQLPFLGACKMSMCGEVGMRFKSGEWYKIESSDGRVLSFLDSVPMCDGELTVSIHDSSATYHKLSQEILDLSAQIACISELRRAREKGAVSNYLLSFLTPNHGGFGTAYRVFNGQLQASKATYARVRLGALSTATNWGQLDNGSAYSSEDVTGEIIDGPLFNGNRMDNGTLRIVQNAILGQTLEDEDLYEHSAKEILHPHLTILSNNESDVLSAFRPVGAQGDIIHAVGEWVGTGVSGFIHTIVYLVVFCGIILLLYRCLPYFLKKRKSQSAGRVTPQMIPLQQYQFVP

SEQ ID NO: 16106 - protein, 508 aa, unidentified
MLRMMLTIIGICSFVEGLPLTHHGRLYIGPTGVVTPWKSISPESVDCKASVPRLGLELTPEHKFVETKRWSPHVTAPTSGYTCSLIQKRTTCSRSFFGYDGIKKETKISLPSAQACREAFQRFRENHLEEIEHPYPTCHWLGDDTAEAKGLKISLVPVEYNPFSGKYTDHILAGGVCDSVPCMVADRSGYWFNSSAPVGECFPDPAIKIFFVDRNDTLTPKTEFVSLSLQARSFKGACKAKYCGLDGFLLNTNEWIENSRSFSNRYSSASAIRDCYNMSKSYAYLTTQAIIGQVLGSSQSDALLAECRKVKDKLMLGEPISRTDLQLFSPESEGRGPVYRFFNGSLQVATAKYESLVFPDDTAASLHGYSLGATVNTSTPVLWPHAIRINRDIVDGPNGMFWFRGRLIHPRTWEGRIQEVSHHLVQLYSLKFKTPGVPDIDQGNIVEPLSNWEWTSPAVIRPVAHLTLLESLALLAGGVLILILCVKITVWRRTKRPRLSAGVQPSWR

SEQ ID NO: 16107 - protein, 673 aa, unidentified
MSDFKTQTNTLQVLMLLGIGILSMVNFISGTGDGQGKVIGIVKKAQTIYRKVPSPPECELDDDHEVSFPVQGSIWRYKSSNADMVGFILTKSETTTFCHENLLGGEEKRILQVRDLPFREVDTEDRIQVEKLRKATFEAKIPEWECSYFSDNTVKTKIYHVKKMNYQYDPSTRKIVIPPGITSEEGNGIFKLGNNSLFITMSPKPVFPECNIELFKSSVATLVRKKTEVHQVIFNQFKEMYYYNVKQFMMCFKTRIYLTLGGYLISTVNITSTSHTTPTNPTPPSATKPPLIITDAPIPTSTAGHGHGKRTKREVTPQEETIRVPSYRDIQLSCVTENWLENIKLRKKVYSVDIGAACWELSSETIEEDSTSSRRRRSLNDVHEVDSHIFLNYQHELSRTELQWGLYHLANKTSEALTHLAKEFCLEQLMHHTALMEEIDKGSISMATFSSFYPDYIYHSISLKNNVIEIQEGSIKFVNLMDPLVCCERRCRIIDTKNRTMWLESSSRRIYELSESQTSCRWKPNSFIVQDKKTRNWIDVMDAEVISPLYKLKSLNRPDPLEFSFNTTNIYNPYDFLSPLYTDIVKSHRGEDVTVSYGKKFSWLLGAVDSVKEFVSSFKGQLIIGLFCIFLIVVLVLKMFHFILNKKVNRRGEGSPVMVPLTRYGDRIPASSF

SEQ ID NO: 16108 - protein, 638 aa, unidentified
MEEQPWKITLLILALAATAAAADLPGSTSESSGPSTTPFSDSKNLTVRVVASTEDKAREEEERKRIALNLTKLMDPQTESEKSATARAMINKLNAITIRAEGDEVVTVETLDCTGPVTRRLIPSRPDCSNLYPEKEEEVKAVEVIVMKEDPVKSQIHSWSCTGYKVTERCETGPFGGKAYWHMEATDPEALIKLRPSVEQVRGWKAGGTYTLGKNPKPECWWLMISDVSNLKTVCSPATLVLSKEEAVMLPSGKAVPYSSMYESDGGRMWFWKSGTVGRPGCGFVEHTRDVCMAHIRNKVLEKIVCRHSGLIFKATANVELKHSCPGIPRDAHVYLTESGSVVAFRLDGVRLPSETVGGSEIHPSLTLTSAQVQFAITELGDYTTAQLRSLSSEICRNSFSIWENSMGLVEMDATHAARSLFRDPLLIAEFDGVTFLVQSCHMSHANVNLSQVLCQEYFNSTDGTIVRRPDNLVLKKAPTRCTSSNVKTIYVNNTHAVSLDGKVSVFSSRPQFSASVVGEWGGVAITNGDLFTLDELQTDQVARSGVRSLSKIVDSIQEQLGAKGLIEESGLETLLRSAEKGLLAILSWMKWPLIWIAIIVTIAVLVKKAVCAGGKAVVGRRSRRPRRRDSSVEMSSW

SEQ ID NO: 16109 - protein, 639 aa, unidentified
MEVIIKLSILTALLTMTGPAGATNINGTDTPSYLTPPGSPELRLKLITERTPVSLVELETQSDCFPYEESLNPHSHVIKSSVATVYYPMREDTPLYGLSITLESREYVCDDPWLGINTIKLLGRSRVPIAHANKEWLEKFVDKVQATSWATDRYWFGYSEGETKTEVDCNYASTTYKTQLYLVVERVRVVTSMNWKLIQPVKVDTCVVGVNASCDLSPTSRIFFSTGYLPHGCRLSVLSRIAGVLSMDRNDLSLLRFHSESSDFALTLKRENPTRPFSSECEDKGTYIYSSTEGHLVSFSSSQGVADLEALLEQLKPSHLRSKKEAIFINPNFPLIETHPPYRMKSLKNRVEMRVRRDHNTNYPEFQRLDYLENKLAWGLSTFEYYTDQLSVISARELLRTRYNQCLIKNSMMEIAVSLNNPTIYVRMKLDDPGFLVISKDGNIIRILAGVPISAIRIPNQPYNWCNGSLGIEYEDTDTHHWVRGWLRHGTGLILASTFSGNTCLQTRPPSTFQIPSYDQGMWDLFKENYVSLLTNQITRKEFQYTIMNLPVDSSASAWEFHEKGIEFFRNYEPEDTWENLKRLIGGASFSHLEWVPQTMKFISMIIVFLISLKVISFLWWILPSRSGRQSYSRGKLLQ

SEQ ID NO: 16110 - protein, 517 aa, unidentified
MLYALPQIWLFLVLWGYSAGGQYSITVPTKMIKEPTPINFDQLECHVSIQDSTKVWSEKISAYFFTADRLDPSEKTLLCTGWEYVTRCYEYWYGGVDVTHIRRPAKPDLAKCTETYAQNTIFPDEQAADEYSPPECHWLRSHDVVKKVNHAHTVYLKYDFYDRKVKDERLVAGECEADICPCVATNQVIFRPEIKHPECSQWKQDMIQYRGHEVWASSEDAYYILKRSCDVKLCGRVGKIVDPGIFISLDKEQEIGPFAKTIPCANDVNVTTAFTALIHQQELYRETDLLFYEQCMSALDLAKSTHKVTLHMYQALSPSIANGRIGPVYSLRDGKLYAGLAQYQAIQYVLEDTKGACVSINSLRYCLARDKDLFVPTSGFELRRVGEKGIVPLTNGIYMDSKNMIHYPTKWGILSTRINVDANYTLPHVPHFTVDHKIFRKDVVEESQKPAGVKHFEISNLFSGSTSKIITYSVVIFLFCLTLLLGVCCIPWARLCRRKISHHRSGVDTIALRELNF

SEQ ID NO: 16111 - protein, 704 aa, unidentified; identical to SEQ ID NO: 15420

SEQ ID NO: 16112 - protein, 526 aa, unidentified
MEIIGLNLFLPLLTLLCIQIGDAFISVKDTTTDLFYGPTSTVIHWSPLYPPNIPCNKRPIPEQDRLIPKKLTGTKLAHITNATSHGYLCTKAVWTVTCAEGFFGGRTLTHKIHPTLPSLSECQDAVRLYKTNHHTGLGFPVERCGWMGTNTESAINIQISESFVHLDPYSQKYIDARFIGGSCGDPPCKLNTLDTLWMNTSTLPKMCLQRSKIDIFVRNFNSTDFYSNDLVANTLDGACYLKVCGEKGIRLVTGEWMNIQAKTTAEADWFKSLDTCPTLSEIQDVSLKGIMNHMEGRLLMDDSYRLCIESKEKFMTGEVTTRFDIARIAPTIPLGGPVYRKNGNRVEVGYSEYTLLRSPDNALVGSNPDVIGYDTVSHRPIVWRYWTQTNSTIREGPNGITSVGRYLINPLVSLTTPGLYRQILEQDFDPPIHHPNIYEGPLGHTLDIEFDPKHSPKELTKVIYHWWGSWSFTRWFWLLVGCLTAICFLSILIKCSIARRRVTGPLPVIYQACPAPAVKIGTPTRI

SEQ ID NO: 16113 - protein, 669 aa, unidentified
MYHLIVLLVMLGQRAVAEPADIARAAKIIQYAEERLRNKTGLRIELSSRDPAQSAASPPDVPATKQPATKPAATTAAGTSAPIKVGLPESEYLRQVVEPWFTVCESKVPRTLTDVVHRILRKGDGKAHRMLRGTPNGDDHSVYTKFGSGISPAPSRLVVLSESLQEVQRPQLYRVSRLRSSSTPHRVVLCEVMSAFSPLNVEEMECTGVLGKLSDTSSVTLNVVDPGYVLTMIRVCSCSAMRVKRWTWTSFFNVKERLEDRWRIPPDPKECESHCEPIFAGEVTSAVRGSVPDYCYAWMSTCEVQGDVYQVSLGTAKFHRFLNQIRAPFIVDDPCTPSAPCKGSGDSLVLAKIEEDNPRFTTMNGELTPRYNWDTHKVYQVHLPGVTTSILDASCGFLHGGYVYYQLMSGRIVSVSVGTLQFGDKVKPPICTEWKGPYMPFVLPDSQVASTSEQLRQDLLHCQTRKEVVLNALATKRLPSITLFEGLGYKGSESYGLVSRKGLLYAAPCPSVEYTDLEHVEGNIWMVVNNGREVGCLDGGLNFAVKSGCVVNPNASVSILLGEWKVISDRDGKLLAEPIPKAGWGSIPALENISAAFGDYLASLEQPPLWDDGNGPIIIPTSNSTGDPVIHSGASSLWSSMSLASKITAILMPLLSLAVVVGIIMCCRR

SEQ ID NO: 16114 - protein, 536 aa, unidentified
MSVLMIIVMYLPTVSSVLIPIPLEKPHPINSHELVCHYGLPPSPTSFSTTYKLSFFTPSQTSHKVDGFLCSKTIWETKCDEGFFGSQTISYIIRKSQVRDGECLEAFQSFTDGGDIPTPHFPPNYCSWMATNSKSSTYITLTRHDTYWDPYQNAFKDLVFIGHSCSQVICPTHYDNVKWITGPPSRKSCTTWFEVEGEITLDSGRNLDWSYVEAEFIPRTPLSNLCYGVSYCGRTGYVLNNGLFFSISAGLNDTLNFARDIPIKSCSPSTEISLHPLSSSMASVELQTLEILFNTKCNDVVSKIKSGNNITAYELGFLNPTHPGIGYSFISIEGRLYSSKTQFEPIKEYKLTFSNAPSIKYLSKDKTYKIVKVDNCTWISLNNGSMTCRWYNGVYITQDQIIFPYSSREESQDELDIYAEIRPNFDRHIGIPDISNDTITTSDQVTDPDYINPDVLGTLNNWLIRWFHYVGLGVSLMFIGAIIYCCRSCLFKCCKFCCCVTTNVQKAVPKVIYRKRPECVKISNLKGSDKSVDFQF

SEQ ID NO: 16115 - protein, 551 aa, unidentified
MEIFSLQFLFVLFNLLVLASAVHDYKYSIGPVCECLDPARPLGDFIKTCYRRCLMDPEPSARRTVQIHQTTAKSTGPSVVECSRIIQEQQFTQMWTFSTEASPIQHTVGSVSEFECLEAISENCPDYNCNHREPDALTPEYHYGSTTTVRRETISLISMPSSLMIESGSIMISPLSTPDLYKASDKKGFYKGKVYLWKDDVDSTTCPFESSASYGCDEYKGSDGNAYYMCAGGRFSVTPTRLGDDVAEKICKGLKLSSEGFLYKLLDESASNEKHSRLYITQTQGMTGDADYLRHKIQHAVTHLDSEICSNQCELLAIESRLTSFRDPIVRVGMTYYRLYGNGTATLCKTVTGCKLTNPILTCGNPPRVGVSCSTNSGLWDPLLPYMVPGGVCAKPDYHEKLSFSLGSESYVVDSGLTIQANSSYAHGVYPTAFSNLHQSGIQLTITDLEKLKPKWIASKGDGGGVSKTAKTHHKIESPSVNIGERAMGIYKSVSGFFSHLEHAIGMIIIIILSIVSVMFSIKLMKKVNHKPSKRFKVVNTEESEEASAWI

SEQ ID NO: 16116 - protein, 647 aa, unidentified
MYFCSQVFIMVFCVILIVMFSTASLHCRRKFSGEDTTKVVPKVGYLESNPPNNLLEAPLTLPAPCGSSYINYKASEQFYPTAIQIYHFDPSMYPATTILIESVEIETTCRQFWVLHNQYSRKELHPVPLSAMPSYSVEILIEKLRSEMDSLEVNQPNYELLDQEEYDCPYLSLSGTKKLKVFKYTRVFGSWSPSGELLRPLLNRNCSLFSQTLMCGLESSKLLIWKDKISPGLALTPLATLVGLLELKDTNQANRCPRVSRFISSNQEFQLSLGGVRADSLAVLQWIHGIPIFLSLEGHLFSFANHQGEPVFGEFCPNWFSSLKKLGKFKRGVNLENRSKRSPYVSSSLSFPYDPDLPKFPRIQENNQTRPRREIPRSIVDFPEEFRSLLLAEKSAWSISEVMGQLGDLSNRTSREILDLQLHSCQRRVIFAELALSILPISEIPYMNLFLGHRLYRSFFEKGRVLYYLARPIDSLSFSENSIVDGRVKVNFTIKGATMQGYLQCGSGIITSDPIKSPPHLSECYLPLLKLGAVDLCSGQFVKTINPLPDGLNAWEPKLHLPTPAVKNPNYKLSLVRWSSLTDSIDNSEGSNLNKFLLPSSLFSSLTTYIHAIDYLILSIPYVIGFLFFYWCCCSISSRTTIRSTLY

SEQ ID NO: 16117 - protein, 647 aa, unidentified
MYFCSQVFIMVFCVILIVMFSTASLHCRRKFSGEDTTKVVPKVGYLESNPPKNLLEAPLTLPAPCGSSYINYKASEQFYPTAIQIYHFDPSMYPATTILIESVEVETTCRQFWVLHNQYSRKELHPVPLSAMPSYSVEILIEKLRSEMDSLEVNQPNYELLDQEEYDCPYLSLSGTKKLKVFKYTRVFGSWSPSGELLRPLLNRNCSLFSHTLMCDLESSKLLIWKDKISPGLALTPLATLVGLLELKDTNQANRCPRASRFISSNQEFQLSLGGVRADSLAVLQWIHGIPIFLSLEGHLFSFANHQGEPVFGEFCPNWFSSLKKLGKFKRGVNLANRAKRSPYVSSSLSFPYDPDLPKFPRIQENNQTRPRREIPRSIVDFPEEFRSLLLAEKSAWSISEVMGQLGDLSNRTSREILDLQLHSCQRRVIFAELALSILPISEIPYMNLFLGHRLYRSFFEKGRVLYYLARPIDSLSFSENSIVDGRVKVNFTIKGATMQGYLQCGSGIITSDPIKSPPHLSECYLPLLKLGAVDLCSGQFVKTINPLPDGLNAWEPKLHLPTPAVKNPNYKLSLVRWSSLTDSIDNSEGSNLNKFLLPSSLFSSLTTYIHAIDYLILSIPYVIGFLFFYWCCCSISSRTTIRSTLY

SEQ ID NO: 16118 - protein, 512 aa, unidentified
MHLLNMKILFVLFPLIRLSPSAPQPHFSAPYFAPKNLQYPWHPIPAASLRCPPLHPVISGEGIPAHIESPVKHDIEGATIGGYSCYGSTFKVKCVVNFVGWRSFEHVIVDLKVTSQICREKIGVVESGGLPDSPIFPPPSCSWWSENWSTLDHVFVLRHPVAMDPYSSVLLDPLFPGGRCDNKECPLIHHGGLWLQTEALSSSCADWSRIPVTIGLVGDQVMIVPHVGPPMSLQGSCMLRYCQRLGIRLSDGEFIRIEDFKGRSRILPNPPICSDGVTIKALSETADEDRRELSSMEETDRLNCISRLSVALATNKISPELLGSLTPRHAGVDKAYRLRDGVLEYANVEYVPLSRPSNLTDPFLIGYSPKGSRLEWNDWVVSSNISFGPNGIVRPPNSTVIIPNFERLKVEYDQVIQFYHDLREVPHPKIRYYSNHSDLQGFQFGNVASEGSNWEVFSGWWSSIWGSFTWTVGLGLVGLIVIWCLMRRCGRNPVATQTVVRSPSRWEDIEMQ

SEQ ID NO: 16119 - protein, 526 aa, unidentified
MAKACCGIGILLVVIFIAHQNLSSWDGFPPDHSHHSSIAHPGHLKCPYRMIENQTISYLGSFKTYRSPLPTDITSIVSGQWTSIRMTQILYRCHWRSPIVLDISTYYVSPLLEGTKRPPVPDDGLNHDNKTLDCPWYRWNGTYVREFRSVVRRNKTVRFHVGSSTFFDFTFPSWVCTTPPCPTIDPNGLWVPTAAPPSLCLGWQLASVRLIGTVKADPETYHMDGLYGYPVPLRKSCTFKICSHFALLLPTGDLIAINTSSRLSSLLQNYPSCSITLHRASNFKFDPRGIASELLDFRQYYTCLLALSFYHANEAIPHLMLPIIQPYSSSSLFRYRLKNNRLTPYLVGENPQVSTDLSALMAEETLNTAGRLLFLPTPDTAYSRYEFQSEWSRMGELIRQLEETTPAPRKLESPKPGRLSQGTIINWKFTVVSVLIGGVVLLTLDRCIGGPLQSSRLREGIFNAPSRHNTSLTRKSPKTKKLEVWSNPSRRIAWNCPCRRNPAKSKGPSVKRRTSLSAQRTRSSSS

SEQ ID NO: 16120 - protein, 511 aa, unidentified
MILDNGRLALLLGVVFSVAADYTLFVPGEKNIHWTPANHSSLRCPVRSAVHPVSGRIGNLPLLLPIHPNSNDEPGYSCHKVEWISECSEGFFGGTDVQQYIRHLEPNAQECKDAWKAKRDGLEVTPYFEAPKCQWMNTVRKAHTFVVVNTKATKTDPYTLEYVDPLFPGGRCTTKEYCPTIQGGVIWLPLKPVDPKVKYEWRTVNADYGTSAKDSKTYLIWGGGMPTTKLKGACRMSFQGQEGIRFSSGFWAGTKTETWSNKNFTDAIGELSACSSNLIARFPSAHEEIAEHEMEINDLILSLKCYDIVREFEETGKISFLDLGFFNPETSGPGHIYRIKDGILEAASVHYRECPILPGKFSKIHCKPSTDWTIYDTWVPTGIPGILSAFNGVYKENGIVNYAGYNLWNNKLTEADIQRMELQPVPHPVTLSIQKYAPGLNITMDETGERGEVDLDILGGLSHLGRSILKYISLTGILIFSLVFSYYMIKLACNRQVRNSRRERVEMEGFY

SEQ ID NO: 16121 - protein, 557 aa, unidentified
MSQSYNNGSLLLVAILSLLNTFCLSTLVEKSVGPVASCHGESVSTGSVIKSCYHRCMMDPEPVDRANIELYKVKTNLDGPEVIECAKIKQRQTFTQTWSFSTIKSPVSHEFLRVTKEECDKAIADNCPDKHCNHRERDELEEEYHYASDTIKESTTISLISMPSSIQISGSVTNISPMSAKKYYSSQDGMAKEDGKIYLWDSGFVVSGCPYEPVTTYGCDMYQDSDKRRYYMCSGGRFSITAPDLDESDMSSKCPGMKRAIEGFIYKKVEKGATAHDHSRLAITQTTDMKADTDYLRHKVQQIATHLDSEICQMQCEILSVESRLTRKDSAIVRVGMNYYKMYDNGTMVGCLTLHGCRMTKPNIYCGNPPRIGVTCTENNGLWDPTTIELKRGGICMKPDQKERLSISLGSEHYIVDEGLKIHLNSSNMHGVYMTSFSDLHQSSVQWTISDLDMMKPEWDSQKSGKGGLSRSVEKNTTLWTPVISVGSSLVSACLSLSSGFTSVEHIVGFISIGVASLVAIWFAIRVLKLFKGPKTSPRSTDYAPIHVKSPNKATWA

SEQ ID NO: 16122 - protein, 537 aa, unidentified
MMRYLLALILTLSLLPPSLQMSIQDGPKYVGGHIIPLDRNLSWHAAHPSEIDCRYASRHRRPDWPDNLLVQAKEHVFGSATSVDGWLCHKTKLITRCSVTWYLASETSHLVEDQTPSLEECQAKIRDRAEGVFEDEIEFPLPNCGWNAQNDEHQIKYTLTPHKSFFDPIAERVRDSILPGGQCDSDVYCRTIYASTIWVMEADSAIKQCQETVNKEIIFKQYQGNVTSTIFVPGSGIFSRRDFCLGNVCDEPAIITSFGESFTMDVANIALLGTSVNTCDRAKLKTGSRAMLSQEKVTMIEDQIGEIKCRMAVNKLKSGMKLMPSDLYAIAPKTTGFHPVFKVINQTLWGSHAKYILAEPLAKSKAMGECELGRSSSLGVLQTDYWVPVSRGVKMTYGGLLCVNGSVSTPIEIEISENLMELEVRPWLETYHPAHGFLQINGTIHTVSEARHDGENVLEATGEAVSNGARYIGNAFSSIFNAFYLIIPIGGCFAIVFCSWYCCSCICARRAKNKSNKQIFYELEAFQQAKRRGMHPF

SEQ ID NO: 16123 - protein, 525 aa, unidentified
MKQGTLILWVVILYMTLYNVESEEKIILFPISDTVIWSPVNPDHINCTKYTYQQGNDTGIRVTGYTPVLHKDYLVSGYLCTKIKLITKCEKNWLFMTDITYLEVHEEATLQECMGGIHEQKTGGDKVYQYPPPSCSYGKINFEELTHIHIVTREVHYDPYTDFVVSELFPGGKCKGSSCNTINRGQKWLPNVDHKPQCVSDHLDKIVYFYKTSDGDTLVWSPDMPISFTSGSCRKVYCGLEGILFNDGTWLGLNTNITIGKDEEWWKSITLCENNKGLKMHEKEYTTHLMEKTNIHLMLEKECNLLKIKLMEGQHISRVELQVLHPTIPGFHPVYRLNRGVLEVGLSEYRSLKLIEDGVSIYPKFQDRTNRRYTWNYWIAHDKDNLIDGPNGLFVKQGKLRYYLDSIEEYESALNYALKLETRVESIDIKKHIDGASYLEEKHQKVNDANVLDELLHWDPIKHYLILAGAIIVIIIIIVISIKYIWYPFWITCLNKYRGRQRGQSNRDQSHRVYYNKAGSIIYSP

SEQ ID NO: 16124 - protein, 591 aa, unidentified
MISNMFFLFQLSLFLQLIAGDESLETITAPETPDPILLKGDTKYLFLVPSSVKNWKPADLNELTCPPLISKPDTSEMTYFSTDVMELQKHHELAPVEGYLCSGLRYKVICSEGFFGQKTITKKIENIEPDSKQCIDDLSKFKNDDYLLPYFPSEDCNWMKETPTHKDFIVFQKHLVKYDPYNNGFYDPLLKKDYCDTQVCETEHDQTIWITEKSIENECIFNYPVKKHIFHTADFGKMIIDYELNQWTSVEDGCLINYCGREGIRLSNGMFFVGKFYKTLNYLQTCSAGTKVSYKPLTSKLEEIENEIILDQERLLCLDSIRQMTATRKLSFYSLSFLEPKSSSRHKVFRIHNNTLEYTETEWHPIMSFNFDEPNKIGIDKNGKSVYWNEWVPSGIPGLLSGFNGVYKKENETKVTIARLETIKEDYDREMMIDHELVEVEHPKIVHLKRENITGSRVEIVNKEHSDVGGWLSSVLSSFWGKIMMTIISIISIIIIGLVLINCCPIICKSCIKRYKTRKESRNRHRLDREDNGRLRRQHRVIFNNQANDEENAIEMVEYTDTPRPLRPIPDAPTSDIESRSPTTAHSFFNR

SEQ ID NO: 16125 - protein, 627 aa, unidentified
MIPINFLPTILLTGLLSKKGDSIIQYKNFVNTIGHDRWEIVNTPDSNGSIVFPTMCTGNWTRISFMDLTCPTKKEFHPDKMFTREVGSVYHPRDKDSYMVDGYICHKQRWSAICEETWYFSTTQSSEITNLKVTEAECRSQMVTLKAGEEDQPFFPPHVCAWSSKISNDKDFVILTPHAVKIDIYNDSLKDPMLSGGVCYTPVCETIHDGIKWIAEDDDIRTDYCDMSHWERASLFIMHDLESTGSNLLKTTYIRSSLYGIRNLHGSCGIQICGVWGVRFATGEWWAFSRGQLGDWEDHGFKHCEKGTKVSFHHDNHGELELYAAATARQMECARVLGSVKGTMKMTPMDLALFAPVNPGVGWAYKILFPVRRNQNSGREEERNGLHLYRRNCHYHQVFNVTGKYLIDEKQVNFSTKIGNTLDPNDVYITYTNYSAADIYHDTGIVNASYVFFSLNGLMKFGNYVYTPDHLITSGLLMDDFIIPHQLEMVEHVDLLLAKSNREARDLIYRSSFNQTGANLVDKTLEGMKSVKNFFVNLFNKGASIIWWAITGITSVIIFIILIRSGAYQWIWDKCSPKKKGNLPRQANSTQKTDIEMSEYKHIYDDPDNIKKMRKISDDGFDSIFSV

SEQ ID NO: 16126 - protein, 520 aa, unidentified
MAQLKLMACFASMLISQSAYCFVPSGIESGLFYGPTSNTISWHPIQPKEIICRQRILPELAPSTTEKIPARKLTYTDSHSVPGYLCSKSRWDVICTENFLGGRTLTHQLHPSLPSETECVEAVKIFRTSHNLDLGFPPEDCGWWSTNTASQTQVHVTESTVEMDPYSLILLDPRFATGSCKIPPCQLSTMDTIWMNRTDLKKSCPKNQLIDVYKFNSSSPEFYSPDLIGSTLSGSCQMMVCGGKGLRLITGEWIGLEARNTREQEWYSNYPKCSDHVSVNDISLTGIISHLNKISLIDEQYRLCVNTKEKILSGEPISRTDLSSIAHSAPTPGPVYRLNNDNLEVGLSDYQTLESVDPVKEGLDLDVIGRTVATQILVKWNYWVDHTTSLREGPNGMISVSGYLVNPMISLDTPGLYRDKLMTDHNLSLQHPIVSSGAVGHALDWVFNPKSTSASLTHVLPRSFHWFSFSFIGTCLLIIICVLLGGYIISKLIQIYQCFTTKKTHSDKLLVGYTPSHMRI

SEQ ID NO: 16127 - protein, 507 aa, unidentified
MHPLILVVVAASTLVSSLVVNEMYMFPREKNYIWKPINLSALHCPLSPTETTIHNPQSVQVRLLRPSGHLDSHITGYICSKLKLSVQCSVNFLGWKTLSHRTEDVSPGLGECTEALHRQQQGDISSIPAFPAPNCGWMNDLWASATFLLMTLHPVSVDPYSGDLVDRIFPGGSCKDKFCKTVHHGAHWVSNSRVPEMCSQWEVIPGTMGTSRDGDPWVLLPLLGHKSLVDVCKITFCGHTGWRLVTGEFLIFESGLSSHLLRAPPCPAGSEVGELSVAGELGLANLQLMREELRLQCLSTLTTILATGRVSAFQLGFFTPSQIGPGEAYRLNGPRLEEAKVDYIEVSRFPTTGVSDIIGYMVNGSEVTWSDWTPLSNSNKTTGPNGVVRLSSGVVLIPQLESRRLISDLVMMIGQEVHLARHPHRDIESNFSDLIVTSERDEGKPGEWSLLSWLFGKFRWEGTLVIVGTILILIIGVRLVIKTTRCTCRSRSKPTIHSWDQVDSSSV

SEQ ID NO: 16128 - protein, 528 aa, unidentified
MRTELCLSCLLLLIVGHGLLQEWSTRPEPPDESTMSDPPRPVKARCPFRLIKDPAITLLGKFRTVRSSLPIDPESITPGQWVSQRVRVTKYTCQWGYPTIVHVAVRHVVPSLKDLKNLQQVNMDGETQITSLPCPWYPWSGTHIMKQESVIRENKSVRFHIGSSSYFDFDFPLWTCKLPPCVTTNPAGMWIPNGGYPSQCSSWHEIELELLGVTRADPETYHVVGMYSYPVPLRKSCTCTTCSRNVIVLPTGDLLEIPLAPQISKILSSYPRCSISIHRKTGLHFDPRGLPSELLDLENYYRCTLTHLTYILRPPPPQLLIPLLQSDSAFSLIKYQLNNGYLSPSLSSVGVKGGDSQPTHSQILTLHIVGALLHSHADQNIFTRYDYNTNWSMIDDIIREMDQTVEDLTAQTDPEKTQHPLNRQNEPIFKFEHIMYLVMLISGLLITFSTFFVISKKEQTSEVLTGNNSSTSSTGKRRKVKRTPEVWSNPSRRIKWNCKTSCSCTHASPTKFMRVPSRSLASGKSSSS

SEQ ID NO: 16129 - protein, 519 aa, unidentified
MILLMTLILLVSMVEGGTDILTVKAYNLSPKIRIQVPSPPSCEQHPTSSSAKAQIVTFSTYTLNSSMAIMNGNILWKEEIVAECISYFFGSKQMNIRSQKLIPLTLEEFNSIVPGVEEVGTTRDLTTEPMYSCYWPGTQVKTTQRIYSKTVSVNPSLHGGVMADGEVWTPMTLGLAYRSGGKFLKISSVMQNRCPLIKQFSDLGFLSKPTGHSSEISCPARSLQFTFSHTNPLYSCLDSQKQVYISDLGFLVEIVGTKTIDGSKASIVKALSGSNRLSDDLVDAEIQFDLKELAHSITINHQSISKYLCKYRLREWKTILQKKDANALAAYVTGDEFSIGTFEGSKFYIQTRISDPIFIPLKNFHLDPPNSIYFRINQSLHKYEPVSGLIDSPRLSDPLIPPILVLSNGSYLNLKSHLISEEEFSLQGIEPHLRPMRRDYTYYLEELGFQPQTPPLGKYESSNIFESTWNWITGEYKEVKIIMLIIAGSGSILLGYKLIQCCCSRSNVSRATGTLSMPF

SEQ ID NO: 16130 - protein, 521 aa, unidentified
MSTLSRFNFIYSRMHLMILCLLLALSHSHDEPNGIKVKAFYLSPPMHGAVPAPPLCDSPNPKANPVTTHVVFQTYIINTTIPIMNGYIVWREKIRTSCTMYFFGAQVTTITNRELVSLSIEELNQISFGPQSLGEIVDLSTETMFKCHWPGTTEHSTTRMFLKSVEILPSLHEGIMADGLLWRPIVKGVVYTRGRKLLKVSSIFPAACPLIEQLSATGFLSHPTPQTSEISCPNKNLQFSFSHDAPTYACAPSKGNIYISDLGFFVEIKKLAKIIHKELPIIRALMGETSHPTDLIPSEVHYDLKELSRAITNNHYSVSRHLCKLRQVEWKRIMKDRDADAMATYLTGDEFAIGKFQKGTIQIQTRLPMAVEIPLEHFHLERPNTIKCLINNTFHTYDSISGLIDLNRPISPETPPVVLLMNNSYLNLNDHRIAREDFQLPGYDPQIRNLYRMESLWTEVTGDHESIIPLKAPNVTTWFGFVWSWLCDEYMVLKMSLLGTLSVLILLVIILVRGRCRRTHF

SEQ ID NO: 16131 - protein, 537 aa, unidentified
MRTHWLIMTTFIIELNCQQLLLHQAKTSPVLIPYPGEVSCGINSRNSKWAQISFYYPIHEYFDRPCIMCKAIQRKTECYSNFIGQTTTNTVSEIEETFTPDMQKRVMQYLKDNHESDLNHAQDGGTFEIIPEGYIKCSWLRTIEAIGVVLRCRVTHCKFGRQGLLSPITMSNFQVSDVNGYSSQTTSLYFYAPISDNSHIDCPFSLKGVDYCAIGIHQNSSLETAICTASKTLFQIDFSQSAFVCNISGRAIWLSKTGEYVSRQVVDKATNNVGHELVTTDSKTLLDIRKSVSSLSELNFISNVIQRDTGNQYFLENCLKYKLQWSQWAYGYPSSCLAALDLISTSRYAGCKYHEEGILAYETLPVLVPVSELKYNISTRTLEVLMSGVSFPVIPYIGIIMNKQLSSMSYESWFPRIYPLMNGDYWSPERNIVIHSHHHFDELKLLTKKPEFENSLLNDLLMTVPFSTHSFAIRFSNHTHDYKQEVLPVLLPGFGWISNSILWMIILLVLVFVLVKILSSVIPSFLRVDTYGPAKYV

SEQ ID NO: 16132 - protein, 520 aa, unidentified
MIMIACLFGLLGCWSTPCLSITQTPKVSIYEYAPPVLSPIPLPPMCSHSNNNSSYISGIVNLWKINPDLLHNVGLLYWDEVIEVKCYSNFLGQCSTTIVKRTNQLPLSLSHIEAEKRLKELELGELRDTNDEPEESCSWLRETNRTTTRHWVQKIWVQRFVDGSVVGFGQSLPLSLGHPVDLTNGHQHLYIPATQERICPFQIKESYPCVIKETRDDFWITVPGVNLQFNLGKTSTVPFCEIDKVRVFMTPQGYAISSPSVNIKSEKKLEDLTSLRTDLVLSRVLYDINHLEQLVETELIEIEKEVCQIRRSLWNLAAHLHNADLMAQFIDGDIFSRGRYSPSGVLIYRLVPSMRNCRFPDVRETKRGLLKINCDNDTVWITPLASVISTEAVNDTYSYPPLVKMTEGIYVHYFSGEIIKSDHLETLTLQGFKEVAMPNLYHLNELYQKDLSDNHPYLSHLTQSSEVSIDDDLFGFIGKWKSFLIQVIVILISIYLLSSFLKLFCNHKSPFYVGVPSSKI

SEQ ID NO: 16133 - protein, 511 aa, unidentified
MTVLFVSFTLIAIVTGSDVLPIQLIGELGGINDHHISCDHTFFGDSIHDLRTYKFESIDPVPNHEGVEGYMCIKHKHVLRCKEGFLGGQTLTRHSEVVPISPSECYDAVDKWKIGQLPDEDVIDPDCGWWTTNDRVKMLIKVIPKNVQFDMYNARAVDKIFLNGICDNLVCETVYKGVLWMTPNEMKKNCPTTRKSVVEIKVGFPYSLDNLVIHSNYVPNVSFRGACRLFRFCDTVGYRLRTGHFVKWFSPMSHEMNVTLFSLPICDYPNTVITDTQDVKLNDVELDVTQILYRDRCLSTSYKIQDNQTVSRYDISYFQPQVPVTAPGLIPINGSLRAGLFKYAEVSDIRIKCLNCDSCEISGKTLDGPVVLPSDVMHCNCSNFVGCDLPNGLRVYNTSIFNPLRDITNLIQEEIVRARLNLNYFEHPILSEGSQVELVGSSTEINSHKGTFSFSFGGMVKRLYVVLIFGLAFGFTVLVVYICIACRRRSHKRMTIRQSEEQGIPMVYWGR

SEQ ID NO: 16134 - protein, 571 aa, unidentified
MSKLSHTVILLLLVQIISSVLTALGRKGATSGALKRDKLIIGPVADCRGPLVDLGTEIRLCYAKCEGYPKPNRGVRIRIHHSLGTGPRIVECRKLKLTQRFTQFWTFSTERGPIVKEHLTPDVAECLSKWQSECKEGDCNLREPDHLEEEYHYASDTDVTAEFVTLYSTDSLLILKNGEERVAPMGADADFPMDTRKVLHSNVVYMWDPNPPLKECPYKVAGEYGCDQYDEGDDTFYTCSKGGMTITPTKTPDMHPRLCPAVRVSEEGLIYSVDVAASPKEDDYGRVAIDVPDGTVEAADSMYLRQKIQILAKTLESDICYTQCEVMSLEVRMSNKTEHLVRVGHNHLLAFENGTALQCQAITGCQLSTPATYCGNPPRLGLVCSQVHRLWEPMTPYLKPDQKCEKPRGVEHLSFSMGTSVYDVDDQLEINVTKTDLANIYHSEFLRYHSGNLNLKTKDLDSLKDGWMKSKEGKSKSTSSSKTSRTVDSPHIGLGEAALSVFKTMFSVVDSVEEVIGIAVIAVVAVMTVVLIKNIWGLKRSPTRRRRRRVESAGEEELALNSQINSEPTWI

SEQ ID NO: 16135 - protein, 513 aa, unidentified
MGSPVVETVADIIAKQKIDVDRFQRALKKVKLQKIGSSYRPNPDQPTLFMGHDEDLAADDLNITCGITPTYPLEYFIANGFKKPKLTLPKALPDIKSASIGLKQLIYSSSPLTIHDVKLFLSTVMSKMEETCLEHWCGMGVEIAAKDMKVTPLKLFSVEECSQGQTASGEGLETNEILPALILITGCYRISLIKNDVYKAKIEKLINEQILAAGGPMNNATKCLQYLTPFYSDEEIIKCLAGLDMFLNKFIKNPYARARVGTIVTRYRDCSALLTLSFITDMVGFGAIDFSRWLFVPELSNQYNRIMMCGQDISNEFSYMPYMTCMKLSEKSPYSATVNSAMHLFAHAIGSAMMLTRSINAAFIPCNNQQGVLENAILFFYAQRKTLGYTPQFYTVAEKEEVDKILKRLADISKAVGSTADPAEERAKAEGSEGFVSPTEVVVELAKEPQTRDGLAWYKWIVEYKCQTPPEITDLVYTRLSSIKTPREGTIGDQLSRTAIAELQTAARNAAAV

SEQ ID NO: 16136 - protein, 644 aa, unidentified; identical to SEQ ID NO: 8727

SEQ ID NO: 16137 - protein, 586 aa, unidentified
MDFLKKLILILLIAPNGSPLHMPKVGKVFEDLGVVIEPSSVVLHHESFHYTTLGVSFDIARYYNRTHQTMLRKCTASVLTSSLLDGFQTNIDTFFNSMSTVFTDLGSHYCEQSTLDCFLEGKPTRERRQAVLLGLGFAGLAAAGYGLYHHITDGEVDDHVRQINRHVASHESRLSNLQITTEHYEKINDRLIVKMYSGFSDLFKELFGKLCQSQEEEIRQILLMHLDNYFYQYKNEIYRAMDGHVSDFMISLQYVKDNILSLPVFKDSAYTQDPGLFYASSKSVLIKADKKTSTAYFLVSIPIIRKQDISPLYKVTNFGWDSSGFTNKIKLPENFYYLSQNDSVRIISVDLANCFQTYGIFLCPSRYAIINKHSICLENLVKNKSTSGCSLTSQISTKRCEHLNLKGGVILKNCVDASVIHNFRGVRQVNKIRSRGGKPVFVGYSMFSELIIGDHSVSSRPNLVTTKVESQVVFNMTDWSRFDHLMIPGVEHDLDELERTRLHSLSTPTGYWEEGTKITKHYSGEIILVFLLLLAAVLLCIFWSRLRYAIGIRCLKKKQRPVNTEFLYTPSERLKSIRERIQHLEI

SEQ ID NO: 16138 - protein, 558 aa, unidentified
MALSTFVLLFAMWALLMRSSHVHSTDPPSKTFLKHTIAPVAICDDSIPVDPHKKVEECHTICNADPVNQGKARVTIYKDSSSSKKYKAVRCEKWKLSQTFTQTWLFSTVRSELVKEMLKPDTDECTKLIAEKCPDYSCDFHLPPSLPEEYYYASTNTITKNFVMLTTVPAIILHFDGNFHIQVAHEKDSFPTSTGVASTDKAVYRWSDSVSEGCPFDAGITLGCDKWKTDEAINYVCSNGRLAFESSGSKDLSQKCPPGTRLSSEGLIYREEKGEAAIKYDSQRIAMIADNKLSGDSETLRVLTSNGLAHLDSDLCSVGCEVAGLELRVARRQSTLIRTGAGYVMLSPKGHGYDCSKAVQCSMVKPYKFCGSPPRVNIMCDGKFYYWDPSKSFVILDNGCHSPTATEEFFIHLGNRKYSLDSDMSIELHENETDSTHIRAYTINKGSLINYEDLAEMKAEWTRSKMTPRSSFELETSKVLDQHSLFNTSIFAPLKKIGNWVSNSINNIERGIIAVVILVICVYLSKPIIKYLLASQRPAWNHYRRTPTERVGYDITII

SEQ ID NO: 16139 - protein, 647 aa, unidentified; identical to SEQ ID NO: 16116

SEQ ID NO: 16140 - protein, 647 aa, unidentified; identical to SEQ ID NO: 16116

SEQ ID NO: 16141 - protein, 647 aa, unidentified; identical to SEQ ID NO: 16117

SEQ ID NO: 16142 - protein, 512 aa, unidentified; identical to SEQ ID NO: 16118

SEQ ID NO: 16143 - protein, 526 aa, unidentified; identical to SEQ ID NO: 16119

SEQ ID NO: 16144 - protein, 511 aa, unidentified; identical to SEQ ID NO: 16120

SEQ ID NO: 16145 - protein, 557 aa, unidentified; identical to SEQ ID NO: 16121

SEQ ID NO: 16146 - protein, 537 aa, unidentified; identical to SEQ ID NO: 16122

SEQ ID NO: 16147 - protein, 525 aa, unidentified; identical to SEQ ID NO: 16123

SEQ ID NO: 16148 - protein, 591 aa, unidentified; identical to SEQ ID NO: 16124

SEQ ID NO: 16149 - protein, 627 aa, unidentified; identical to SEQ ID NO: 16125

SEQ ID NO: 16150 - protein, 520 aa, unidentified; identical to SEQ ID NO: 16126

SEQ ID NO: 16151 - protein, 507 aa, unidentified; identical to SEQ ID NO: 16127

SEQ ID NO: 16152 - protein, 646 aa, unidentified
MIQIWMLVILSTANSQRIYNFPFDCSEPVGIKDYQIKCPVRLNELSLEAHHKEMDEKVEKVCRPQIKDDDHVEGYICREQHWTTKCTETWYFSTEIEYTIKETIPDQIDCQKELDKLKRGVSIPPYYPPAGCFWNMVQSEKIKFIVLIPHKVLQNPYDMKLYDPGFLEICDVNKAKKSGCRMKDITGLWVTNNDGKNTSEHCNKGHWECIRVKSFKSELNPEDRLWESPELGIMKLNKACKKDFCGYKGVILEDGEWWSYTNVTYMEIQHAHLNDCDTTRLPGFRVHQDRTEFEEFDIKTEMENERCMNTLSKILNRESLNFVDMSYLSPSRPGREYAYLFEQVEWDEKFCLEWPESKKKKNCSVDWRVRKNAGLVTKKHGAIGKFYRSLCTYYPILDANKDGIIQTEELGKRSPPNETHHKTLKRNSNDYGDSSTFITTFNGMLVVNGSFYMAAKSVYDGTEDYNSLLKFEVSEFDKIDMNEAYKEEERKWNDIDLTPMSSVKRNRTDIIKEVERGGRKIISAVTGWFTGLAKTVRWTIWGIGSIVTIYAIWKLRRMIVKKNKADAQGNHQEPSNDEFEMNRDVEKGRHRFWGKRESNKEDGIYERVEDMDNPVGKSDKIISKKDDKTNPYLHHDKFNRDRFFNH

SEQ ID NO: 16153 - protein, 528 aa, unidentified; identical to SEQ ID NO: 16128

SEQ ID NO: 16154 - protein, 544 aa, unidentified
MEISPNLIVIIAEILIHYTHHALPDQLLLHRAHSTPILAPYPGDVSCDTHATLSKWAQVSFYYPLEEIFHRPCLVCQELIRKKECYSNFWGSTSENTISEIPAQVGGDSIQLVLNYLTEKRLDNLMSAEYDNSFEIIPEGFIKCSWLRTIESSGRVIRCKVSSCKYSKGSLILPITKEGVSYKDISVILNKGKGLFLYSPISNSSLSTCPFGLKGVDYCSIGEFKNNPVETFVCATNKALFQIDHTIESHICDLGTHKIFVSKTGEYVSRMVVSKSTNNVGHELTIIDQNTKLDIRRSISSLSELNYISNIIQDDTGNQYFFHNCLEFKQRWMSWALGYPSSCLAALALVSTHTYAGCKYTDNGILAYETSPEYVDSDDLYIDPVTGEAFYHSSSSLLYIIPYLGIITNRALNSSYKTAPLPLIYPLSDGKYWSSVTKQSLDTFHHTTHLQLLDSKPTFVQHSYLITGFTVPFSSQQFSDRWSNHTKDYKAEVLPLILPSLGGMFNTLIWWVIFFVILLILIKVMSLVLPSLSKSDRFKNLTYS

SEQ ID NO: 16155 - protein, 521 aa, unidentified; identical to SEQ ID NO: 16130

SEQ ID NO: 16156 - protein, 537 aa, unidentified; identical to SEQ ID NO: 16131

SEQ ID NO: 16157 - protein, 520 aa, unidentified; identical to SEQ ID NO: 16132

SEQ ID NO: 16158 - protein, 511 aa, unidentified; identical to SEQ ID NO: 16133

SEQ ID NO: 16159 - protein, 523 aa, unidentified
MISNTVSAMLAVLTLLITIQRGCTFRKAGSESGLFYGPTSRDILWTPIQPKEIWCNQRMSPAAESGDKSLMITGAKLTHTDSQSVAGYLCSKTQWDVICSEGLFGGKTVKHQLQPMMPTEPECLDAVRKYRTNHNLNLGFPPENCGWWSTNTVSSTNIHVAETTVKMDPYLLTLIDQRFPSGFCQKLPCPLSTLDKIFMNRTNLKNSCPRKQVIELYRRNQTSPDFYSTELLATTLLGSCQLMVCGDSGLRLSTGEWVSLDARSVAEQAWFKSYPKCPDHSIVNDVSLVGIISHLEKLSKADDSFRMCYNVKEKLMAGEPISREDLSFIAHSAPTAGPVYRLNNGTVEAGFSEYQTMLSVNPIAEGISHEAIGRHPVTHLPFLWKHWVKSTPTSQDGPNGIVSIAGYLLNPLVGLDSPGLYRDQLELTHNHTLEHPITTAGAVGHTLDWVFNPKSTSASLSSILPTSFNFFRPGPLLITSFCLLFLLIVSYIVKIVYPRFRPYKKYTQKGEPSVGYAPQLLRL

SEQ ID NO: 16160 - protein, 550 aa, unidentified
MMICTLILIIVGFNNLPVSHSSPRDFTSDYLLYPVQMHGSRRLASVDRLKCPKLSDSLSKVKRFDLKLATAEPRTRVGYLCIGVTSDIVCSSAILSYAISSSQKTVRVTKSDCEVRVSKFSHGHNTGFKETTPDCALGYTSDRRDHQIIVKKQIFPFSPLKNGIVSSLFPGSVCADRYCSSSDGTTHWFLESSEDYGCTGLVNGTGELKISTAGKGRSQLLSTSVTGDIPLNEICKTDDYCGFPTYIDYSFNGFSLTSLEGDIGSILAQDVRDCPGGGSIREYHPNDLKTMLSLTETIHQRHYQCQKILNKAKEEGFMSSRYLTLFQPYQEGIAPGYRLENGKLWEYDLYYTIGLFKSQMIDQTIYKTYKWDVIDASGSFTTLPPSLCLFDTTYENSADGPLCHWFNGIQIHGINLLYPDVANFFEYSHDYPTLPYSTETTDEDTDLQHNPTIPKSWTGLLPFWGEVLFLSISGVIFLLIIWLVLWSCCNGSKTKRSGTETLNDGGDVKITELGTIRPSLSQIRQAIPLAWNQHNIVTTRHSPPMLEWFD

SEQ ID NO: 16161 - protein, 620 aa, unidentified
MTSSFAILGMLKIHILLILGMEFPSIGAGVINLGENMTISLPFGKDSRNETVHPLDHLLKLRENSTVEYKPFPLEPICEKLMTSDQPQTPVTIAIWKADYHNVDHLGFLVWAEAISTQCSFGFFGEKATSITQTSLVKLNQEPSLSQFDKLRDQDVDVAMELEDLSWDLRYYCYYCRNDYPNTYKMTMGKKVLVTRYPDGSLRTPPGSWEPTESGILSDGMRYLKVLKPKDRLSCGFLIHDVKAAIKTVNPNGEIILSVPSSHHQFSIVQGDNAMKCNFRKATYDVYKSMGGYLISLSGNDEKLVGQAFASPKIRQASRKGRSVPAVQLDQLTWRLFQFLSPRKRRDLDEREFFSNLRSSYDYSQLRFEQTFIVSQINKNLALIQKNICDTQKLKWLSLSPPNLARKVADYYTTEGFSIGETWNGVYKITNTQPIALSYRVVLPIRISHGMFQLINKITGEINWVEPVTGILFENATFTHYSLIATWVPGKFGTGLNLVTGEITKPNLSPHHLKLINQAQALSPVTLYSQNEMSGSLDERRFYSDRKLPPQQNPDPWTKEIWGIGIHILISIIVGILLIICGPSLLRLASVCVMREEETIEDTLFKRKAASSRTQTLLNP

SEQ ID NO: 16162 - protein, 2138 aa, unidentified
MDSNEASDEDGEYVPPPYSPDLHLKTAIRPHMRNYLVNRIRKGPEYRVPLGVRLTYEHLMLTRLDLSGSLRVDSERLYGILLTPQTTPHYDTRPANAQVTSNYKLAKEFMSHAANYLIKDIADDEQAANLSSRIDSLILTDSIKNWLFYRDYWEVVRDCMKEKQISRNHILTKHRIGCHSYDVYTNCDFLIMRDNRENWLLDYQQVLMIFDTINSRFLGLLHASITRQLELEFLPSEDVMLALYKAGDDLVSALGNKAYDTLKLLEPLCIGVYLTRTETLAISRGFLPSIIESAPADEYSSLFISRIKDLLESLPLDNHLFEVFGLFRHFGHPTVDEVGGVQHLLSHAREDIQVDPVQLDKVTGAFIKMFVLEFIGQNKVWPPCSEREEGKYPVISKLLSEKPITFSEFALDIPLMEWSNVKLHQVFEFDDYEDFTELILDKALSPYREHWHHTLNRDVVNFRIEKNHPEYRRVLLQVLSMRELSCKKIREAIQSGEIPLSWLVIAYHAKEREMKILARLFAMMCLEIRLYFSMTEKNVSEKLYKYIPYQTTTWSDSELTKVMLNLSSLNTAANRSHRNLKGKALRKSKQCDTVFVNISLDFNKFNLRWRKESTDPIFSEIDNLFNTPGLYTYSHRFFETAFYYLSSGLCPPDILNANKNPKNPKQVLKDLWFESETTWIGQFGGQEGIRQKCWTIVIISALYAAQQELGIPGTIIGQGDNQVIVAAFTVPIAGMSAEEYIRDHIDDLNKRIEDYLSHLKLITGGIGMDLKLEESWVSTHLLNYGKEIICDGSYCSASLKKISRAYQETSEINPTLQNRVASIFSSAQGACLKGFDTLSPYIISVFESLNMLVKETSVGTMMGRELRNLLIQHNRTLDANLKLSFLLIPRECGGFPIQPYPTFLFRGHPDNLTMILPWIKFLGEKYPQARKLLDLIMSKELYSKSRDLTQLIQDPQSVNFKRPIQASNKIKQILSARVKSITKNVVLNSLMKTFDNKSLLRLVDFLSSITPCNPRVLNEIFRNSPDGVLLSILGKFYDMRTIKQVLPNKDANYLIQNIKESDHSTFLFLIIIDDELNRSTCLSELGKKVDDPREWLDRRQECSYKSANILREESWGKPIEGVTTPHPCEQTKLFPASGDCCSYELCKTSGFILYTFQQTENGHSLLFKRGPVVPYIGSGTSEKRSGPLLNYSKTERGIRSAQQILRITQWLVDPREGNQVPSLLSNIIKSRTDADETFLTYISGRHYGGSVLHRFSDVTSKHECRPGLRVNMFDKILFSSDSAAEFSRGKENYPILFQACFLYGLTLLHHLALYNPSFVSVGNRTYHQHFVCSGCTPLLEEKLLYSDQTPPTISTLSNCPIVFSKVDQSLVNIPISDLSSLQLTEPDINSPLFLNQSLDAAASVIISDLKSQTSVIVQGDLRTYHRVSSLTCLTVGYFSSIPIKRLFQHIAKIWILDNIHQVIRIAETRHLTFLDACAIVMSLIPDYSWNILKPFLCLPEIRDRVWPYMRQHSSGTEIFISGEGLGYACTQLALESFESLRLKSRPLDRRWFRVYLSTNAPGLSMQRAINIWVASLVMTSNWTTYRDLSAMIRSSRQITQNSVTDGQLSLRRIIIGLSNIGPKLPPNNVLNKYRLCLSKVGVEPWLAPALMKDQVLPEVPNPILNWVGHGSVLSCAAKRIFKQIGLHQVIRLPHIHLSRTSTDPNVQERIPTVKRRHTRSDHKYRLASNFSTGYLKYANIICAEGLTQFRGSMHLAEGAGSVARMAAILFGSRVLIYNSLIDTSRTIYHRSYNFKPAELLDLGPEILVEGPTACFRTGGDITNLRTISEFSELAEKHKRVIDLVTCDAELSRDLPFSSGINLLTSFLEITTSVKVGALLIFKTYSLNSSLFEAQVAIWASHVRLARVITPMFSSHESHEVFLVGRKAHLAVSPSRVIITPETQSLLRNLNDFRLRKNPFLQNTKKDTLKDLFLFLDKIGFRLNIEESIAIFLNHIISTHEIRNLPHWGIRVAQNRAHESIRARLSLIGALTRLTRPSLPSQLSLGLSRSDSSFIQRNMETLINAFLLTQIVTREKITNNELLAEWHWIHKNKCYYSVKLHLDTWRDYYGKSLFRIIGYLSILEDRSLELPSVLVNTTR

SEQ ID NO: 16163 - protein, 486 aa, unidentified
MHKDKAMAFRKFPFTLLILCLWTKSCICFSTLSCRSDSQPTITQCLESCEDLKDGPSVSVTFYRQEISNVITIAKCRWVTVEQSFTETWTFSRLKSEPVTTYLEASPDECRDALSNVCHNIPGCVSKARSPIPEYSWARTEAKRVKYLYIETFNTSGLIEPDRKYVFVDGKVVEMSLSHLVSSGFTHVWNPISSGTACPWQVPESTFVCNWYGDDNIICPKEGLYLEGIVSLTFSCTPNRMVDKGGLIFSISKNPQSDWYPEVIETADVGIKEAIASVKYSLKIHEQTECQSRCISVQTTPTLVNGRYYIPNKNISCSIVSNCTVDLTTFTCNNGELLWAHCSGKRHWINMKTAMIEITPRCSPMSRSKISRAEVLDILNVYHGIHRIPELLRGDVISSLLITPEDSVNHISVVDGEGEEINLPNEEGSIISEFATKIFLYIQALEHNIKVVIATVICLIIGYVIVNSLKGIMSSRKYKQVPIQMI

SEQ ID NO: 16164 - protein, 676 aa, unidentified
MRNPSSFIKYILISLTLMFLYDIGAVLSDTTQTPSPPQTQDPQISDTATTKDSETSVSRESRDLKPGTMEEMANQLISVLKPSESKATLMEKPTRGEAATAIINPGKRSNINKIGKPSTVRPVGAATEPNPTDSPNEGKESYLPLYACDDISGPATNIEPLYKGCVHGCQMREPVKVTQIRIQAPKPYHEKLEVIWYSATQMYDVCHEDIWGGEHRMKSAIEYPLSDEEISKIYNEVKDHLVNDQDLIHGDYPRAECSYWQDNKDQSIMTRIRKSLYDLYWAPEVNDYYIHIPSEQVNVLMWDEGFRGPTGIYKWKKKNLLTPCLLKTSETIVCLGNAHEGEALQCASQGLLFEPPYVTSYDSGCGVWTVKDVKGNHFRNLGSKTMSYKEAISDSNPNVQSLGSAMTHIEELLCTAGCSELTMMSVMNNTNIIVDTPVGIWKRKTGSGNQVTQCSTMSTGKIELLTPICTLLGIVGIQHISSSSITYYWDLNQLYATTSQPSCLTETIRDLEPLMKHQDNGTLTMDTFMGRIELNTKTGESRFLSYNPDIVINKKRWFPNVALEQAPPDEKTNDLEISIMQQIRNLSAEYRASCKEAKGPVILKTIGGAVWMLEEDVSTAWGNVVTYFWLWKVAIGAVLIWVGLYICILILGLVRTLFTAKEMIRVPVSYARKRKY

SEQ ID NO: 16165 - protein, 508 aa, unidentified
MLRIMLTIVGICSSVGGLPLTHHGRLYIGPTGVVTPWKSISPESVDCKASVPRLGLELTPEHKFVETKRWSPHVTAPTSGYTCSLIQKRTTCSRSFFGYDGIKKETKISLPSAQACREAFQKFRENHLEEIEHPYPTCHWLGDDTAEAKGLKISLVPVEYNPFSGKYTDHILAGGVCDSVPCLVADRSGYWFNSSAPIGECFPDPSIKIFFVDRNDTLTTKTEFVSLSLQARSFKGACKAKYCGLDGFLLNTNEWIENSRSFSNRFSSASAIRDCYNMSKSYAYLTTQAIIGQVLGSSQSDALLAECRKVKDKLMLGEPISRTDLQLFSPESEGRGPVYRFFNGSLQVATAKYESLVFPDDTAASLHGYSLGATVNTSTPVLWPHAIRINRDIVDGPNGMFWFRGRLIHPRTWEGRIQEVSQHLVQLYSLKFRTPGVPDIDQGNIVEPLSHWEWTSPAVIRPVAHLTLLESLALLAGGVVILILCVKITAWRRAKQPNRFSGVQPSWR

SEQ ID NO: 16166 - protein, 508 aa, unidentified
MLRIMLTIVGICSSVGGLPLTHHGRLYIGPTGVVTPWKSISPESVDCKASVPRLGLELTPEHKFVETKRWSPHVTAPTSGYTCSLIQKRTTCSRSFFGYDGIKKETKISLPSAQACREAFQKFRENHLEEIEHPYPTCHWLGDDTAEAKGLKISLVPVEYNPFSGKYTDHILAGGVCDSVPCMVADRSGYWFNSSAPIGECFPDPSIKIFFVDRNDTLTTKTEFVSLSLQARSFKGACKAKYCGLDGFLLNTNEWIENSRSFSNRFSSASAIRDCYNMSKSYAYLTTQAIIGQVLGSSQSDALLAECRKVKDKLMLGEPISRTDLQLFSPESEGRGPVYRFFNGSLQVATAKYESLVFPDDTAASLHGYSLGATVNTSTPVLWPHAIRINRDIVDGPNGMFWFRGRLIHPRTWEGRIQEVSQHLVQLYSLKFRTPGVPDIDQGNIVEPLSHWEWTSPAVIRPVAHLTLLESLALLAGGVVILILCVKITAWRRAKQPNRFSGVQPSWR

SEQ ID NO: 16167 - protein, 517 aa, unidentified; identical to SEQ ID NO: 9124

SEQ ID NO: 16168 - protein, 624 aa, unidentified
MVFLIVLFVFSITQTTPGLVVNLPLGCKGGDHAHVSSLKCPPPEAKPLLDGKTKVHSGELCRPQINDKDIESGYLCHKDIYVSKCSETWYFSAKTTHSIEHAPIQDYECVGALARLKLGIVPEPEFPVVDCYWNADTVEKREFIILTEHDPQLDPYSYKLLDNVVAANCDHNICQTNFINTLWIRDLNTTHQERCDLKNWDCHHFDIYQGWKTSSVLKGLYQHETQHLYTGLIVESHILGHVELGELCQKKFCNQPGYVFPDSSWWSFSNMSLAGPAFSEHRYNPKSEDCEKITSYGFSDADENLEYLTTLDSAIIKHEMCLDTLALIGDGYQASVRDLERFVPDKPGPGPAYYLNDTHYNDGMKFDSPTEILETQCMYYLVDIHNLTSNGTCTLHHTHPVGTLLHNNRSVTLEDLGLIFNQKIRVSVDPYVSIPTKNIVSNKERDYTSEVRWYKPEKANGDFLIGPNGITILCPSEQDCKIHFPSFSKGVDRIPHFWTEKHSFVKYRHVVQRRLFRDYEADILSKNNPYDFNSWIGRHVNRTEIPAEVKHWFSKVGTSVFDSIWKVGSWLKVSFYICILAVFFKIAVVAWNRFQKLRKNRPIGHHSKGSKNEQLKLDVFGQSA

SEQ ID NO: 16169 - protein, 582 aa, unidentified
MLQLNFVYIVIISIPWVITGVQPNYLRMTTRTTTQSTTILPPSPSPITKSSPKTEVDSPDLKYVGLKFLYPNQLLESWKRTSLIDLKCPPRIIGMEHLKDGDEDFMSVLRVEEKGEKTKGFMCAKHIYRTTCTETWYFSSTVDKRIIPSQIAEIECTEAISKFKTGQIDLSYFPEPKCIWNDNNDSDNKGVSVHEVELDFNPYATTVMSNILLDGSCGVKDDERFCKGVSDNVLIWIDGFNVSGLCNLKTVRGYIYKYREIYHPAKFNHYVVYNPSLKPFHILNACTTMYCNKNFVVLKSGDAFAPGSKMEMLIDSSRLEKCPPEREVKIPSLEEVADSIILNEDELINAVMCQNFVDRLKDVKEIRQSDLIHFFPTSPGRNAVYYLNDTGLFKSSANYERCQVVGPAPDFPLMCSFDPKDSVSNSVIQKYWNKNMPNHTVGDFMVFPMGFKKKGNKTINPVANTLLGQIFLLEEKKYPVNLVHHPVVSHVIHQLKLSGVEVQHHGKNGSIIDSVSYAWHSFTDGIGKWVTIFLCVIVTLAVLYCLAHTNIWKICTRKNNADAIPVRYSAKTQRVNIPIRRR

SEQ ID NO: 16170 - protein, 517 aa, unidentified
MFLALILLLQSLSVTPEEWTYEPEYVIPENKKYLWKRINASDLECPPLFFSPPLINPSPVYIKTIAIPDEFDSAIEGYICSKLKLSVKCSVNFVGWRTLSHRSEDLRPSLHECDSGLHELLSGNSPNPPEYPAPNCGWMADKWAESVFLIFSPHSVRGDPYTGEVIDRIFPGGVCGAKRCDTVHHGALWISKDRNVKSCYHFQTHWGTLGVSKVRPTTLILHSPHMGFRLLDKACRILFCGQHGVRLSTGEFLLLNLKSSNISLPTFPECGTDAKVSEMNLLGQLDYTRLELLDQDSRLQCLMALSTIVATGKINAFQLGTFTPTHPGPGYAYRLNGNFLEEARVSYLGIHIISTDGRTNRIGYDSNSIEVIWTDWVESPSIQGLLGPNGLVKLSTGQILIPNAELRAQRHNLLLTLTSEITVVEHPHREIEKNFTDGVIVTSRDTGEDGSIHLGAWIKSPTGILVLILIGLVAIILLFICCRCSGSCKCPLSSIQIQRPQPKRPGSGWAGVATTSV

SEQ ID NO: 16171 - protein, 583 aa, unidentified
MHLLSLKLMICLSSSTVLTDSSLENLKLSVFHHPISFSKLTLKAEPACRLSGASDSHATVPSYVHIYQQYHSDEANTGILFTLLDVRYEMTRDWLFSCNNKTISKAPYNIQKLSEDDERFWNQVTKSDTDWFKIRDSEVVSLDFGVQSCDWFSKKTVSGFQIKIQKVTVSWSVRGTLVDPIKDDKCEIGEPCLLGKNSLLLTRKTGFSSCSLIKIKTYPCIAFLTNYNQDLRILVNPSMYDITIENKEITKPRCLLGESQIFLTSDSLFVSLDRTDRIPIWCYLKYGSISNKYPKACELTDPSNFKDIPKFSKKRDVSGDLSIVPLNQKLDWVFAHYQLSQAHSVAVRNSLINATLMDLKALDYQVCVSRRMARILAQAMVNINPNPLLEDISGGKGYLFKQHKDQLLVSFGRTYLFALSSFKGLDTIKINGEDCKIYGHLGTTLCGFPDTVNIPLLPMTLIPLSDGGSYDTSTKKIRCFQKSLSFQVEHLLNNSHPSFDLYVHYSDYELRSLENSGLLSSEIPVNSDNGHSIWRLIEDFVFQDRMTIRLVCGVIIFLSLKFMIDLYQFLIPSGPSSRRGRIF

SEQ ID NO: 16172 - protein, 560 aa, unidentified
MMSVKLNLVFMVVIVSIGSSVATVHKAIGPMADCSGAADTIDQVIKDCYSNCLMDAEPSGRSTLSFYKPSQTAKGPRMVECSKVELKQTFTETWTFSTIKGPLNMQYLPVSDDECKDAISKNCPDYECNHREPDNLTAEYHYASDTEVIETTVALKTLPSFVELVGKETMVSPLSSSKQFAWNDEAGKDGFKKYYWHSITAATACPYEEEGMYGCDLYDDKDGGYYLCERGRFVVTKEKGEPLLSSTLCPYLKRSKEGILYRTRDSEVGVSMKHWGRISVGEVKDFTEQDSFLRHKIQQVVTHIDAEICHNQCEILSLESRVTGHEQTLLRVGQKYYLYYHNGSATVCSSLHGCSLASPHIMCGNPPRIGIQCGSAKGYWNPYLGYIVQGGHCSKPDQMEKFEIKIGHHKYVVDDDLMVFINESDYTGVYPVSYNQFMASGVQIRTDNLATIKSSWTSEKMNKEGISKTRDTKANIRTTPNHIGDLAVTGWKSFVNKIESIETLIGNVLIMSACAIAGLLAVRVAIWARRSRRPNMSYNPVALAPARSSPDLSNYRATWI

SEQ ID NO: 16173 - protein, 541 aa, unidentified
MVSVRQMLFIFNLMDLTTAQQQAIPSILMPTAERLILTPVDPHYINCEPGLTHYELPGDDLIHFMAASPNPRLKTKEGHLCTKQRWTTICYEGFFGEVSETGSIEPMEISDNECLDSIILYKENRLKTPHYPLPACGWLKTNYNHQDFVIVVSHEVKIDLYNLEEIDPLFHDGRCNKTVCKTVYPNIKWISSKSDIPICDINRVSLFTLVVRKGGDPDQSMIRGQYIPQTTLTGACKSLKYCGVTGIRTRYGHFFKIASSDFVGQLAKTLEKLPICDPRVQVILNNNQIKQDDLELTEDLLIKAEKCEDVKDRLMDGESIKPRDLIYLSQSSPGPGYGFVLINNTYWITPVFYELMYNVSSICKSLDSCTVKYMKGPNVQGQWSPPHCGITPNTTDPDIIKCLWVNGLVITNRGIVQPRNNLFKAIWEQMYSEEYQIQWAEHIITRHLEDKYSTMKETDRPNYQSKTVGKWMSSIGHSIEAWIVRTVIIVTVISILYCVIRCWCLRPTIKQMLPPVSYNSSTDRVQIHNSRQMQLRGTHWN

SEQ ID NO: 16174 - protein, 582 aa, unidentified
MDSMQPYYVCDRIDSGSAVPITAWHYSCKQSCMEDNERTAVNITRVRWHYVGEEINVYKIITNEVCYTAHENMWGYCTQSQTIKPVSTTEADKVKLEAILFSSTEPIQGTKIITNSGPGDCEYFSDNTNCGRDYTITYRPGKTSKKSEESDLVLNVYGDGIRTDPKKGALYQNDVAWVWDPKKIGQSTECGWGVYDDDTCRITTTSEMMHCPNIGYQYNIHTLKPTKTCKGDVYDIDGPAPFLYKDQKADPKRDDVMKKAAEGKSDPDISMIKGINAALERIEETYCSSSCDLFARGFSGDDNQVLDTPIGNWRLAGSNTTSPKLVPCTPTSTWRTKSPTLMCHGKNHILVEDSKTKHTCSWDTTRDYITVEDTCVTDQKETDEDIKDMRHMMMKGEDIRISFWTGDTYILGPPYNTPRWERNNLTVSQNPSWFSKVEVDKSMLHNQIDLSRLLTNMTQDTKQEIMYNKTSVRSVKSYFIDEVVMGAGAVGATVFSWVASLLGVLPKFALCVVIIVIVLWIAKEAILQRFRYQPAPREKIVKFNPDALEQFVPDNLVHPTAPKRRPQSRATRIGNLFSEHGL

SEQ ID NO: 16175 - protein, 549 aa, unidentified
MAGIGVLSFSAKLLLYCATFFPGCVGDQSRYEMRRALFNPVESNPEKAMSYDEISFWVGGKNDPEIFSEVSALSQVEETLWNVRRGAVLSVFSQKSLQYHAIGCYCVERTISYTCLSCMFCGNTKSVTETQIASDAADCYVACESTKVDKILNQTETADYQCPWTWSSSSRTVTVKEVVTTKMQVRVDAEKKFVYFMRTGSELSCNYVTHECSTGLGAMMVDETTLRSDSCGYKKTHTDYCDLYAPKISTVGLCPKIVCPHLHQEMYLTGKEIQLPACVGGGMGSVMSDKHVILPAQRAHVSEFCRKNSTQISANEDFQRLTLVRTMMRALSKLQADLRSVQAVLHDSFPLCPSSETYVNGHYMIEPLPQLILGRRLEKRKGLKVSPSINGSTVSVYFSEGRRLKQGFLDSTTMIVHDRPCGHQLNFIGIQINDTTSLLIHNQTFKEVKMHRYPSLQIEMMKLTATDLTEQEYNAEGVVPLHELPTVMWGFTEDSPWERALTVIVSWYFGVFIILVITFGIAIRYTLFQLAMRRRMPPIRYRQGTAQII

SEQ ID NO: 16176 - protein, 510 aa, unidentified
MSFGVVLLLLLCSGSTTQDEDLVSAPYYFPESAPAQWHPVPLSSVTCPPHHFRPSGNAHRVKIKSPYRTHLSNATIDGAVCYTATFSVKCSVNFVGWRTLEYYMEPRQSDLTECKSWVGKLLNGEDIPPATFPAPNCVWWSENWSTESHTYVSRHAVLQDPYSETLADPLFPGGKCSSQTCPLIHKGGFWIQTSGFSSLCSNWEEITGFLGTFGNVTVVSPEVGPSRILTGGCRMNYCGREGVRTSQGEFLSIEESPGYTLIHTVMKVCSPGQIVKTGSKRPFAAWLEYSVAEEEERLECLAHLSLSLATNKVSPELLGALAPYHSGPGLSYRVNDGILEVAKVTYVPIYEASKINDRSVVGYSTGGQPVLWTDWVKWGNRTSGPGGTYHSPRGRVIIPHFEKRRLEYDREIHAFSELKEVPHPHVKIYSNLSDLLTSVSHPSGHAEDGWSKISRWFQSMWGSFTWSLVAAILCLLLGVWALKKGLPLICKKRRQPRTWGDIEMVSWETS

SEQ ID NO: 16177 - protein, 520 aa, unidentified
MYFSLAIVVVVIYRVASIPVILPAGRDGKWNDVPNGFRYCPAVGDEYSYGRSLSLQVTLLQPKSKEHEGAEGYLCHVAVYEATCDFRWYGVKYRTQRIRRIAPSDNECVQRVKNSITGRDDWVGFPSFSCNYASITTEKHSEVVLVPHHVGVDDYQGMFVDPTLKDGSCVQPPCQTLYEDTIWIPTNDLHKTVPCDLEFHQSRGVINFPTPRAGMSLANIQVSGPTLPTSSLDGACHMGVCGKWGIRLRSGVWIGFKEKPILQGMDLYETFMHGCRANTTISAGHFNPGALKMIWDAGRLLGYSLCQKTWDKLDRGDSITPLDLSYLNPVSPGPGLGFMSINGTLKMAKLRFARQELPDGVILNYNKDEPNPILFQWQRWVPHGNVLVGPNGITLNGSTVKFPFFMVGVGKLDSDLTEAESIDLLHHHEIAKGHMLHPIDDRYDWSQGGQSGDLVKKIESWFSFPEWIKELGYGLAALLLLGLICVIFGRYCTRTKKWNHGSQNNQVQNRSDLPMSASFL

SEQ ID NO: 16178 - protein, 546 aa, unidentified
MALTLILSLLAFASASVDDITPSPLRDPSDESDYLSGYRHVILPVSVGEHWRPAKLSELRCPKQGRGVNDEYKIVKVFNLTRYDHFNPASVHGYLCHKMKWVTACEYTWYFSKTISRRIIPLTPTVQDCTNENKLKRGGMEESGSYPPEECYWNSYNEEEVTEVHLTYHVVNMDPYTMEFVDSQFLNGRCSLQFCDTIHSSVKWIADRGNVQVRCGEKVTEQGEFLARSNSSEEYRYSDLVLYSHHVPHTSLKGACLMTFCGDMGIQLHNGFWFHLPDLSSFPQDSLKACPKGTTAGAIKHDYSIDVLKFSIEALREDMACLDALESIQLSGALSYRKLHYLHPRDAGIHPIYRIVNGSLEINTAKYIAAFPVSAPSEDCIGEFYKQGKLECISWYNWLDVTPTLKQGFNGLMKDHDRIMIPNAYLTVLDWDPEIHSIRYLTTAQHPFYTQIDHLIEDLVKEEIRHDKSKNIGDSVSNVVGSIGQRISAFFYSFKEFFTGLGILIVCVLFGLILLKIIRIRKKKNNPTPRVGADEISLRTMDTQFG

SEQ ID NO: 16179 - protein, 683 aa, unidentified; identical to SEQ ID NO: 15368

SEQ ID NO: 16180 - protein, 496 aa, unidentified
MKKTIVLFFLCFIQIAFSALKDTPKWLKKLEEPSMHRQLRDVSSCKNSSIAEMHCQVYDQEVRVHASDAVLFDIKVLHKQPRIVRHGFVCTGVTYHHSCSENFFGVEEVKRWKTATEISDAECKVAVDKHLSGTKVSLEYPQKECYWNQYKEKRSRQITVTPHQFHFDPVTERIDDPLISGHCGKEATCMTTKSHQKVFFSEGLNYHPSEYYMLDLGFEDIPMRTIHSSIIGTLRIADLKSFQLFGLTWWTDGKSLAFSTDYKFTDSKVSKDATYDLSEMSNDDWMRVISAKSRAYMESFTCTQLLPVIKDTGKLYANQLMLLRPHVEGAVTVYVIHGEDHKISSCKGWYSYTDSVERDLVNDVSTKVLVKHFGEEFYTSFGYWKNSSWHRYNNILGHLEDKIVSKANLQHWEQSPLKYHYEDLGLKETKIHQSGVESESTYPLPSFPWLDFKKLMYHPIVFIGVQILLLIMLLYLLNKCFQPREYQRAPRHRIDI

SEQ ID NO: 16181 - protein, 496 aa, unidentified
MKKTTLILFLIFISSWSTAFITRNDPDHWIERWEYGNSHKFISRISDCKNTSISELHCQVHDQELRVGSKSIVPFTIRVLHKQPNILRKGHVCTGVEYHVGCDTNFLGIESVSRWKTSSEISNDDCKLAVDKLRSGTALTPEYPSKNCQWMKYVKKDNKFVTAVAHEFHFDPITEKIDDPLISGHCGKERTCLTSKPYQKVQFDEALDYHPSDFYIEDLAFVDNDHWTIHSTLLGTVDQQKLQRYRMFNMDWWRTENSLSFSTEYSFSDHNKKENRGEGINVVTDRDFNRIMVAKSRAYLESFVCTQMLPMIQDKGYIHASQLPILRPHYEGTVQLVVMSGSNNSLSTCKGWFQYDSKNETISVLDKAAKAKLEEVFGKTYYTSLGYSDMGVWKSYNHILEKSKDPITSRSVLRHWEQTNLNKHYEELGLNSSNVARSDVEKSSEISKLKLMIPGLKNVLAVPGVPLLLQLLGIFIIFLLIRRFFKRPEYVRTINI

SEQ ID NO: 16182 - protein, 636 aa, unidentified
MDVIRQFMVLFLIRLIISPTMKGEVLDDFNSYRKSSLANNPTKSDWAIKNNASHLYQPYYTCSSRSSTKGLTTNAWQYSCKQACLNEQKETEITIAIMKWDFKTDKIPVYKIITHETCYTSHENIWGYCSFTKDRKLVRAGKKDIDYLTDFIIKGKKKIEGMETIITSKHPDCDYLSDKTSCSNDYTITKEEGSYIKKSEVEKIAIYTSGVQAEKSWGFLQMNEISWVWDKDDASTSKYCGWKQTSEVKCNMVETSDILQCPDIGYSFHIHDLRKQHTCIGEIYDVHGPLPFLFKDSLTQKQRGEIESEVIKNKQDPDIAFIKGVNKAFKELESSQCSAICDLFARATRGDTDNVLDTPIGTWRIDISDPHHHLFIPCLPTNDWRLISPLLPCNDPNSLQIINMMTKSQARWDAGRDFMIEGDKCDTPQANPKSDRSLYHLVSKGMPFDISFWNGDTAEFKYPYDHPIWIKRHAPHAINPGWLSKVKFDVSMVHSKGDVSDMLTSMVRSVQSQIKVGDAAHKSTYHLIFEEVLGGIEGALSNCASWVMSVFTDIRRMVTFALSSMILFLIYWTIMLVRKKMSKVKPQKDAVPLKSLLKKVTIVDNRETRAGRRRSRSRSRKSRGEILEDLQNQDHY

SEQ ID NO: 16183 - protein, 528 aa, unidentified
  VARIANT 237: note = Any amino acid
MNEYRYKLNYLISIIIRIFTLIESISGSQSLEHQSTILFPTSDNVQWHEVTPNTLVCPIGDSYDKIESGVTIPVKLPLIGTTINIAGSVCTFMKLSTTCSKGFFGGITLELHTEPLDVSESLCREEIQRVSEGAFSSSEHPTPSCSWMKSSTTSRTLISVTSHSVSYNPYADAFKSSIFLTGLCPSSVCRTHFYNRLWISDHSIKESCNESQMLEGSLVIYYNTNHTVTSWSPDIYXSEYDSPCTMNFCGRKGLRYPSGDWMALDRKDIPQQDWIGEYFYKIKDCPTGSQVNIINDKELIQNAVLSLLDEFLDHECEKVKDKITSGDMVSRTELQTLTPRYPGFHPVYRYSPGKFEMGLSLYQQVTVESSPNYPYIIIRRSDGRLWSWPYWIASNTTDIIDGPNGLYIKNKTLILGIQDIEGYKRIARLSSHYRVPLAKQSPEHRTRQLHPGTETEYTFVDDSALTDLHWTPMLYTLTAFVFTLFIGILLLMFWSKLVHCVKNKQYHVVKLFKKNTNDQEMEFYQPGP

SEQ ID NO: 16184 - protein, 625 aa, unidentified; identical to SEQ ID NO: 15336

SEQ ID NO: 16185 - protein, 609 aa, unidentified
MCFTLYVLWVCAILFSGLPRIVRPNEVKFSVSGVQLFHDPEEWEKEIIGGWWLNGLRKHNWNQQGFFLRQLAKTRGIVSRRTRRSTSQSSGPILPLCPRLSEFKNTRVDDLDCNVILQNVSGLLNRRVKLKVVKREVVRVSEPWCACKYMESVRGCKKEFFLWDQKWGYDREVTGSLEECRVACSLLKTKITDGLPHVYQSKPIKYPVCWWMKGTEERTEYIVAVPIPAVLDKMRQSVSSSYVQSGICFINGPPCKKSNGLGSVVPLSTEHLSPPITEDVICMQPKLVPSGWIYCKVPTTGEVHIASKECGFHAFNKTYVETLNGVYIEETVPSVCERSSPSGRLPSMVDFPRPEGITNDLYQQFVSCNLHKAVIGHAIQLGTRIHSSLFDPFISPLGRVEEETTVIINGLKSLIKATCIGKRVTGLVHKGGDTWEVTGEEGPIGCIMAKLQIMMEGGCIRERGPPTVPVIMKSFLVITGPNGSSYEAVPTSVPMLEFLHGISNISVQLGIIDSILNRPTIVDYLPEISGENIITSGNSTGYLADLRINLLNLLGLSWVRPVGITILILISLWLCWGLIKKIRVWRFHYLLKQGEIVHYHKRHHHHAIH

SEQ ID NO: 16186 - protein, 493 aa, unidentified
MKKTSFIVALAFIVGLTIGSSNQENLKEWEEDSYNYQLLTVEQCKNSSIHELYCQTHDLDIKVNSNDLIPIAIEVLHRQPTILRSGYVCTGVNFHISCDTNFFGVDKISKWKTSSDITDAECEKEVNTYLSGTQVDLSYPLKECSWMAYKEMTKKVITVTPHEFHFNIKSEKIDDPLISGHCAKESICMTTRSYQKVRFSGKLDYEPEKYVVYDIGFFNPEESRLYSTLIGSIETKTLTTFKLMGKTWYQGQNSLGFSTDFDFGIKKKAPETDVPEDHNRLFRQDLTRLLDKKSRQYVESQFCTQVLPIIKRQELISAHQLEILKPHFPGSVTVFVMNNTGNLYSCKGTYAPPIDDRPKQAVTEGVSRRLIERFGSEMYTNLGYYSKGLWRPYSQTLGALEDKIVSSDVLHHWKETPLNYHYQELGLNSSTKIESSPENSYEKDRFNLDWIPSFATFSSPIFVVLLQVLLLISLLYLIKYLCTPKTATRQMSI

SEQ ID NO: 16187 - protein, 519 aa, unidentified
MMKLLITFTFVWVVALLDCYLIPLCGKNTAWDYIARPHDLCESLKPADSFSIIRSITIEYPAHTDNNHLSKGYLCTKIIRKTICKQYIFFSSVVTHEYSQVQPTDVECRAVFKESRLQLLESLREYPKAICSWGGIPFSITVQTSNEIIIKEYDVQYDPITDQFFDSELNNGVCKSTVCLTQDLSSLWILSNELNKCSPMHKETATIVENYKTTHMSLLMEDVTHFEVTTLCSQKLCGTMGYKTPAGFVFLTDGLKEYSIKSCEENSTNIQEGSQTLLMSSHIKFVEQQLKYLFCLQLTQNISSTQINDVLGILLPVEEGNHFVYQKSFNGSIKRAKCTYIQGYISPHPSHEYIGTTLKGQNQFWKFWETLNPNNDNNTEYFCPSYGPNNIYRNSQCNLVVPYNYGNMIQGSEKYAEFNPLIINQPYESVLQPTHSIQTNDKTSGVFFNWDELMESVNDLINHFNQRVIWVVLLLLIIFSGIIFIYIKYTSLIKTICLDSPFSYRYTNPQNFMEMRYIY

SEQ ID NO: 16188 - protein, 551 aa, unidentified
MAFIQSCFFLSLFIALVSLRTLSATELEKSVGPVAVCGGGLRPASDIIKSCHQRCVMDSEPGDRATLKLYKVSDNLVGPSVIECAKIKQTQIFTLTWSWSYIKSPITHEMLPVTKGECEDAIKVNCPDKHCNHREPDTLEEEYHYASDTTKTKTTIALLTTPSSLMLDADQTKISPLSSKRFVLAADGAMKEDGKIYLWDSDFKLTSCPYKPVNTYGCDTYQDPDKRNYYVCSGGRFIITAPDTEETAFSGWCGGLRRSKEGFLYEKTRPSEDSHEFARLSISQQAGAAAGVDYLRHKVQQVATHLDAEICQNQCELFALEARVSGKTSTIARIGLNYYKLFQNNTVAECKTLHGCRMTSPRVYCGNPPRIGVTCTEANGLWDPTSVELGSGGVCLKPDEGEQLIVSLGSDHYVVDESLKIRINSTNHHGIYMTSFSDFHQSDMQWRVVDLDTLKPEWDRQKAAPSGLSRSTETNTALNTPSFALGKSVLDIWNSVTGEISSVEHILGMMIISCLCLCVALVFYRVFLKKSAPRYNVITQQQPSEAGSSWI

SEQ ID NO: 16189 - protein, 550 aa, unidentified
MPSTKFALTTLCTLILLSLVGRTKGEFNHSIGPLAHCSSQMIDARQYTEACYRRCKRDAKPEVHGFVYLYSDTSSTGGPIVTSCSKQRLSQTFTETWTFSQITSSPVITPLLISKEDCEQHIQMNCPTHNCSTKLPNSLSPEFHYASDTVVTRDFIVLISMPSGVDFLEETIKVTPAMTDVSFPLSDGYGSIGTKWFFWSPQEAPTVCPFAQSQYHGCDAYGKPIDLINCRRSRFVIPDVGHSIQLKGHCSHISRSSTGLLYSWQDKMSLTSDAAKRLALTQLQNENEQIAMLRMDTTNALNVLDEDICFTQCELLDVILRSDRNKEVLTRIGGSYLLVTKTGYIRKCGPLLGCQLITPHTFCGNPNRVGVTCHGKVHLWNPMKGYTEDGGECNHHFSGTKFSVSVGNHLYHVDDSLHIELPESEYFGLSHDPMASSEDKISKTIVDPSELRRSWENYKTLEQGMTPVFTNENKTINNWGEGVNLDFNLGSIGRVIRDITGRVTWWITLFLTLVCAVIGYKIWCFLFKKQQNETHTSVIYTPVQSSATWM

SEQ ID NO: 16190 - protein, 740 aa, unidentified; identical to SEQ ID NO: 15330

SEQ ID NO: 16191 - protein, 513 aa, unidentified
MLLLITIVCFPILTGGVWEPEATFVVPEDRQYVWKRINVSSLECPNIYSVPRLSRIAQVALLRPEFTGSFDDAVQGYICSKVKMSVKCSVNFFGWRSFEHLVEDVVPSRQECLEGVRTLQVDGKLSSPAFPAPNCGWMDDRWAEDLFLILTSHPTHGDPYTGDFIDKIFPAGMCGTDDCPTIHHGSRWVTTNRTPSSCTRFQTSWANIGNQEDPPHTRVVYSPEFGVRSLEGSCTIRFCGKSGWRLETGEFFVLSSPGGTSLGIPPLCERGVKIGELSLQGQLDYTRLELLDQETRLQCLTTLATIVATNKVSPFQLGMFNPTHPGNGRAYRIRQKFLEEALVRYVGVTRLDDKPRNNRLGVDHQGKPVMWSDWVEVPGTNRTFGPNGLLKLPTGEIVIPNKEIRALRHNLQMTVAQDIDLVGHPHREITQNFSDQIGLSSRNTATDGGIDPFGWIKSKWGSLGGGLTTLIVAGLILWLLGRCICKRSPSNSVPTIKLSTRDRNWEKVATTSV

SEQ ID NO: 16192 - protein, 527 aa, unidentified
MLPLLLLVVVSSARSELGDPPLLVVPAEGNYSWRPIPISQLRCPPRYLTKKPDKDSLVSVRTVRFDYDYTSDAMLDGYLCHKVEWAVLCSTNFLNQHSFQYALTPQKVTEIECKEAIHQYEAQGRTDPHFPSPNCGWMRDSWTELSFVEITPHQIHYDPYTGSLLDPQFVGGRCRASPCLCIHNGTMWIGGQKEPQLCKRQVEGTATLAYDPKGKTKDMTVFGAELRPISLAHACRLNFCEREGFRLETGDFIQIRVQNSPMIASRLNMYSRRCEEGKTVGLHSSSSHTQAVDLALIDEQDRLSCIQTSLVIMSTNKASPTELTHFSPRFPGNGIAYRIHMNQLEAATVHYVGVYKLPSNSTVPNLIGYSHNDTPLYWKDWVPPNKTTDYLTGPNGLLKNPRGKIIIPDLEALYQYYDLAITMAHDIHPIQHPGLRILSNFTDELPIIHRSGGQDNSVGGVLSEFFQGIGGKISGFLLGCILIIGLICVLKLCLKKCINRSATAKVNPPRLARRSSSRWRNYRNSPV

SEQ ID NO: 16193 - protein, 549 aa, unidentified
  VARIANT 102: note = Any amino acid
  VARIANT 115: note = Any amino acid
  VARIANT 148: note = Any amino acid
  VARIANT 532: note = Any amino acid
MQFSNSKIIHILIFVVLINYCCYNGSVVLPVKLKTSIEPINSHSLICHSSLSTYNLDQINPILLDSIDPGEELNTVRGYLCSQIVTELTCFENFFGIESQTXNRTLMKPKFSDCXEAIQEWKDDRDKISEQLLPNCGWLKTNQVSSTXFHIHEKSFLFDGYNMEVQDSLLLGGKCGDQICETVYPNILWFAENQFTNNCPKLKYHAVKLYKVLNSFNKSDFIFKSHYIPEIGLSKACTNFNFCGNRGLVLEGGYFVSLTQDLVNYLLEEHIYLKDCSSDTLIKSLNLPEQINNLELNIDELFFLDKCKKTLSMINYNQNLSFYDIAYLNPRKEGIFYGYILTSTNKLKQALMEYRDLTNVVISCNTCMTCYLSGKNHGKLVRVDKSLIRQGEIKETCLLPNGFLIVNDTIIDPVQNLNQELEYLLEQSQISGHFLHHPVPKVNKLILEPSLVKVKESNAANFINTISSNISDFSLGIKFYIKTTIQIIIILIILYVIFKLKLIQRCFKLIKQKKKEKSKFDIELKEMTSKSXILWRLKVFHIIQETNQF

SEQ ID NO: 16194 - protein, 538 aa, unidentified
MNPALTLCAIACLVMPSLTVVHYPLPLYVVPQKQLTEWSKAAPNDLHCPPPGTEPDLKDGVQDQVTISKQLEHKEMKGEDGWLCYGLTYATTCHEGFFWNAEASNSIKRHMVTENSCREELQKISEGESAPPTYPEPQCVWNSDNTVVSNYVLIVDHHVQFDPYTSQFVDGLFPNTRCRSSPCQTVHENTIWIAKESRNRVCSEFKNETAIIMRERDKSQDQTLWLRMDDYDFVDIDQACKMVYCGRQGLKLPTGVFILWWDDLRKWEECPSQEQQIDVETQLTIELKNKENFRNAERRMECLTTLIGLRNGMPLTYLALDQFQPDNPGAHMVYRINNGVLEKSRWLYWPIVTFSLAEKNVLGYDADRSAVMWTHWVPSGLNGTESGFNGIYRRPDGIMVVPRIELRKARYSEILLLSHAYITVEHPEATQLKSTNLDSDVRFSISRSTTDIGSWIEHMWDSFKGKIVIIVVCVTLVVLLVGICCCCGPACCSCLLSCCKSCRESTTPVSRTRDMEMQGYSPGRPSAVREAPQLSREW

SEQ ID NO: 16195 - protein, 541 aa, unidentified
MLLILLVVSCVLANQRNYQHFENPLHDQRSALVPLNPPVKWLPASLDSLRCPTHTELGPDAGHTLERWLIKRPHNPKVPKVDGHLCHIAKWITRCEFTWYFSKTISRKIEPLDVSQAQCSDATRAYKSGSLTPGSFPPEVCSWAHTNDETLTAVTITPHQVTYDPYKNVYLDHLFAGGTCSDSYCPTVYQSTAWLATSGGTPTYCDFPGEEPVELVLGYKDTVGRRFHESFWLRGPHLSHEPFHMLCKKGFCGHEGFMTDKGFWFFIEDVVWQYNKSVLFMTNIRPCATEEPIQVSDDFPDPSEIRATISELMWDLNCFNTLENIVHHNKISLHDIFQISPQEPGPGMIYRVKDGSLEAAMVQLVRVILETKPRRECIGKYHTKAQELCLGWSDWLLIGNRTYQGYNGITEVDGQLIFPPMRVIGRRWDEEYIAEHHLHKVTHPVLGNLSWKIHENLHHVDIKHLPSNVGDLMGGWVVSAEHKVGAFFRTVGGTFMSFGVILAFGIIVYLFIQLCKLLRRRNTTRPKKEELEFKAATAFGA

SEQ ID NO: 16196 - protein, 514 aa, unidentified
MAFGEVLPCLLILFILIGVGLTDEDLVPAPYYFPEDSVVPWHPIPLSSVTCPPHHMRPSGNAHRVKIESPYRTHHSNATVEGVVCYTATFSVRCVVNFIGWRTLEHYIEPKQSDLGECRSLAAKADRGEDIPSPTFPAPNCVWWSENWASSTHVHVSSHLVFQDPYSETLADPLFPGGKCSDSACPLIHKGGFWIRTGGFSSLCTNWEEVTGLLGTFGEVTVVAPEVGPSRVLTGGCKMHYCGREGIRLKQGEFITIQEGPGYTLLRDLMRPCSPGQIVKTGSKRPFASWLEYSVAEEEERLECLTHLSLSVATHKASPELLGALSPYHAGPGLAYRVNNGTLEVAKVTYVPVYEASKVNDRTLIGYGPNGIPVRWTSWVTWGNRTSGPGGTYHDKRGRVIVPHFEKRRLEYDREIHTFSELRDVPHPHVTIYSNFSDIIAENQHTSGQASDGWAKISNWFKSMWGSFTWTFVAIIVCLVVGICSVKKLLPCIRKRRQRPERWGDIEMSTWENQ

SEQ ID NO: 16197 - protein, 596 aa, unidentified; identical to SEQ ID NO: 8625

SEQ ID NO: 16198 - protein, 522 aa, unidentified; identical to SEQ ID NO: 8624

SEQ ID NO: 16199 - protein, 578 aa, unidentified; identical to SEQ ID NO: 8971

SEQ ID NO: 16200 - protein, 656 aa, unidentified; identical to SEQ ID NO: 8964

SEQ ID NO: 16201 - protein, 522 aa, unidentified
MFPSIFCLMLLVMTSSVGQFILPIKEITPPRPINEHHLSCRLGPGALYPTTSSSVVVRSIHPDSNPVPIQGYLCSKKEYTLTCSENFLWMETVKKDSRSVPVTPSECVDAVNSWLQDKLDKDTQLTKDCGWMSTNTVKKEIFDIQGKHVRLNPYEMEYIDEILHRGKCSSKICQTKYADMLWVSEGDLNQTCPKMIGADVRMSLGDQKTPSSVILHSNYVPGVSLEGACRDFSFCGHRGMVLRTGHFVVVSSDFPSTIVKMYNLFQVCQKDLTIVSDNMNSEITSSKLDLMKIFLLDKCQQVVARIKGGLSVTRYDLGFLSPQISGVGSGYVASNRSVLVGQYKYMLVHSYVANCHSCRSCVINAVTDEGVIPVHLTPDQCPCANFNGCYLPNGIKVYKDKVYNPLLDIDEEFYHQMTEVELNPNYISHPKDVKETFLSLPATEEVEQHHGRTLDSVVGSLVPDFSFSIWPYFVGLGALVIIIIILWRRRSYKPPAEAPIRDFPVIYTPQSSFGPIAQIRWN

SEQ ID NO: 16202 - protein, 614 aa, unidentified
MNCVVTAITLWMFFGSSTAIFHCVEHLSKTVVDKVLSTLDEHKSQIFTGYLTTSINADLTPLTIRDPPPCGTYLGSHRAEDKFAKTAVQLYQYDPTLTPHLILSITSVRVSTECKTRWFGRNEKTIESEAVSTFEKLPKDEWEVYATRIPGLLHSMSVGEEKMEVLNQEIYECPKVFNPGKKSTYVLRVQVKKAYWSPTGFLVAPWFLKNCRFTSDLQPCNVSAHTKIYWDSSTRTGPPLLPTVTMGGLLELSDHSLSNGLCQGARRFTNIKNSFQLSFRVPDIGGWEPEVYINGIPVFLSDEGVYFSFLSHDGELILKSICPSWKYDKPTRRSRQVIQPPRSSSEVPLDLQTMTLEEEVAWIRARTEGHLSGLYNRTVKEIMLVHYNECQLRKSVLELAISLSPLDPRPYLSSILGHRFFEVIQRGKKRYYKTALPISEISFDLHSAKGQNIPVNFTVSGRRESGYFVCGLGYIKSSPLEESVTTDHCYLYLHDIGGVDLCSGETTPSAYEGVMNTDWNPKIEVPFLRLSDIEYGNELEENSYSFIGPRDFISSMGHSLVHPDSNFPSLSDYTLLIDHFILVLPWLILFLIAWKIVACVCQSEGTTSVKSRVF

SEQ ID NO: 16203 - protein, 535 aa, unidentified
MKKTNSYPPHTMHTITLILWGYLLKVGHSANLFLPFSEPAVWKRSSVKNMKCPTPLRYEANHPAQEEVTFYSFSSKYALHKQEGYLCHKTRWSVTCAESFFGVQTISERIDEMQVSLVECQEAVTQRHRGSDPHPVHPLPNCGWMKTNTEHLDYVLLTDHPVVVDHYTSWWIDEQFVGGRCSTSPCQTRVDSILWIANGGLKKIAPYCVSGTGFIEPIEWQALNGSSLWDWNHGSIFSSRGFVRTTFRNACWLVVCDRKGIRFASGEWASLDVKTDSLIKPVLHALPECPTGTKIVPHHISEPSAEDILIKLDRELLADCLMTLREAQERKKVDRLLLSYMFPDHSGRGLVYRMRNGTLESGVVNYIEVTLMDWETVGKPLGVYRDEVTGRIEDYHLTGWTKPGEDGIRHTYNGISANRTTRSIPVLALRYQVRDSDVNQYIDDIGLPHPALQVRYNQTELSTTILDQHSQGKELSTVVMSWFGSIWSQIGFGIVLLILVCVIILVLWKWKPRTCTCPPLMTPRDRVNDSWTHQL

SEQ ID NO: 16204 - protein, 604 aa, unidentified
MMNPSYVILCGLILPALSASQFGGKLQPFLGNRIPSMKSIASSNVVVPIQDTNDVSIPSEVNLMDYAPTSNDTMYDIYPIYSCPSVNSTNLSISEWYGICKYQCSYTTPIDNMVVTIYRKNSSIGKQNVIVVDSYSVTKMCHENIWGSEQTYIVDSKPKDFDYQGILGVKDSLFKVMGSSTSYVYDTCGNPECKYLGDTYNEGVIYKLSLEVWDLSIDAKHNYYIKGPSVPFASYYSDMAMYYEGKWYIWNNDHKESSIDCLFTPDFTDTCLYNQDSGLITCPNEGIIINAVGAYLAAGTCVGDVNISSNGLVYQVSDIQNSKSVNAKLQDIQSTSQGSVTDLISTLYDTLHTLEETYCGSLCDLADRSFQSIIEVEDVVDTANGPWLVKNSSTGLRVHACHVSTNYTPVLPLKFCDDYTLIQVKEVNTNQIAWWDPTVTYVDPNRACSDNGEETLRVITELNKPITIPFWRGYAILNPPYSGPIMWTPRLNPASVRSAKWFPKLKKVADSNPLSLDDIEKSILHHVNVTLGQGQQNQTSGTYKLLFDKIVFDLQQVIGVIAITLANAPLIFTLASIAIGGCIMWYCVSLVRGNNKPQEWSYVG

SEQ ID NO: 16205 - protein, 540 aa, unidentified
MAYMVYVLILGVITQLSTSTVVPNIDLANHVQIHEKYETFEQPHFYKQAGVIREPSGMYLPYGGSLIIPFAYTVPALVGSQRVCNATNHLHELKEDMIAHIRQVLSPRPVPSRAKRQLFMPIALGLNSLLTAFNTYEEQSMKSTLEALRTNQVAIRNKIRGVVASQNMVIDKINRLAVIIGEQAEAIHAMTEKLGCDELYTSVGYQSLVSLITLIPSEFIAAYNAAMSGRIHPNRISTSALREILATHPSIRNSLYAKNPSLLYELGSVVLTSTIFDHRPTLMGILHLPKLIRDNPTPLYTFYSVNIISDNVNYMVELPTQMVCKDEYTCWEIDPSRCMRTLSKAVCLQGNKINHNSCIRGMKTGSLTSCKLSVSKTLNDTIIVQTGGGILIGGSQQDIVTYSLLDGRLTPSSPMSASNTARFITSKDHDYILNGGEIYTTHITNYVSNITYNTQNLTYPTVQDIYKLPDSWAPISHLDPNISWIEIPTVKYSMIGGLCGVILIILCIIVLVVILRKRCATSQSKDMILMEASSVPHRYE

SEQ ID NO: 16206 - protein, 538 aa, unidentified
MKFFLALTTFCCIYKVSSGFDDKGPLSPNITFYQSHGVLLEPAGYYYSYAGVSIIPLVYTLPSFNVKEDIGNCSTSDHLDKLYEGVITHIRDMLQSRRSGTYHIRQKRFLGAIAMGGAIIAQIGIDIYNTYESISLESRVQALMSNEGLIKENIKKIENSVNLIVDKVNVVSVAVSETAAAIKRMSQRMDCQDVLLGPSVTLAEALITELPSEYMAAFNAAIVGRITPELISVKNLEQVIVTHPDIKNTIYQQNPTLVYELGKFITLSLNVDEKPSIHGVMYLPKITQRTPHPVYNTYAVNILHNNHAWRIKVPAQIACSRVGHCWDFDASKCIVSSSKTVCLQGVYQNINNCIKGLHKADDDACEFEIASKDTDTLIYQLGAGILIGATNTTIKAVKIEHDVITPVDEFPPSNSPKLITSKDSDYILIKNEVYSTKITGVEFKVNITLSEFSPKHTEYILPDTSAWQPLTPLNLSWDSWIDIPSSYTSLIFIIILILITIFLVYMVIRRLKNRNKKNSKEHPDFLLLNPPSDYPKIR

SEQ ID NO: 16207 - protein, 567 aa, unidentified; identical to SEQ ID NO: 15328

SEQ ID NO: 16208 - protein, 587 aa, unidentified; identical to SEQ ID NO: 8757

SEQ ID NO: 16209 - protein, 513 aa, unidentified
MDSRLLGGDDLLIAADENSPRIPIEVYDLEAVSQLDKNSQPCDSFLFLDAERNLKLSQLGLANPTTFLFPNQSRYREIVDNIPVTPSRGTGHLDLLQRGRLTLQSTTRVKGRLSFDLPTHQTLSAAASLPSALNLIHQELLEEMASAQEDLEKSQQDQPLGEDIGAGIADISLEAQPRRDSEDDLNKTFIDTIPSVRPISIATAQSPSNLDIQRLYEQIEIEDAIVRESHAVSRPKSPPLIPSPITYITRPGAEKGAIKKVTMKPDTHLEIPQPSSDRQDVSDHGVTAAIDAMTEFMKESYSMLDTVNLTMNALVEKIGSLESKVINLESNVAIITASQATMDANLKILMSGQAQLVRTSSFQQVMPTPTADVAIERSESSLSPEIQAVYDEAGANYDKFLKSHNMKHLTRELYCTIHISGGFQEYFKKTYPKENQLTAHFDAIKSGTAKTISYLALDRVIGRYASKAHKDSYLEPASDRPVYAGLFPQPIIARASNGNSTYAHISATDYFSM

SEQ ID NO: 16210 - protein, 603 aa, unidentified; identical to SEQ ID NO: 15300

SEQ ID NO: 16211 - protein, 458 aa, unidentified; identical to SEQ ID NO: 15329

SEQ ID NO: 16212 - protein, 533 aa, unidentified; identical to SEQ ID NO: 8735

SEQ ID NO: 16213 - protein, 383 aa, unidentified; identical to SEQ ID NO: 8737

SEQ ID NO: 16214 - protein, 560 aa, unidentified
MMVYQSLLILILMSRSRAWALKDDDQLIRESLARQHFSVSSVQDQIQVIPERGILLEPAGQYYSYSGYSLIPIIYTIPSVKLQGDNRTYCPSNRIIHPIYRSMVDRIYANIKPQRHSRAPKTKQSREKRFVPIILGGAALLGQIGYDLYNTGEVHSLQTVITDLQTSNSEIEARLAEVTDTSNIVIKDLRKISVIVGDNTASIVSLANKVACMEHDSSPEFRVILAQLADIPPEFMAAYDNMIAGRIVPELISMQNLQFTIESHPELRKSVYSRDPSLIYELGKAILVDVIYGEIPALKGVLFVPKILNQLPIPMYNIYTVNYQHKGTQFRVILPEKMVCRSATDCWELPTKQCINSMTKSICLQGHHRIPNKCISTLHQNNSLECDLLIGKADADPIIYQLGAGVFSGTLPDPIKGVDIVGESIVYKGTFEVERPRLFTIKDAPFLLINDDVYSTRMSGVQFNITLIYTDTAHVEISPPVDALRDWIPLEQIPVSWKSHMHAPVTTLSGISLAMGVITIITAVVIIFYILTSRKVKKQGPPLFIERRATVPLQEIPYLR

SEQ ID NO: 16215 - protein, 586 aa, unidentified; identical to SEQ ID NO: 16137

SEQ ID NO: 16216 - protein, 540 aa, unidentified; identical to SEQ ID NO: 15335

SEQ ID NO: 16217 - protein, 596 aa, unidentified
MFPPWILLSQLLYFANTICGRTLTRGPLKEDQFTSSGSNKIHASLYQSAGVYIDPKEDIYVSTGHLHIPIIVSVWSTLDTKKIDNMIQECRNSTGFDLEQFVTDVLIRHFDYNRYGMISEAGSLSSISERLNNEHLLMKTTISNIRRENSTIKGDIPMIGKGSRKSKSKREIVTLTMATIALSGLAVTALGLYNSYEGVKVRDLANDLESRMDTLSLQFLNISSNLENQIQNIDDIYLYVSNLREYLSNVARISDCKFLAINAQIEYITTRVAIEVNSLVRGINSLYKNELNSDMMPLSRFGQLILNLPQLHNTIYTSYPETIYKVAKTSLAKLNMKEMTVSYILSVPLISASKIGTSFNLIKFPVIIKDKLFIVRENTRRYMMVDNVHQVYPLDMTSCIDVSVFKICDVRDISYKNNICLKTLLVKESLSDCKFKLADTEYPIVQYVSTGCLVSITSESNLTLSTGSSLTNNGFLHQIYHKGHSIIHVPYTSGDGILVDGEYYKFPSILNHPSIRISQVNVSHYSHTDYPGLIPSVPIKHKSSGSIIYGNFRESTPTVYVIESVLIFSGIFACCLFMWIISNFIKSYLERRSPKA

SEQ ID NO: 16218 - protein, 530 aa, unidentified
MKANRYLIFCLILIIIFIEVNSMHESSNLKVFDESHFLPSVGVYLEPGGHYLSYSGSIFIPFVYVLPNIAFTSNNSCSGDNNITESYFHVLEHLRDMVGIQNKARSKRMLFPIVSILSGGLSLWNTIEVQGIKRKIEYMQEMSTHMDRELNDVISSHNKIIDKVGSISVMVGDNTRTINRIVNMYSCEERKRRNMQTYMTNWLFSAPSEFLLAYTGALTGSVTPSLLSAKNLNHVILDHPDMKGTIYQSEPTITYELGNVVLTEVKVFHQALIKGIIQLPKIVNNTPMPVYNTYITNVIHNKVSTIIDLPGSMVCDKYLRCWEPDMSKCLKFSHRLLCLYGSAQVENTCLEYIRTKNDTSKCDLKVRAIDNPVVVQTRSGVLIGGSGKPYKVYKRQGDIDVQSTTIPARDTSLMINQSYGDWISIDDNIYSTKISGYEYNFTVYLTPAKYPIDTLDKTKIDDEWKNIEKVKYEPIRFDSVSTTDGLYMTIISCVIFSTLYCFYSIYERIKDSHAKVRIDYPAIHELIGSH

SEQ ID NO: 16219 - protein, 512 aa, unidentified
MISNLLAGLILLILPMSKTDVVVYKDRGIALAPDGKLWTLQNVETVSVIHRLFPPEHILSFHVCNGSFQPYAHILSDFKAHMKSIDHQRPKRFLSIMGLISGVVGSTLSAKNWIDIKVIERDLSALKQRQLNLISWADNTTSKLNDQVRLTNMLITSWNKYKSVATTAIGMLRCRTDFLLQVMPDVISNIKILEQVTSAIISIWSYRSSQKDLNIIVNYPKIKEVINKHIPHGHLPGIKSFFKLIDIVPGYIDMNSLTATFVLIVPIFKSQPMSTYFILNTGYIDSSHTYRQCDIHGLVVYQKQLLLQIHPDSCTTVGKQFFCPPHATLIDPRMSILHKDYLCQIRDSVHFPVVQYRQSWIAITTIDKTLSLMTDTTGIERINHSSSDNGFFIVDSKTVAKVWSGSIVIYQHLNVITGGAELYRKISFVNHSHFDDYILQKQPDLSTIGPYQSPSVSHRGSTDTHTVVINTTIVIVIVFLGICVALLTCKFARLKKDHQYLVQLQALNQRQE

SEQ ID NO: 16220 - protein, 608 aa, unidentified
MVNLKVVLIFVCFLQTCVLARLPDEMLNLHSTPAIVSDEIGLYIEPSHLLIESHSDTYIHLVFDYSHPDLELNSTCNREHFRAMNTEIRVRSLESLLSKIFPVKKNPELGKLCSLDSKNCSINIMGAKKRGKRFLGTLLVGAASLFGIGSSISNAISIKEQYKAISYLREHASTVDASLRDVQSSFEKTAKVFDNLYLVMQNEFKHYNSYINYIECKVHDQHQSELYESMLLLIERKVTSLIDSVLFGSVSPELLNIDILTSLFDSSNLLKDSYLKNHMDLIYSLGTMYPVSLDVSKKRLHFLLRVPVIQEENILKVFHTISTGFNAQNYSHFKLFVDVDPYVAVIMDGSIMWPFPVPMNMCNERGTHLFCRSLPIRRYVSDSLLFYIMNTETRNFSLDVKKWENSIMYQPISRIFPSEHKEVTLHHLKTGVIIVGCDQITLITNIQGHLSKKINHKCDRFSNFIPYQSFSTAIAGKTVIESPNLEGHLFKIWVNISFPGGDYFPEEDVSNMIRSGLKEVKYLRQSIKQKAEMHPVFGVKYNTMEILYWIFGCSIVIISIIIMVITRRRQNKHSERLKNTQVLSLRLSEILNSLSRAKVPSARSSSEV

SEQ ID NO: 16221 - protein, 659 aa, unidentified; identical to SEQ ID NO: 8739

SEQ ID NO: 16222 - protein, 648 aa, unidentified; identical to SEQ ID NO: 8678

SEQ ID NO: 16223 - protein, 523 aa, unidentified
MERVDYKGLDYVGMLSAGLIPPPIGTLRSKKKTFKKMAALWSLACCIRSTEGLEQRAYIVRGVTLTCGAESEDFQLETMVAVVSRDVGLSEDDTYLLSDLVASGERKDAISACYRWTADSRKFDVNLPDIPITGSVMAQRWLREVSEHMASVLYPDDTTTDPLSNAHLPPDKWDSDLSTRRSVSGDDEGSVSSDNLEECASSGSLTSPVKATSKPDTSLPGQDNPEDCPILREGPKVLRPTDPGEREEFQRQVIGCLGAYSASLVRQAIQEQADDNQRIVQMDTDILMRMIKEEVDMINDCTRARQYLCQVYDALHDQRIPYMKHIASYREDMAMRCHVLEKALWEIVTARGNGSGVPQIWDKVLLGEMYARYYPAHAELMRSANHVADIDQVWRNVNNMIISEIKNTGNYDHKDVRDNIPLTKDEVLTAIKKAAEVPDSLKSILTAGVDKIQLIADKFVSGSRPLEKETVESLRVDRRSSVCAPLDSDPVTRSEAPVTVRSKRTPEEEAELIRAFNEMMDRM

SEQ ID NO: 16224 - protein, 638 aa, unidentified; identical to SEQ ID NO: 8641

SEQ ID NO: 16225 - protein, 587 aa, unidentified; identical to SEQ ID NO: 15303

SEQ ID NO: 16226 - protein, 634 aa, unidentified; identical to SEQ ID NO: 15193

SEQ ID NO: 16227 - protein, 441 aa, unidentified; identical to SEQ ID NO: 15147

SEQ ID NO: 16228 - protein, 647 aa, unidentified; identical to SEQ ID NO: 8451

SEQ ID NO: 16229 - protein, 667 aa, unidentified
MGSFFRLLVIFTCLLNVEALVAYDCSHGNTGIKDISLVDVKTCVPKLRNVTKVDAYIQLIQPKYFETTPYFQCLVEVTHLIFRCGKTIDTHHQGGLYSEVLSLSRDECNTLITRGEFKYQGFLVIIDITKNVNRISMETYGTINSGSCTPGSYDYALVINGVQYDRAVRTSNFIITTKRSIATVDIETRKIILDDGIKCDYNPLSCFSSDNGFVFWESMFENPSCNSEDEYYPIFEGHATKYIEYVGNQATTSVIIHYSNYDFQIALLGKTKRICGQISYLTEHPKLAIVFSTKTEGFNLKINSASMSKNVNLMAYVNSKIVYVLRHVKEQVDSLYDRVSHDRCIAETKIIHNMLALAVISPQEFAYEYFNAPGHTAVVLGETIYVSKCVPVSVNFTKVANKCYKELPVTVNGETMFMLPRSRILSGIGTEVDCSGLLTVKYKLTHEWYTVGSNLIVTSAPERLDFSNKDDWTFRTIDDLIETGIYTLEDLEAVQKIIMTPIQKNALTERISRTIQGESELPTGSNVIHLFTEEDLKTLAKDSVRSVLGSIADGIHYLGDICSFIVGSFIILRFIKFILNFIINGVLIFKKYGLNWRLLICWWENIVHIMLSGYMSKMRDEKEENESTAPLDTIRVSEDAYTNGQPLLLSERRSRRIVPVRPKGDEI

SEQ ID NO: 16230 - protein, 541 aa, unidentified
MKVPSIIVIFTGCIFVNGTPIPRSDCSISQGSTTICNIPKFSRGLVVHDWRYKLITISIPKPTEIVKIALKTLDLSKTDEMRQAHTIVDGMAILLDKSMRQRLAAYSEEVYLTIEEQKSLISTRTKRSAWSVIAAFFRATLPQLGRSLATKGALKAMMKHSFMALVTSGITYGISQAQLPNVELIEEQIMLLKSGQKESTSVLSHLTLVNSMAIGDITEFSTSIRSAFLESRTGDSLTRTAYMLLREFLDDTYFSLDRLMSGHIPQFLMSPGTQKEWITTSTQTFGLIESISPHFKVKVLLIDDEKFNIYLSVRIPVFSGVQRKVFGEWDPKILHNRTCYTTPHSSWILSLNPDHDSRGITEVDVFDRRSCEMSGVPVCESEGKIDWLNEMKVDRTCTEWMRGNSRRKRHFEDIAAPSQREIEIGEKIGKALLDKFNRSMVSNENALKLKPFLVPPIEHSLNDLVRRMQEKHDQIDELHKKIGSNSWGIICVWIVAGLSATVLISSITVYIVLKCIEIKRSKRAVRKFGVLYRSQRDQERK

SEQ ID NO: 16231 - protein, 522 aa, unidentified; identical to SEQ ID NO: 15240

SEQ ID NO: 16232 - protein, 523 aa, unidentified; identical to SEQ ID NO: 15241

SEQ ID NO: 16233 - protein, 499 aa, unidentified; identical to SEQ ID NO: 8808

SEQ ID NO: 16234 - protein, 524 aa, unidentified; identical to SEQ ID NO: 8932

SEQ ID NO: 16235 - protein, 500 aa, unidentified; identical to SEQ ID NO: 15247

SEQ ID NO: 16236 - protein, 500 aa, unidentified; identical to SEQ ID NO: 15374

SEQ ID NO: 16237 - protein, 500 aa, unidentified; identical to SEQ ID NO: 15339

SEQ ID NO: 16238 - protein, 500 aa, unidentified; identical to SEQ ID NO: 15340
  VARIANT 261: note = Any amino acid

SEQ ID NO: 16239 - protein, 499 aa, unidentified; identical to SEQ ID NO: 15353

SEQ ID NO: 16240 - protein, 499 aa, unidentified; identical to SEQ ID NO: 15342

SEQ ID NO: 16241 - protein, 499 aa, unidentified
MPPLMCFPIVFGTLVLALLDLTSGLQALRCNTDSTPTLIDLEIHRLCHNRTEHVVPCEVSYRNHTVIELSAQHISCYKYHCKTYWGFFGSYSADRLISRFTGDVQQCINETQEDPFVCNWYYCCSAQIHEICRCSSSNVTVAVKTIPPFMYCSFADCSTVSLQELSSGRANLSDGSFLLFKQTNITSSTVNQTLNGTILCNQSPIVSFDEFRRSYGLKNGTYTGDTISIKCNITAANCSKSRRKRDLSQIQYLVHTLRPTLRDAWEDCELVQSILLELFGSGTTSSSRFLRSWLNSTDIVGYVVNGVGVIWQCEPTNVTFLPWNESTYYPPVQVEGQRFYLNDEGRIQRNTPEAKPGLKRIFWHERYYLGTVGSNMKPKRVKYNKSSHDYHLGEFNWALNITPGINLGVGHETNPINHAFGTQSDLLPYTKSSNITSTDTGSGWVHIGLPSFAFINPLGWIRDILSWAAWLGGILYLVTVCISLPALIVRRRRLGRWSE

SEQ ID NO: 16242 - protein, 503 aa, unidentified; identical to SEQ ID NO: 15577

SEQ ID NO: 16243 - protein, 503 aa, unidentified; identical to SEQ ID NO: 15343

SEQ ID NO: 16244 - protein, 499 aa, unidentified; identical to SEQ ID NO: 15425

SEQ ID NO: 16245 - protein, 503 aa, unidentified
MQSTQHSMSFPIVCVILGSVLLVQTFELRGLRCNTDSTPALVDLEIRRLCHTPSENVISCEVSYYNHSQQSLEARHTSCYKYHCKTYWGFFGSYSADRLVSRYTGAFNVCNNGSFPDDPYECNWYYCCSALTTEICRCSINNVTVAVRTFPPFMYCSFADCSTVSQLELTTGFASLSDGSVLEFEPWNISKELINGTFNGTILCNSSSKIISFDEFRRSYSLVNGTYMSSSINITCSSYNGTCRAKPRKKRDLSQIEYLVHKLRPTLRDAWEDCEILQSLLLGVFGTGMASASQFLREWLNQTNIVGYVVNGVGVVWQCDWVNVSFLPWNESTYYPPVNFSNSRLYLNDESRLQTSTPEARPGLKRVLWFGRYFLGTVGSGVKPRRIRYNRTSHDFHLQDFDASLNLTPSINLATGHETDPINHAFGTQANLLPYTRSNNITSTDTGSGWVHIGLPSFAFLNPLGWLRDIFSWAAWIGGILYLITLCISLPASFARRRRLGRW

SEQ ID NO: 16246 - protein, 499 aa, unidentified; identical to SEQ ID NO: 15341

SEQ ID NO: 16247 - protein, 511 aa, unidentified; identical to SEQ ID NO: 15376

SEQ ID NO: 16248 - protein, 511 aa, unidentified; identical to SEQ ID NO: 15426

SEQ ID NO: 16249 - protein, 635 aa, unidentified; identical to SEQ ID NO: 9187

SEQ ID NO: 16250 - protein, 578 aa, unidentified; identical to SEQ ID NO: 8698

SEQ ID NO: 16251 - protein, 469 aa, unidentified
MTKREILSCDKLREMISSTSVSGPLSSQGNDINMLSPLDQQILNELRGSESLPPSTILPVRRSRTVEDLTNIPTSQPIEQRLVFSSPIESTKRKITEDNSPMSSGTDQLISKLTELPLRPYTPLTELLPISDILDPQPAATSTTRSSPFKKRSTRASSVHTKISYVPTLPSEIQESETDTDIEVDDAHSLSVPMSRFLQASTPPPPSPSTSHNLNTYNLASAYLAQSDPIEPTGNYTVSSKMMAFLSGESKTVDSDMDLELKRWATDRWDQLINPPKGLKCEHFALCLKYISGNSNRHKAYHIAKGNFHMACATEQVWSDLPKLTKTTSNLKSALSTPHMTIELQSLITQHTQLLQDNNRLITTLQEYGGSLINQYQDHTNQLKNITQEVSNTLSSKISSLVSAIEKLSGLSDKEQGKLLKRKSLGTELLDSSLSSVGPSASATRSQSSRRGSTVSTYPYYYSNVTSLP

SEQ ID NO: 16252 - protein, 562 aa, unidentified
MIFGLIPTGLGLVGYDCSKHTDKVTYLQDDKNNCSTYQLNTYQEEPWRGTVLQIPLTTTKHHRTCSLVLKTYTMYCTYSGNPTQLELEKDDFETTNYQLTGAECSKAWEHQLFIFQGVHLKIKVPGITKILIGSDISEDGFCLTTRSTSQVIKGHIELIWSPVTEWTDIDGNPQSRELDDSKLTWIENRTASTTQDGIVVLSNSPPTSICSWEQLYQGDGKLLTQDSKEQYVVIPSLPAGFRINSQRRLCNLMVSTTEDSSIFLINTTALSLPIATNHFKGRYSTVISSGITGLSLLNQLVHSHSSKTLLENQCILESMVRENIIQQAMTHPHQAALLLLGQLGWTIVIAGNGVVIKRCKEVTVSVVPQSICYTDIPINIANSTHLGFIHPVTRVISSSSFQISCQDDVLPIFSIRGKNYQLNPKLSHIGNLPHLPSRLSKMSINFTSSKGGLYSHEILETMDQPDDHMTRREEVGRQLLKMGDGSFHHRQDSAGVLGNMVGLIMDSAPGHWLYTCVLIFSILSIILNVILWIIIIKSKLWLILFNKERIAAYQAQLLSSPC

SEQ ID NO: 16253 - protein, 569 aa, unidentified; identical to SEQ ID NO: 8733

SEQ ID NO: 16254 - protein, 574 aa, unidentified; identical to SEQ ID NO: 15219

SEQ ID NO: 16255 - protein, 635 aa, unidentified; identical to SEQ ID NO: 15204

SEQ ID NO: 16256 - protein, 633 aa, unidentified
MFESVVNWILSPIAVALMYVSYVMVFIVIMHFLIKLRCLPILFTLGLMFGRAQCFVRSVEHNTIQSVITSMRSNWLCGNMSVVLVDDVVHFVSEDLGLGNDLSYEGCTWDLSDGHVSGECLTPPPSMRGMKAGVIGRAWFQCGATRSCWKQNKGCTKVVEVSSYCGKDVQVELDDKQTTLLCENPLRGWMDSDGTTHGMMTLPEKEERESFHPTVERCLCNVAFHSGPVTSPITYSLHTSGCDTPEAFGMVGNQRVCLDPHGIQMNITRWMYGAMNGRHDVVLEVTGNKTWDAENYFLSSQYERWMIRMISVRAPNYKNGRSCLLPGKPQKDRPAELKECFIKTDTCVGGCWYKGMSLPDVDEVEREANRRKAQNGKRRNKRFISLFSVYSLKKAGFEEDGWSGNLETALSDSVILTAMAKRVDINTADIKMLKKKLSFLAKLTWEGICSNGSHSLKGNITLNFEDGSDLHVGDWCNKRTFDSIMQGRPIVENDLSALVVTLVHSRLQKREMQTSMKIVVYGALILLCLLVLRCSGRSAYVATHRHVARGGSQSCSGPHRFSKTFSRKCNCGSISLQPCDKLVNARCNNRKSVAMCLLNMPSCTPLVEPTEITSPVTVQEPESPAGYVTQTVM

SEQ ID NO: 16257 - protein, 728 aa, unidentified; identical to SEQ ID NO: 15201

SEQ ID NO: 16258 - protein, 497 aa, unidentified
MGLIQSVSEGMVEILQHLPLIVFCVMTLVTASMFVRNRWYKLYYLILFTPKCEAYRYCSENEFKLCSTSYGTMQTSFKQINHKGMNIMTQFNYTNNKFCFDIRDSGCLGDENMLLVYSENITEAYRWCEPTWSGSSYTSPTTCSLKSNYTVRCLTHGKNESICFDVPVSHSNCTRGGCTELKSTATRYENYVRDYFCFQNISFNMIAEFENLSALICDGGSRKQYEFRRLSMSSNGWNIFNKFNNKSKISATGFSYPVHSVWKNGKRTKRGDSSLFSSLSLASLISFSTGVDGAVEIWNKIYKLESLIQKLEFIVKNISNNQRTIWKNVMIDQSTISQILNDLKSQGLKLENSEKKFNYSHLCVYKYDSIEFFGIIHNHSMGSHHHNCDDLSLVDASIDSIINETKRAHEETLNSLRKAQLKEYFMQLHWEYPCVFLMIFIIIFSKILEPRINKHYHYFKDGELKCPYPHYLNKKGVCSCGKEYPSVKLVVCNIEKY

SEQ ID NO: 16259 - protein, 478 aa, unidentified; identical to SEQ ID NO: 15162

SEQ ID NO: 16260 - protein, 474 aa, unidentified; identical to SEQ ID NO: 15163

SEQ ID NO: 16261 - protein, 494 aa, unidentified
MGLIQSISEGMVEFFQHLPLIVFCVMSLITALLFVRGRWHKLYYLILFTPKCEAYTYCSQNEFNLCSTAYGTMQTSFKQISYKGMNIMTQFNNTNKKFCFDIRDSGCFGDDNMILVHSINVTEAHKWCEPAWTGSSYTSPSTCSLKSNFTYKCIQLTNRNTSICFDIPITHANCTRKGCTRTQGEAVRLANHVRDYFCFQNAPFNTIDKFENLSALICDIGSASGRRGISSNGWNYFMKWNNKSKVDQTGFSYPVHSTWKEGRRTKRSSESLFSSFSLASLISFSAGVDGATEIWAKIYRLESLVEKLEWITKNISSNQRTLWKNVVIDQSTISQILMDLKKQGLKLEGSERKFNYSHLCVFKHDSVEFLGIIHNHSLGNHHHNCDDLSLVDASIDSIINETKRAHEETLNSLRRAQLREYLMQMRWEYPCVGLMLIVVIVSKSLESRVSKHFHYFKDGELKCPYPHYLNKKGICSCGKEYPSVKLIVCNIEKY

SEQ ID NO: 16262 - protein, 479 aa, unidentified; identical to SEQ ID NO: 15164

SEQ ID NO: 16263 - protein, 476 aa, unidentified
MGALVSISETFVSIVKHLPLIVFVFVLIWFLFMCMRGRWWKVVFLLFFTPECQAYTFCSGNEFNLCSEVISTIESKYHVIDVENQTIITKLLKDSYYFNIITLSNCTADKVHFKLIEQKSITVNVSDTPGCEGGWIENNFFDTYNCRNTTEKQGLRYHGPFGNPPVGFWVNDNSRKTGTEQKTFNNLTFKWNQHDYSRHIFNLIQNLTKVVCTGRRHNCTNKTTSSDSVVTKCQITPLPVLQRFKRESVSLSSTTSVFSLIALDTGYSDSSALWENLIRTQTALENLEKIVANLTSNQYVLADQININQNTFVGILTDLKNHGVKLERAEKAFNNSHLCVMRNEKLDLTHYVRVNHTYNNGSHYHDCKDLILVNDSLSGLIQLTQMAHREALQGLRAELLRNYLLTIRWEYPSILVLLILGIIFIALQKRASMHRHYKKGDEWKCPYPHYPNSKGHCSCGKIYIDTRLVECPIEKY

SEQ ID NO: 16264 - protein, 477 aa, unidentified
MGAFQSITENFVWVVKHIPLIVFVLVLVWFILMTVRNRWWKVAFLIFFTPRCQAFTHCSQNEFSLCTSVESTIESKYHILEVSNQTVITKFVKLGYYFNLLTLSNCTGNDDFDLVESKTVRLLANQTMGCKGGWIDNNYFDTFHCRNASSGKGLRYHGPFKTGNTSVGFWVSVPGKGGTEYMMLNNLTFRWRQHDYSKQVFDLSQNFSGLHCLQQKQNCTIVTSSSGTNSTRCLTVPLSVLHRQKRSETASLTSTTSFISLISLDTGYSDSTALWQSITRIQDVMLMLESIVANLSANQAILAGEINIDQKTIKNILGDLQEHGLKLTRAEKSFNNTHLCVMRNESHDLTHFIRINHTYSDGSHFHDCKSLILVNDSLSGLIHLTKLAHQEALEGMRLSLLRSYLLTLRWEYPCVVLLIVLGVIFVFLQGRAEMHRHYKKGEDWKCPFPHYPNNKGVCSCGKKFDQVMLCKCPIEKY

SEQ ID NO: 16265 - protein, 507 aa, unidentified; identical to SEQ ID NO: 15479

SEQ ID NO: 16266 - protein, 485 aa, unidentified
  VARIANT 157: note = Any amino acid
MGQIVTMFQELPHLIDEVINVIIMALVALTLFKGFVNLCTSGLFQLIAFLILAGRSCSIIQEQFRLESVEIDGSTFKSMPNLCTLNETHHYIQVNDSGIEVTLTNQSVTTTKFCNLTDALKRRQVDLVLFSVVSEFHLSISKFDDFTRLTCDFENGXILMQYNLSGYNTELADRAGCGTIQGRILYAMTKLFVKFGAHIGFMNKNYGWCARTTYKYLVLQNTTWSDHCNPHPLGYLRMALLSQSSRLISRRLLGSFSWSLSDQEGNSNPGGYCLERWMLIASEIKCFDNTAIAKCNLKQSEEFCDMLRLIEYNKEALKKFKNDLKTSIDVMKSTINSLVSDQILMRNHLKELLGIPYCNYTKFWYLNNSVLNLHSLPKCWLVSNGSYLNETKFSDEIEQEANNLITEMLQKDYKDRQSKTPLGLMDLLIFSTSFYILTVFLHLLRIPTHRHLFGESCPKPHRLNSNALCKCGVYNKPGLKTIWKR

SEQ ID NO: 16267 - protein, 485 aa, unidentified
MGQFISFMQEIPTFLQEALNIALVAVSLIAIIKGVVNLYKSGLFQFFVFLALAGRSCTEEAFKIGLHTEFQTVSFSMVGLFSNNPHDLPLLCTLNKSHLYIKGGNASFKISFDDIAVLLPEYDVIIQHPADMSWCSKSDDQIWLSQWFMNAVGHDWYLDPPFLCRNRTKTEGFIFQVNTSKTGINENYAKKFKTGMHHLYREYPDSCLDGKLCLMKAQPTSWPLQCPLDHVNTLHFLTRGKNIQLPRRSLKAFFSWSLTDSSGKDTPGGYCLEEWMLVAAKMKCFGNTAVAKCNLNHDSEFCDMLRLFDYNKNAIKTLNDETKKQVNLMGQTINALISDNLLMKNKIRELMSVPYCNYTKFWYVNHTLSGQHSLPRCWLIKNNSYLNISDFRNDWILESDFLISEMLSKEYSDRQGKTPLTLVDICFWSTVFFTASLFLHLVGIPTHRHIRGEACPLPHRLNSLGGCRCGKYPNLKKPTVWRRGH

SEQ ID NO: 16268 - protein, 483 aa, unidentified; identical to SEQ ID NO: 15488

SEQ ID NO: 16269 - protein, 488 aa, unidentified; identical to SEQ ID NO: 15522

SEQ ID NO: 16270 - protein, 503 aa, unidentified; identical to SEQ ID NO: 15519

SEQ ID NO: 16271 - protein, 484 aa, unidentified; identical to SEQ ID NO: 15482

SEQ ID NO: 16272 - protein, 480 aa, unidentified; identical to SEQ ID NO: 15487

SEQ ID NO: 16273 - protein, 507 aa, unidentified
MGQVVTFFQSIPEIIQEAINIALIAVSVICIIKGCVNLWKCGLIQLMVFLLLAGKRCDALNIDRRHVLSSVELNLTRMFDNFPQSCSKNNTHHYYKGPEGTNWGIELTLTNTSVANYTSMNRIRSLAFGNITNCDKTGEAGHTLKWLLNELHFNVLHVTRHVGARCMTTEGAGLLIQYNLTIGDHGGEVGRHLIASLAQIIGDNKAAWVGKCDSRCSNDGKCNYTNCEGYTHYNYLIIQNTTWAQHCTYSPLPSIRMALNKVAYSSVSRSLLGFFTWDISDSSGNHVPGGYCLEQWAVVWAGIKCFDNAVMAKCNKEHDVEFCDTMRLFDYNQNAIKTLQLNTENAVNLLKRSINGLISDSLVIRNSLKQLARIPYCNYTKFWYINDTVSGKHSLPQCWKVHNGSYLNESQFKNEWLLESDHLYSEMLLKEYEERQGRTPLALTDICFWSLVFFTSTVFLHLVGIPSHRHIVGDACPKPHRITKNALCSCGYYNLPGKQVRWVRKGK

SEQ ID NO: 16274 - protein, 507 aa, unidentified; identical to SEQ ID NO: 16273

SEQ ID NO: 16275 - protein, 479 aa, unidentified; identical to SEQ ID NO: 15532

SEQ ID NO: 16276 - protein, 495 aa, unidentified; identical to SEQ ID NO: 15504

SEQ ID NO: 16277 - protein, 493 aa, unidentified; identical to SEQ ID NO: 15223

SEQ ID NO: 16278 - protein, 491 aa, unidentified; identical to SEQ ID NO: 15514

SEQ ID NO: 16279 - protein, 515 aa, unidentified
MGQVIGFFQSLPEIINEALNIALICVALLATIKGMVNIWKSGLIQLLFFLTLAGRSCSHSFTIGRFHEFQSVTVNFTQFMSYAPSSCSVNNTHHYFKGPQNTTWGLELTLTNESMINITNSMRVFTNIHHNVTNCVQNISEHEGVLKWLLETMHLSISKPGKHIAPVMCERQKGLLIEYNLTMTKDHHPNYWNQVLYGLAKLLGSSKRLWFGACNKADCQMQSDHQHIKCNYSNCKGYTSFKYLIIQNTTWENHCEYNHLNTIHLLMSPIGQSFITRRLQAFLTWTLSDALGNDLPGGYCLEQWAVVWFGIKCFDNTAMAKCNQNHDSEFCDMLRLFDYNRNAIQSLNDQSQARLNLLTNTINSLVSDNLLMKNKLRELMNVPYCNYTRFWFINDTKNGRHTLPQCWLVSDGSYLNETRFRTQWLSESNSLYTEMLTEEYEKRQGRTPLSLVDLCFWSTLFYISTLFAHLVGFPTHRHLIGEGCPKPHRLTGSGICSCGHYGIPGKPVRWTKMSR

SEQ ID NO: 16280 - protein, 492 aa, unidentified; identical to SEQ ID NO: 15222

SEQ ID NO: 16281 - protein, 454 aa, unidentified; identical to SEQ ID NO: 15470

SEQ ID NO: 16282 - protein, 491 aa, unidentified; identical to SEQ ID NO: 15459

SEQ ID NO: 16283 - protein, 495 aa, unidentified; identical to SEQ ID NO: 15445

SEQ ID NO: 16284 - protein, 498 aa, unidentified
MGQIVTMFEALPHIIDEVINIVIIVLIVITGIKAVYNFATCGIFALISFLLLAGRSCGMYGLKGPDIYKGVYQFKSVEFDMSHLNLTMPNACSANNSHHYISMGTSGLELTFTNDSIISHNFCNLTSAFNKKTFDHTLMSIVSSLHLSIRGNSNYKAVSCDFNNGITIQYNLTFSDAQSAQSQCRTFRGRVLDMFRTAFGGKYMRSGWGWTGSDGKTTWCSQTSYQYLIIQNRTWENHCTYAGPFGMSRILLSQEKTKFFTRRLAGTFTWTLSDSSGVENPGGYCLTKWMILAAELKCFGNTAVAKCNVNHDAEFCDMLRLIDYNKAALSKFKEDVESALHLFKTTVNSLISDQLLMRNHLRDLMGVPYCNYSKFWYLEHAKTGETSVPKCWLVTNGSYLNETHFSDQIEQEADNMITEMLRKDYIKRQGSTPLALMDLLMFSTSAYLVSIFLHLVKIPTHRHIKGGSCPKPHRLTNKGICSCGAFKVPGVKTVWKRR

SEQ ID NO: 16285 - protein, 496 aa, unidentified
MGQLISFFQEIPVFLQEALNIALVAVSLIAVIKGIINLYKSGLFQFIFFLLLAGRSCSDGTFKIGLHTEFQSVTLTMQRLLANHSNELPSLCMLNNSFYYMKGGVNTFLIRVSDISVLMKEHDVSIYEPEDLGNCLNKSDSSWAIHWFSNALGHDWLMDPPMLCRNKTKKEGSNIQFNISKADDVRVYGKKIRNGMRHLFRGFHDPCEEGKKCYLTINQCGDPSSFDYCGMDHLSKCQFDHVNTLHFLVRSKTHLNFERSLKAFFSWSLTDSSGKDMPGGYCLEEWMLIAAKMKCFGNTAVAKCNQNHDSEFCDMLRLFDYNKNAIKTLNDESKKEINLLSQTVNALISDNLLMKNKIKELMSIPYCNYTKFWYVNHTLTGQHTLPRCWLIRNGSYLNTSEFRNDWILESDHLISEMLSKEYAERQGKTPITLVDICFWSTVFFTASLFLHLVGIPTHRHLKGEACPLPHKLDSFGGCRCGKYPRLRKPTIWHKRH

SEQ ID NO: 16286 - protein, 493 aa, unidentified; identical to SEQ ID NO: 15380

SEQ ID NO: 16287 - protein, 497 aa, unidentified; identical to SEQ ID NO: 15434

SEQ ID NO: 16288 - protein, 491 aa, unidentified; identical to SEQ ID NO: 15503

SEQ ID NO: 16289 - protein, 489 aa, unidentified; identical to SEQ ID NO: 15466

SEQ ID NO: 16290 - protein, 510 aa, unidentified; identical to SEQ ID NO: 15381

SEQ ID NO: 16291 - protein, 518 aa, unidentified; identical to SEQ ID NO: 15486

SEQ ID NO: 16292 - protein, 507 aa, unidentified; identical to SEQ ID NO: 15478

SEQ ID NO: 16293 - protein, 510 aa, unidentified; identical to SEQ ID NO: 15526

SEQ ID NO: 16294 - protein, 498 aa, unidentified; identical to SEQ ID NO: 15238

SEQ ID NO: 16295 - protein, 481 aa, unidentified; identical to SEQ ID NO: 15484

SEQ ID NO: 16296 - protein, 493 aa, unidentified; identical to SEQ ID NO: 15239

SEQ ID NO: 16297 - protein, 495 aa, unidentified; identical to SEQ ID NO: 15583

SEQ ID NO: 16298 - protein, 485 aa, unidentified; identical to SEQ ID NO: 15480

SEQ ID NO: 16299 - protein, 492 aa, unidentified
MRLAITFLQTLPRIIDEVINIVLIALSVIAMLKGVINLLSCGILQLLLFLMLCGRSCSTLRDDFQLKSVQFDMQTLNMTMPLSCSKNNSHHYIFVGNTSGLELTLTNQSIINHRFCNLSTAHKTAEYNFALMSIISTFHLSIPNFNQYEAISCDFNGGKISIQYNLSHSTVTDSANHCGTVANGVLETFHKFYWSGGVRDAYQIPHNHALAHCYQTSYQYLVIQNTTWENHCQFSRPTPLGYLGLLSQRIKQIYISRRLLGVFTWTISDSRGNDLPGGYCLNRWMLIESEVKCFGNAAIANCNEKHDSEFCDMLRLFDFNREAIKRLKIEANKSINLITSAVNSLINDQLIIKNHLRDLMGIPYCNYSKFWFLNHTRSNRTSLPRCWLISKGSYLNETEFSSDIEQEANNLITEMLQKEYTERQGKTPLGLVDIFVFSTSFYLLTVFLHLMKIPTHRHIAGKPCPKPHRLNSMAICHCGLYKQPGLETKWKR

SEQ ID NO: 16300 - protein, 474 aa, unidentified
MNIVLIALSMIAIMKGVINLVSCGILQLLLFLILCGRSCSTLSDDFQLRSVQFDMQTLNMTMPLSCSKNNSHHYIFVGNTSGLELTLTNQSIINHKFCNLSSAHKTADYNFALMSIISTFHLSIPNFNQHEAMSCDFNGGKISIQYNLSHSTVTDTANHCGTVANGILETFHKFYWSGGIRDAYQIPHGHALAHCYQTAYQYLVIQNTTWENHCQFSRPTPLGYLGLLSQRIKQIYISRRLLGVFTWTISDSSGNDLPGGYCLNRWMLIESEVKCFGNAAIAKCNEKHDSEFCDMLRLFDFNREAIKRLKIEANKSINLITSAVNSLINDQLIIKNHLRDLMGIPYCNYSKFWFLNHTRSNRTSLPRCWLISNGSYLNETEFSSDIEQEANNLITEMLQKEYIERQGKTPLGLVDIFVFSTSFYLLTVFLHLIKIPTHRHIAGKPCPKPHRLNSMAICHCGLYKQPGLETKWKR

SEQ ID NO: 16301 - protein, 512 aa, unidentified; identical to SEQ ID NO: 15161

SEQ ID NO: 16302 - protein, 489 aa, unidentified; identical to SEQ ID NO: 15212

SEQ ID NO: 16303 - protein, 501 aa, unidentified
  VARIANT 228: note = Any amino acid
MGQIVTFFQEIPHILEEVMNIVLMTLSLIAILKGIYNFVTCGLGGLIIFLLLAGRSCSENPQHSRLYKGEYRFHEITLDTKSLNSTMPLSCSRNNSHHYIYLKNETGLELTLTNNSLLTHKYCNLSDAHKRNLYDHALMTIITQFHLTIPGFNQYEAMACDFNGGNITVQYNLSHENAHQAAKHCGSVANGVLYAFFKMFWSRNITDTVSLPSDKGSGDVHCMSTSYXYLIIQNVSWADHCIMSSPTPIGPISVLNSQVRTIYLSRRLRSAFSWTLTDAAGIENPGGYCLEKWMLIASELKCFGNTAVAKCNLNHDSEFCDMLRLFDYNKQAILRLKADLETTLETFRKAVNALINDQLIMKNHLKDLLGIPYCNYTRFWYLNSTKTGHHSLPKCWRVSNGSYLNETHFDTEIEQEADNLITEMLQREYIERQGKTPLGLMDLFLFSTSFYLISVFLHLIKIPTHRHIQGKPCPKPHRLNSKAICACGAYNQPGLPIRWKR

SEQ ID NO: 16304 - protein, 489 aa, unidentified; identical to SEQ ID NO: 15388

SEQ ID NO: 16305 - protein, 489 aa, unidentified
MGQVVTFFQEVPHIIEEVMNIVLITLTLIAILKGIYNLMTCGIIGLLIFLFLCGKSCSAVYKDNYELMHLELDMRSLNATMPLSCSKNNSHHYIQVFNTSGLELTLTNTSLLTHKFCNLSDAHRKDLYDHTLMSIISTFHLNIPNFNQYEAMSCDFNGGKITVQYNLSHNTVTEAANHCGTVANGVLETFRRMTWCVSCETPYEIGGTRCVKTPYKYLIIQNTTWEDHCLMSNPSPVGYLSLLAQKARNIYISRRLLGTFTWTLSDSAGNDLPGGYCLQRWMLIAADLKCFGNTAVAKCNQQHDEEFCDMLRLFDFNKEAIKRLRVEAEKSITLINKAVNSLINDQLIMKNHLRDLMGIPYCNYSKFWYLNDTRSGQTSLPKCWKVTNGSYLNETHFSEEIEQEADNMITEMLKKEYEKRQSTTPLGLVDLFIFSTSFYLITVFLHLVKIPTHRHIVGKPCPKPHRLNHMGVCSCGLYKQPGVPTKWKR

SEQ ID NO: 16306 - protein, 495 aa, unidentified
MGQVVTFFQEIPHVLEEVMNIVLITLAALAIIKGIYNFATCGIIGLITFLLLCGRSCSSVYKGNYNLSSVDLDLSHLNMTMPLSCSKNNSHHYIFLNKTGLELTFTNTSVLSHKFCNLSDAHKKNLYDHALMTVITTFHLSIPDFNQYEAMSCDFNGGNITVQYNLSHSNPTDAANHCGTVANGVLDTFYRLSWGHDIKKVFTLSAGYQTGRWVDCYQTGYQYLIIQNVSWADHCQLSRPTPIGFLSLMNQKIKSIYISRRLLGTFSWTLSDSSGNDSPGGYCLTRWMLFAADLKCFGNTAVAKCNLNHDEEFCDMLRLIDFNKQAVRRLKNETQLGLRLVTKAVNALINDQLIMKNHLRDLMGIPYCNYSKFWYLNDTRNGRTSLPKCWLVSNGSYLNETQFSDTIEQEADNMITEMLRREYQHRQGATPLGLVDLFVFSTSFYLISVFLHLIRIPTHRHILGQGCPKPHRLNSKAICACGAYKQPGLTTKWKR

SEQ ID NO: 16307 - protein, 491 aa, unidentified
MGQIVTFFQEVPHIIEEVMNIVLITLSLLAILKGVYNVMSCGLIGLLAFLFLCGRSCSTIYKDNYQLMELELDMSGLNATMPLSCSKNASHHYIQVFNTSGLELTLTNESLISHKWCNLSDAHKKDVYDHTLMSILSTFHLSIPNFNHYEAMACDFNNGKISVQYNLSHSSETEAMNHCGTTANGILEVFRRMTWCTRCDVPLGASIAGFNCVRTSYKYLIIQNTTWEDHCVMSRPSPMGYLSLLSQRTREIYISRRLMGTFTWTLSDSEGNDLPGGYCLQRWMLISGELKCFGNTAVAKCNQQHDEEFCDMLRLFDFNKEAIHRLRVEAERSISLINKAVNSLINDQLIMRNHLRDIMGIPYCNYSRFWYLNDTRNGKTSLPKCWMVSNGTYLNETHFSSDIEQEANNMITEMLRKEYERRQGTTPLGLVDLFVFSTSFYLISVFLHLIKIPTHRHLVGKPCPKPHRLNHMGICSCGFYKHPGLPTKWKR

SEQ ID NO: 16308 - protein, 492 aa, unidentified
MGQAITFFQTLPHIIDEVINIVLIALSMMAILKGIINLISCGVLQLLIFLVLCGRSCSTLTNDFQLKSVQFDMQTLNMTMPLSCSKNNSHHYIFVGNTSGLELTLTNTSIINHKFCNLSTAHRAADYNLALMSIISTFHLSIPNFNQYEAMSCDFNGGKISIQYNLSHSTATDSANHCGTLANGVLETFHKFYWSSGIKDAYQIPQSHALVHCYQTSYQYLIIQNTTWGDHCVFSRPTPLGYLGLLSQRIKQIYISRRLLGVFTWTISDSSGNDLPGGYCLNRWMLIESEVKCFGNAAIAKCNEKHDSEFCDMLRLFDFNREAIKRLKIEASKSISLITSAVNSLINDQLIIKNHLRDLMGIPYCNYSRFWFLNHTRSNRTSLPRCWLISNGSYLNETEFSSDIEQEANNLITEMLQKEYMERQGKTPLGLVDIFIFSTSFYLLTVFLHLVKIPTHRHIAGKPCPKPHRLNSMAICHCGLYKQPGLETKWKR

SEQ ID NO: 16309 - protein, 483 aa, unidentified
MGQFISFMQEIPVFLQEALNVALVAVSLICVVKGLVNLYRCGLFQLMVFLVLAGRSCSEEMFKIGMHTRFQEVTLSLNALLSNQSHELPMLCLANKTHLYLKSGMSSFRISIDDVTILTKSVDISIHSPKLSSCFESDEEWVLAWWIEAVGHRWDQDPELLCRNKTKTEGGLIQINISRADENVHYGWRLKNGLDHIYSGRKEPCVEGGKCLIKIQPDTWPNNCEADHTNTFRFLSRSQKSVAVGRTLKAFFSWSLSDSSGKDAPGGYCLEEWMLVASKIKCFGNTAIAKCNENHDSEFCDMLRLFDYNKNAIKTLNEETKNRVNVLSQTINALISDNLLMKNKIRELMSVPYCNYTRFWYVNHTLSGQHSLPRCWMIKNNSYLNSSEFRNEWILESDFLISEMLSKEYSDRQGKTPITLVDICFWSTVFFTGTLFLHLVGFPTHRHIQGESCPLPHRLNSLGGCRCGKYPSLKKPTVWRRGH

SEQ ID NO: 16310 - protein, 492 aa, unidentified
MGQAITFFQTLPHIIDEVINIVLIALSMIAILKGIINLLSCGILQLLLFLMLCGRSCSTLSDDFQLKSVQFDMQTLNMTMPLSCSKNNSHHYIFVGNTSGLELTLTNESIISDKYCNLSSAHKSASYNFALMSIISTFHLSIPNFNQYEAMSCDFNGGKISIQYNLSHNTATEAANHCGTVANGILETFHKFYWSGGIKDAYQIPNGPALAHCYQTSYQYLIIQNTTWQDHCTFSRPTPLGYLGLLSQRIKQIYISRRLLGVFTWTISDSSGNDLPGGYCLNRWMLIESEVKCFGNAAIAKCNEKHDSEFCDMLRLFDFNREAIKRLKIEANKSINLITSAVNSLINDQLIIKNHLRDLMGIPYCNYSKFWFLNHTRSNRTSLPRCWLISNGSYLNETEFSSDIEQEANNLITEMLQKEYAERQGKTPLGLVDIFVFSTSFYLLTVFLHLIKIPTHRHIAGKPCPKPHRLNSMAICHCGLYKQPGLETKWKR

SEQ ID NO: 16311 - protein, 492 aa, unidentified
MGQAITFFQTLPHIIDEVMNIVLIALSMIAILKGVINLLSCGILQLLLFLMLCGRSCSTLSEDFQLRSVQFDMKTLNMTMPLSCSKNNSHHYIFVGNTSGLELTLTNQSIINHKFCNLSSAHKTADYNFALMSIISTFHLSIPNFNQYEAMSCDFNGGKISIQYNLSHSTPTDAANHCGTVANSILETFHKFYWSGGIRDAYQIPNNHVLAHCYQTSYQYLIIQNTTWADHCTFSRPTPLGYLGLLSQRIKQIYISRRLLGVFTWTISDSSGNDLPGGYCLNRWMLIESEVKCFGNAAIAKCNEKHDSEFCDMLRLFDFNREAIKRLKIEANKSINLITSAVNSLINDQLIIKNHLRDLMGIPYCNYSRFWFLNHTVSNRTSLPRCWLVSNGSFLNETEFSTDIEQEANNLITEMLQKEYIERQGKTPLGLVDIFIFSTSFYLLTVFLHLIKIPTHRHISGKPCPKPHRLNSMAVCHCGLYKQPGLETRWKR

SEQ ID NO: 16312 - protein, 492 aa, unidentified
MGQAITFFQTLPHIIDEVMNIVLIALSMIAILKGVINLLSCGILQLLLFLMLCGRSCSTLRDDFQLKSVQFNMETLNMTMPLSCSKNNSHHYIFVGNTSGLELTLTNQTIINHKFCNLSSAHKTANYNFALMSIISTFHLSIPNFNQYEAMSCDFNGGKISIQYNLSHSTVTDSANHCGTVANGILETFHKFYWSGGIRDAYQIPHNHALAHCYQTSYQYLVIQNTTWEDHCQFSRPTPLGYLGLLSQRIKQVYISRRILGVFTWTISDSSGNDLPGGYCLNRWMLIESEVKCFGNAAIAKCNEKHDSEFCDMLRLFDFNREAIKRLKIEANKSINLITSAVNSLINDQLIIKNHLRDLMGIPYCNYSKFWFLNHTRSNRTSLPRCWLISNGSYLNETEFSSDIEQEANNLITEMLQKEYIERQGKTPLGLVDIFVFSTSFYLLTVFLHLIKIPTHRHIAGKPCPKPHRLNSMAICHCGLYKQPGLETKWKR

SEQ ID NO: 16313 - protein, 492 aa, unidentified
MGQAITFFQTLPHIIDEVMNIVLIALSMIAILKGVINLLSCGILQLLLFLMLCGRSCSTLSEDFQLRSVQFDMKTLNMTMPLSCSKNNSHHYIFVGNTSGLELTLTNQSIINHKFCNLSSAHKTADYNFALMSIISTFHLSIPNFNQYEAMSCDFNGGKISIQYNLSHSTPTDAANHCGTVANGILETFHKFYWSGGIRDAYQIPNNHMLAHCYQTSYQYLIIQNTTWADHCTFSRPTPLGYLGLLSQRIKQIYISRRLLGVFTWTISDSSGNDLPGGYCLNRWMLIESEVKCFGNAAIAKCNEKHDSEFCDMLRLFDFNREAIKRLKIEANKSINLITSAVNSLINDQLIIKNHLRDLMGIPYCNYSRFWFLNHTVSNRTSLPRCWLVSNGSFLNETEFSTDIEQEANNLITEMLQKEYIERQGKTPLGLVDIFIFSTSFYLLTVFLHLIKIPTHRHISGKPCPKPHRLNSMAVCHCGLYKQPGLETRWKR

SEQ ID NO: 16314 - protein, 567 aa, unidentified; identical to SEQ ID NO: 15390
  VARIANT 505: note = Any amino acid
  VARIANT 510: note = Any amino acid
  VARIANT 512: note = Any amino acid
  VARIANT 562: note = Any amino acid

SEQ ID NO: 16315 - protein, 492 aa, unidentified
  VARIANT 253: note = Any amino acid
MGQAITFFQTLPHIIDEVMNIVLIALSMIAILKGVINLLSCGILQLLLFLMLCGRSCSTLSEDFQLRSVQFDMKTLNMTMPLSCSKNNSHHYIFVGNTSGLELTLTNQSIINHKFCNLSSAHKTADYNFALMSIISTFHLSIPNFNQYEAMSCDFNGGKISIQYNLSHSTPTDAANHCGTVANGILETFHKFYWSGGIRDAYQIPNNHMLAHCYQTSYQYLIIQNTTWADHCTFSRPTPLGYLGLLSQRIKQXYISRRJLGVFTWTISDSSGNDLPGGYCLNRWMLIESEVKCFGNAAIAKCNEKHDSEFCDMLRLFDFNREAIKRLRIEANKSTNLITSAVNSLSNYQLISKNHLRDLMGIPYCNYSRFWFLNHTVSNRTSLPRCWLVSNGSFLNETEFSTDIEQEANNLITEMLQKEYIERQGKTPLGLVDIFIFSTSFYLLTVFLHLIKIPTHRHISGKPCPKPHRLNSMAVCHCGLYKQPGLETRWKR

SEQ ID NO: 16316 - protein, 492 aa, unidentified
  VARIANT 108: note = Any amino acid
  VARIANT 126: note = Any amino acid
MGQAITFFQTLPHIIDEVMNIVLIALSMIAILKGVINLMSCGILQLLLFLMLCGRSCSTLSEDFQLRSVQFDMQTLNMTMPLSCSKNNSHHYIFVGNTSGLELTLTNXSIISHKFCNLSSAHKTAXYNFALMSIISTFHLSIPNFNQYEAMSCDFNGGKISIQYNLSHSTVTDAANHCGTVANSILETFHKFYWSGGIKDAYQIPNDHVLAHCYQTSYQYLIIQNTTWGDHCIFSRPTPLGYLGLLSQRIKQIYISRRLLGVFTWTISDSSGNDLPGGYCLNRWMLIESEVKCFGNAAIAKCNEKHDSEFCDMLRLFDFNREAIKRLKIEANKSINLITSAVNSLINDQLIIKNHLRDLMGIPYCNYSKFWFLNHTMSNRTSLPRCWLISNGSYLNETEFSSDIEQEANNLITEMLQKEYIERQGKTPLGLVDIFVFSTSFYLLTVFLHLIKIPTHRHITGKPCPKPHRLNSMAICHCGLYKQPGLETKWKR

SEQ ID NO: 16317 - protein, 492 aa, unidentified
MFEALPHIIDEAINIVMMVLIIITALKAVYNFATCGIFTLIAFLLLAGRSCALYGLSGPDIYKGVYQFKSVSFNMSVLNLTMPNACSANNSHHYISMGTSGLELTFTNDSILSHNFCNLTDSFRKRTFDHVLMSIVTSLHLSVRGNNNYKAVSCDFNNGITIQYNLSFSGAQEAVNQCNTFRGRVLDMFRTAFGGKFMRSGYGWKDAQGRTTWCSQTSYQYLIIQNRTWENHCEYAGPFGLSRILFAQEKTKFLTRRLAGTFTWTLSDSSGTDDPGGYCLTRWMILAADLKCFGNTAVAKCNMNHDEEFCDMLRLIDYNKAALTKFKTDVESALHLFKTTVNSLISDQLLMRNHLRDLMGVPYCNYSKFWYLEHAKTGETSVPKCWLVTNGSYLNETHFSDQIEQEADNMITEMLRKDYLKRQGVTPLALVDILLFTTSAYLVSIFLHLLKIPTHRHIRGGTCPKPHRLNRMGICSCGAFKVPGVDTVWKRR

SEQ ID NO: 16318 - protein, 492 aa, unidentified
MGQTITFFQTLPHIIDEVMNIVLIALSMIAILKGVINLLNCGLLQLLLFLLLCGRSCSTLSDDFQLKSVQFDMQTLNMTMPLSCSRNNSHHYIFVGNTSGLELTLTNQSIIQHKFCNLSTAHRNASYDFALMSIISTFHLSIPNFNQYEAMSCDFNGGKISIQYNLSHSTATDSANHCGTVANGILGTFNKFYWSGGIKDAYQIPNGHVLAHCYQTSYQYLIIQNTTWGDHCQFSRPTPMGYLGLLSQRIKQIYISRRLLGVFTWTISDSSGNDVPGGYCLNRWMLIESEVKCFGNAAIAKCNEKHDSEFCDMLRLFDFNKEAIKRLRIEANKSINLITSAVNSLINDQLIIKNHLRDLMGIPYCNYSKFWFLNHTRSNRTSLPRCWLISNSSYLNTTEFSSDIEQEANNLITEMLQKEYIDRQGKTPLGLVDIFIFSTSFYLLTVFLHLIKIPTHRHIAGKPCPKPHRLNSMAICHCGLYKQPGLEVRWKR

SEQ ID NO: 16319 - protein, 485 aa, unidentified
MGQFISFMQEIPTFLQEALNIALVAVSLIAIIKGIVNLYKSGLFQFFVFLALAGRSCTEEAFKIGLHTEFQTVSFSMVGLFSNNPHDLPLLCTLNKSHLYIKGGNASFQISFDDIAVLLPQYDVIIQHPADMSWCSKSDDQIWLSQWFMNAVGHDWHLDPPFLCRNRTKTEGFIFQVNTSKTGVNGNYAKKFKTGMHHLYREYPDPCLNGKLCLMKAQPTSWPLQCPLDHVNTLHFLTRGKNIQLPRRSLKAFFSWSLTDSSGKDTPGGYCLEEWMLVAAKMKCFGNTAVAKCNLNHDSEFCDMLRLFDYNKNAIKTLNDETKKQVNLMGQTINALISDNLLMKNKIRELMSVPYCNYTKFWYVNHTLSGQHSLPRCWLIKNNSYLNISDFRNDWILESDFLISEMLSKEYSDRQGKTPLTLVDICIWSTVFFTASLFLHLVGIPSHRHIRGEACPLPHRLNSLGGCRCGKYPNLKKPTVWRRGH

SEQ ID NO: 16320 - protein, 429 aa, unidentified
MAGHTAQSPLYLVLLSVMFHPTFGTIGEMLSLAASSNSSICHGMQFTEPTESFMGILPNETQPMFKFSIMHSEAVPKVGKTLKISHDMKLFGEEAINYMIFINKIVFEPVSYYNITGTCRQQGLQACVRVYSDLVNGSKGFPSQKLGFTANELNKTKNSNSHNLGFKICLSCKDHNGIRLVVYNKVNRTAQLMMCPKELIFSQDFTINSTSNVKGDEETAVPLLNVTGYYCIALHNKNMLTHHSLALSSGSKVDNTLEPGCDSNVGLFGHSTGTDYGWGLANFFSAGITNSLQISQLEHVTDAIACKIAKTSNYTTTALFLLNKEEGEIRDHVIEHEVALNYLLAHQGGLCNVVKGPMCCSDIDDFRKNVSDMIDKVHEEMKKFYHEPDPFGGLGTWGFYGTIFGHIFQWIPIVIMVIIVCFICSWIKK

SEQ ID NO: 16321 - protein, 429 aa, unidentified; identical to SEQ ID NO: 15236

SEQ ID NO: 16322 - protein, 427 aa, unidentified; identical to SEQ ID NO: 15449

SEQ ID NO: 16323 - protein, 426 aa, unidentified; identical to SEQ ID NO: 15237

SEQ ID NO: 16324 - protein, 427 aa, unidentified; identical to SEQ ID NO: 15433

SEQ ID NO: 16325 - protein, 423 aa, unidentified; identical to SEQ ID NO: 15431

SEQ ID NO: 16326 - protein, 414 aa, unidentified
MGALLLIINLLLLSSSSSGTITELLSLAAQDNSSICHGLQFIEPTQSFVGIVPNETYPLFDFSIRAPNDSAPVGRTLLITHDMKLFGHEAKNYTIETSIVRFEDQIYNNAVGSCRKQGYTACVEIRVGRETRKIGFTSQELTSKFNNSSPNMGYKICIGCHTFKGIRMVVYNKKNRTASLVMCPSELIHHDNFVMNSTGGKSHITESIANVSNYVCIALHNKNLLTHHSMALSSGSRIENNLEPGCDSNVGLFGHSTGTDYGWGLANFFSAGITNSLQISQLEHVTDAIACKIAKTSNYTTTALFLLNKEEGEIRDHVIEHEMALNYLLAHQGGLCGVFKGPLCCSDIDDFRKNVSDMIDKVHEEMKKFYHEPDPFGGLGTLGFYGSVIGHLLQWIPIIILIIVVCFICSWIKR

SEQ ID NO: 16327 - protein, 426 aa, unidentified
MAGWAQLALYLTLLLIVPQLALGTIGEMLSLAASGNSSICHGMQFTEPTESFMGIIPNESQPMFIFSIMHSEAVPKVGKTLKISHDMKLFGEEAINYTIFINRIVFEPASYMNYSSSCRAQKFQACVRVYSDLTNGSKGFPSVKLGFTADELNRTHKSDFHNMGFKVCLSCRDHNGIKLIVYNKINRTAQLMMCPTKLIYSYDFTMNSTSDRSEETATPLINVTGYACIALHNKNMLTHHSLALSSGSKVDNTLEPGCDSNVGLFGHSTGTDYGWGLANFFSAGITNSLQISQLEHVTDAIACKIAKTSNYTTTALFLLNKEEGEIRDHVIEHEVALNYLLAHQGGLCNIVKGPMCCSDIDDFRRNVSDMIDKVHEEMKKFYHEPDPFGGLGTWGFYGTIFGHVLQWIPIIIMIIIVCFVCSWVRR

SEQ ID NO: 16328 - protein, 696 aa, unidentified
MVNFAVYQTTIFTYCRSVSNPKCVSSKRQATTVSYIDSTIFVVSPDQPHTFVLWYLNEFTGSFLCSENCQFELPKAYLVKDGILTVKVFILDSLVQASTFNIKASETCQIRDCTFICLDYFTNFVCYSTTTQAIIGFVFISVIILLIALMSFISYKIYCCINRMYTFKVTPDPRMAAALCILLCLSPASAACISTTTVAIPTTQCTLLNGNYTCQTSLNANINLLHLGDTACFRFTNQQGDTIGTLNVLYDLSLYVAPLSPIYYTSDWLGLSCSHKSCRNDHPCSLSDGCPSDSTLLNSVLTPQCVVYPGRTKCESSCGCAGCGCFFCSDACLISRAAFQPVGLPYQVKTIGSVSVYPRLTVEYNFNGTTVSSTSDLFNPLSTPDFTLNLVGSYQAATTSISLGAAAFSSDGASALYYSYSDYNNPQFGVIGDVQSSLINGFSNPPYNFIFPDSSISQITSSSSVDYQFPQSGISRARQTPFPLLKDGIIYTADSERLYGLNPNAPAITVAMSSSHTSFSLVSETVCPKYVSHSISGCYNCPQGFTITFNAFSACRPGSVSVVVEGNFLCTTSFVTLNTTSLPSILYCISQQKQIEGTIKLLGDTEEHFPVLTVLNEAPPLSPNDFQRFYGNFTPTFNSAANFWDSLTGSAFIAKYAVVAGLSAVALVAIIAMIVTTYNWFKAREIYQTFNKYVNV

SEQ ID NO: 16329 - protein, 415 aa, unidentified; identical to SEQ ID NO: 15460

SEQ ID NO: 16330 - protein, 320 aa, unidentified
MPLGGSSACVSSIPLLGSVNNNSSIQKLETSSKSATELTTPINHSQSPQPASVTNTPTPTTQSKPWTADHNNTTPTMDPTPIPTTSDTATTPPNNPSDHNATTTSKTRRRRQVNPAPPTITQQTSTSINTSHHPNMTTQLARHPSVQTRMQNPSCNPNLRYWTSREMSNAGGLAWIPWIGPGIEGGITDGIMEHQNTIVCQLRELANTTTKALQLFLRATTELRTYSILNRHAIDFLLQRWGGTCRILGPNCCIEPHDWSANITAEINHIREDILNHHEIQPSQDPSFWAGWQQWVPTGASALGIILAILALICLCRITR

SEQ ID NO: 16331 - protein, 662 aa, unidentified
MALAKKYLMRIFIISHYFLSYNYGFFLPIVKLDIQPENEIIKSPCNGVVKKTEDIHLMSLTLTGQKTASDPMAASKRWAFKEGVLPKTVAFTEGEEAKDCFNISIVDLQGRSLLLEAPSGIKDYPRCKSIHHIQGQNPHAKGNVLHLWGAFFLYDRIASTTMFKDKVFAEGNVAALVINKTVHHQIFKINKIPQNETIGSCNHTYWRSDAGDGFNTTLAVTNLAYVLSANESTKIFKQMQDDLRKRIENMTSSNLTTLSPEAISNSSDANSSATIAYGTSGASISATTRSATSTLTITTDGQMSPPPTPAPPSPSLKPSTDDIKTPTVLSTTSSSTRSKRSVTVAKQSSANPTGKQRGRGRKGPSTGTLTEEQIERVRMLIQKNVGRVNYNNLPLIAGLTALKKKRQVLETFSGEIELEELIGDEKLDSRFRENLKMILETLRNESYSHFELDIPKTAALKSPEETDPRIHMEYLGSGEEPIQSNGQTDTDCDPSLRIWTPNEEKLAAGVSWIPYFGPGAEGLYTMGLMQNQNDVVCRLRRLANQTAKSLDLLLRVTTEERTYSIINRHAIDFLLARWGGTCRVLGPECCIGVEDLTKNITDQIQQMRRDEQDEYEGWGKGGNWFNSQFGNWLNLGILIFLFLGIIIALSCVCRLFMNLTVY

SEQ ID NO: 16332 - protein, 672 aa, unidentified
MILQVPGKRHQRTVLFIWLVILFQRAVSVPLGVIHNSTLQVSDIDKLVCHDKLTSTNQLRSIGLNLEGNGIATDVPSATKRWGFRAGVPPKVVGYEAGEWAENCYNLEIKKPDGSECLPMAPEGIRGFPRCRYVHKVSGTGPCESGFAFHKEGAFFLYDRLASTIIYRGTTFAEGVVAFIILPKAEKNFLQPPLTQGPTNTTNDPSSMYHSTTLEYETTRFGTNRSAFWFKVDNLTFVQLESRFTPQFLVELNETIYIEGKRSNTTGRLIWQVNSRVDTDVGEWAFWENKKNLKKSFPREELSLTAVPRAADSEHDAHPPEHTPGPDSNPTINDNTELVTEDPAHLVQLQRQGRKEILPTPTPQAIEREPPAAQHDNPRNSPTPPSPIESDITDSTQAEDLTHTDDPSTINSATEEPLPEVGGTTQVPRDPEDPRRTQPTPPTGQPEQPSDNTMTPGQIHSESAAPMGERSIDGPGLLTNTLTGVARLITGAGRAKRESPEIRGAKCNPNLHYWTTHEESAAAGLAWIPYFGPAAEGIYTEGLMQNQNELICGLRQLANETTQALQLFLRSTTELRTFSILNRKAIDFLLQRWGGTCRILGPDCCIEPHDWTKNITDRIDQIIHDFVDKPLPDQSNNDNWWTGWRQWIPAGIGVVGVIAAFIALICICKIIC

SEQ ID NO: 16333 - protein, 676 aa, unidentified
MVTSGILQLPRERFRKTSFFVWVIILFHKVFPIPLGVVHNNTLQVSDIDKLVCRDKLSSTSQLKSVGLNLEGNGVATDVPTATKRWGFRAGVPPKVVNYEAGEWAENCYNLDIKKADGSECLPEAPEGVRGFPRCRYVHKVSGTGPCPEGYAFHKEGAFFLYDRLASTIIYRSTTFSEGVVAFLILPETKKDFFQSPPLHEPANMTTDPSSYYHTVTLNYVADNFGTNMTNFLFQVDHLTYVQLEPRFTPQFLVQLNETIYTNGRRSNTTGTLIWKVNPTVDTGVGEWAFWENKKNFTKTLSSEELSVIFVPRAQDPGSNQKTKVTPTSFANNQTSKNHEDLVPEDPASVVQVRDLQRENTVPTPPPDTVPTTLIPDTMEEQTTSHYEPPNISRNHQERNNTAHPETLANNPPDNTTPSTPPQDGERTSSHTTPSPRPVPTSTIHPTTRETHIPTTMTTSHDTDSNRPNPIDISESTEPGPLTNTTRGAANLLTGSRRTRREITLRTQAKCNPNLHYWTTQDEGAAIGLAWIPYFGPAAEGIYTEGIMHNQNGLICGLRQLANETTQALQLFLRATTELRTFSILNRKAIDFLLQRWGGTCHILGPDCCIEPHDWTKNITDKIDQIIHDFIDKPLPDQTDNDNWWTGWRQWVPAGIGITGVIIAVIALLCICKFLL

SEQ ID NO: 16334 - protein, 677 aa, unidentified
MGSGYQLLQLPRERFRKTSFLVWVIILFQRAISMPLGIVTNSTLKATEIDQLVCRDKLSSTSQLKSVGLNLEGNGIATDVPSATKRWGFRSGVPPKVVSYEAGEWAENCYNLEIKKSDGSECLPLPPDGVRGFPRCRYVHKVQGTGPCPGDLAFHKNGAFFLYDRLASTVIYRGTTFAEGVIAFLILSEPKKHFWKATPAHEPVNTTDDSTSYYMTLTLSYEMSNFGGEESNTLFKVDNHTYVQLDRPHTPQFLVQLNETLRRNNRLSNSTGRLTWTVDPKIEPDVGEWAFWETKKNFSQQLHGENLHFQILSTHTNNSSDQSPAGTVQGKISYHPPTNNSELVPTDSPPVVSVLTAGRTEEMSTQGLTNGETITGFTANPMTTTIAPSPTMTSEVDNNVPSEQPNNTASIEDSPPSASNETIDHSEMNSIQGSNNSAQSPQTKATPAPTASPMTLDPQETANISKPGTSPGSAAGPSQPGLTINTISKVADSLSPTRKQKRSVRQNTANKCNPDLHYWTAVDEGAAAGLAWIPYFGPAAEGIYIEGVMHNQNGLICGLRQLANETTQALQLFLRATTELRTYSLLNRKAIDFLLQRWGGTCRILGPSCCIEPHDWTKNITDEINQIKHDFIDNPLPDHGDDLNLWTGWRQWIPAGIGIIGVIIAIIALLCICKILC

SEQ ID NO: 16335 - protein, 676 aa, unidentified
MGGLSLLQLPRDKFRKSSFFVWVIILFQKAFSMPLGVVTNSTLEVTEIDQLVCKDHLASTDQLKSVGLNLEGSGVSTDIPSATKRWGFRSGVPPKVVSYEAGEWAENCYNLEIKKPDGSECLPPPPDGVRGFPRCRYVHKAQGTGPCPGDYAFHKDGAFFLYDRLASTVIYRGVNFAEGVIAFLILAKPKETFLQSPPIREAVNYTENTSSYYATSYLEYEIENFGAQHSTTLFKIDNNTFVRLDRPHTPQFLFQLNDTIHLHQQLSNTTGRLIWTLDANINADIGEWAFWENKKNLSEQLRGEELSFEALSLNETEDDDAASSRITKGRISDRATRKYSDLVPKNSPGMVPLHIPEGETTLPSQNSTEGRRVGVNTQETITETAATIIGTNGNHMQISTIGIRPSSSQIPSSSPTTAPSPEAQTPTTHTSGPSVMATEEPTTPPGSSPGPTTEAPTLTTPENITTAVKTVLPQESTSNGLITSTVTGILGSLGLRKRSRRQTNTKATGKCNPNLHYWTAQEQHNAAGIAWIPYFGPGAEGIYTEGLMHNQNALVCGLRQLANETTQALQLFLRATTELRTYTILNRKAIDFLLRRWGGTCRILGPDCCIEPHDWTKNITDKINQIIHDFIDNPLPNQDNDDNWWTGWRQWIPAGIGITGIIIAIIALLCVCKLLC

SEQ ID NO: 16336 - protein, 676 aa, unidentified
MGASGILQLPRERFRKTSFFVWVIILFHKVFSIPLGVVHNNTLQVSDIDKFVCRDKLSSTSQLKSVGLNLEGNGVATDVPTATKRWGFRAGVPPKVVNYEAGEWAENCYNLAIKKVDGSECLPEAPEGVRDFPRCRYVHKVSGTGPCPGGLAFHKEGAFFLYDRLASTIIYRGTTFAEGVIAFLILPKARKDFFQSPPLHEPANMTTDPSSYYHTTTINYVVDNFGTNTTEFLFQVDHLTYVQLEARFTPQFLVLLNETIYSDNRRSNTTGKLIWKINPTVDTSMGEWAFWENKKNFTKTLSSEELSFVPVPETQNQVLDTTATVSPPISAHNHAGEDHKELVSEDSTPVVQMQNIKGKDTMPTTVTGVPTTTPSPFPINARNTDHTKSFIGLEGPQEDHSTTQPAKTTSQPTNSTESTTLNPTSEPSSRGTGPSSPTVPNTTESHAELGKTTPTTLPEQHTAASAIPRAVHPDELSGPGFLTNTIRGVTNLLTGSRRKRRDVTPNTQPKCNPNLHYWTALDEGAAIGLAWIPYFGPAAEGIYTEGIMENQNGLICGLRQLANETTQALQLFLRATTELRTFSILNRKAIDFLLQRWGGTCHILGPDCCIEPQDWTKNITDKIDQIIHDFVDNNLPNQNDGSNWWTGWKQWVPAGIGITGVIIAIIALLCICKFML

SEQ ID NO: 16337 - protein, 676 aa, unidentified
MGVTGILQLPRDRFKRTSFFLWVIILFQRTFSIPLGVIHNSTLQVSDVDKLVCRDKLSSTNQLRSVGLNLEGNGVATDVPSATKRWGFRSGVPPKVVNYEAGEWAENCYNLEIKKPDGSECLPAAPDGIRGFPRCRYVHKVSGTGPCAGDFAFHKEGAFFLYDRLASTVIYRGTTFAEGVVAFLILPQAKKDFFSSHPLREPVNATEDPSSGYYSTTIRYQATGFGTNETEYLFEVDNLTYVQLESRFTPQFLLQLNETIYTSGKRSNTTGKLIWKVNPEIDTTIGEWAFWETKKNLTRKIRSEELSFTAVSNRAKNISGQSPARTSSDPGTNTTTEDHKIMASENSSAMVQVHSQGREAAVSHLTTLATISTSPQPPTTKPGPDNSTHNTPVYKLDISEATQVEQHHRRTDNDSTASDTPPATTAAGPLKAENTNTSKGTDLLDPATTTSPQNHSETAGNNNTHHQDTGEESASSGKLGLITNTIAGVAGLITGGRRARREAIVNAQPKCNPNLHYWTTQDEGAAIGLAWIPYFGPAAEGIYTEGLMHNQDGLICGLRQLANETTQALQLFLRATTELRTFSILNRKAIDFLLQRWGGTCHILGPDCCIEPHDWTKNITDKIDQIIHDFVDKTLPDQGDNDNWWTGWRQWIPAGIGVTGVIIAVIALFCICKFVF

SEQ ID NO: 16338 - protein, 681 aa, unidentified
MKTTCLLISLILIQGVKTLPILEIASNIQPQNVDSVCSGTLQKTEDVHLMGFTLSGQKVADSPLEASKRWAFRAGVPPKNVEYTEGEEAKTCYNISVTDPSGKSLLLDPPTNIRDYPKCKTIHHIQGQNPHAQGIALHLWGAFFLYDRIASTTMYRGKVFTEGNIAAMIVNKTVHKMIFSRQGQGYRHMNLTSTNKYWTSSNGTQTNDTGCFGTLQEYNSTKNQTCAPSKKPLPLPTAHPEVKLTSTSTDATKLNTTDPNSDDEDLTTSGSGSGEQEPYTTSDAATKQGLSSTMPPTPSPQPSTPQQGGNNTNHSQGVVTEPGKTNTTAQPSMPPHNTTTISTNNTSKHNLSTPSVPIQNATNYNTQSTAPENEQTSAPSKTTLLPTENPTTAKSTNSTKSPTTTVPNTTNKYSTSPSPTPNSTAQHLVYFRRKRNILWREGDMFPFLDGLINAPIDFDPVPNTKTIFDESSSSGASAEEDQHASPNISLTLSYFPKVNENTAHSGENENDCDAELRIWSVQEDDLAAGLSWIPFFGPGIEGLYTAGLIKNQNNLVCRLRRLANQTAKSLELLLRVTTEERTFSLINRHAIDFLLARWGGTCKVLGPDCCIGIEDLSRNISEQIDQIKKDEQKEGTGWGLGGKWWTSDWGVLTNLGILLLLSIAVLIALSCICRIFTKYIG

SEQ ID NO: 16339 - protein, 619 aa, unidentified
MGARTLSVILVCCLLQLTLSLVQLNANGKNSDEHVDFRPDVRGGIFLRRYGTLLKPDQEMFITNGEISFPLRISLAMAEPDRFTCAKEELNTIVHRVDGKGKTLSEKVEKLVSGIQVRSQLGNQRSKRFAISGALAIGKGVLSLITGGFKLFSSYRKVNEIRIMRNEVALLRKQSYQANQIHDARLSAVLSSMHEVKDLVVSLREEFLRFQDNITCDLQRVEVAAVVGPWERLWVSVLESLISQPFNNRWVATRLGTLGLKGFFKHLEGFLGSDNIYGQCEECTLSMLSVSALDYDSDRRELTLMISLPIINMNHRYTIMSANPVPTRIGEGNVMSASFNQRVLIKDGVGYTGDLSMCLTIPGVTLCEASEVNLNNRGPPSTWKLDDIVTMTEITVEPSFWMLVQLYDSVVVYTESDHLCRVQRSTGQTMGLEKGMSQIGSSDGSFLICDNFRVPIPQGASMTPIDSFGLQPVLRTLDRVEVESLAAGHLSGSQLAKILEQDKTPSLYDFYMSDDHDQGKMIAVNQVICALVFLVVLGLMVCLCKNRKTIRLLLKAARASTISLATILRRVNDTEARGRRTGNYLSLKKRGESNRPQSRAFRFPIEEGEGDGASYDSVE

SEQ ID NO: 16340 - protein, 473 aa, unidentified; identical to SEQ ID NO: 8967

SEQ ID NO: 16341 - protein, 461 aa, unidentified
MEHITFFFIISVSTVVANSFLAVHIATYGVPKCYKLAALDGVRHLWMSVPLPHTGILNFEKTGDQAHSSYSAFLPTICYGTEPGYEGCFHPSKDFDYGAIPFKRNGTTLCKRPIYSRDNKNTYCTDPVADSQNQTLSGLFSWKKNCNCSVNWDCKWGLDVPYKECGEDDWIHYGNDTCGWGASGHDGCNTSCETQAATQNDTSYLGICTQHCQLLRNASQSPWIDPANKAYLLGHGSSNCSNGCSVKSPYWIFTGNGSACRQYIGNKLIAVGLITLHAVECPTHKPKRHPRDASSYTEDECKEKSYWSPSGGLAGFLSIITLGVFSDIRQHMNIEALACAITKISNATIDALKGLSHELEGLEVYAQQNRLALDFLLLRQGGVCGVVGNDTCLLNVTHFDISKDIDKIQDSVSHFDHGSSLEWSWGHWWKWLSLIGGNLGLILAIILLICFLPALRGLCTK

SEQ ID NO: 16342 - protein, 626 aa, unidentified
MLDLIIELMRSVGVFRIRNLNRDPLGRPSRSMSLLLLFIIFMGSGTCIEILVNKEGATRQTMDFKADLKSAVIFPRWGIIMKPQRELVLSNGHILIPAILDLGHVTPVLGECGGPVYGNITRPFFEKTSRLVHRSEAVLKDLSKITTGIVEPHGARRSRRSIMAALAIGKTLASLVTGGWKIYNSFSRGRELNQMKVQMEEMMSRMNLNLNMLNDNTKKLKKELYFFEEEFEKQMFKLSYKVSTMHCGLQRVSTELQASRWVTKWEPIVDSLMVQPINNRQAGSLFTVDALSGLFHYLEERFGSLNPYSACPECTLATMTVSHVGGGYNTLALMIELPNLVQKESFIVMEPSYFPVFVGDNEPFMSQMERTVVVKDGKGFTLDTQNCDGERSTMICDIASVNLRELGPVKDWDLDSELVMRRIDLSREYWLAYPLYDSIIVFTAEEGTCRIRRLSGQYMTLPSGLQQLNGADGGNLECQSYSIAIPQGAHTTPLSIYGNPPSIRSPDGHEVELISSGILSGHRLTGLLNDDDTNVLYDLYMSDDKKQGSFIAVNQFFLGVVLVMVVFGVVWFMRNRSVIKTAWAGVKLYGIRAFGFLKPPKVVRAGTGNQKGLELVPMESVPLSVD

SEQ ID NO: 16343 - protein, 596 aa, unidentified
MGGAIAGVIFVSVWIISTTHSVEVLVGDKGKQRKTIDFKADIKSAVVFPRWGLLLKPQREMVLTNGHIVIPVTVELGHGAPDISSCGADVYNNITGVLFEKVARLNARSLEVMGELERIGTGSGLISEHPRTKRSLAIALMIGKTLASVVSGGWKIYNALSRGRELRELRDDLAAMDKRVSSRLSHQDSRIRALKKILFTWHGDYERTLSGFRLFAKNIACDLGKLEAEVQVGRWAERWDRVITSLMIQPLNNHLVGGLFQHDMLSGVFDHLDSTYGPSNPFSSCPECTLATMTVSHVGGTPTSMNLALELPNMVERQSYLVMEPSYYPVRVGDGVDFIGHMERTLVVKDGRGYSLDTTHCEGSRSMMTCDVSVVNMRSLGSVKEWNLDSEITMRSTPVDPQYWLSYPMYDSLLVYAAADGTCRVKRKTGQYMTLPQGLQQLSSSDGDFAECGGYTVHVPQGAQMTPLSVYGSPPVLRSLDYHEQVAVKAGALSGQLLQDVLDDDKTSEAYDMYMSDNRGQGRVIAANQAICLVLLLVVIGVVIWLLKNRKIIRDWWAGVGLFGLTLHGILRRRKNAQTSHQTANTAMGTELAPLN

SEQ ID NO: 16344 - protein, 619 aa, unidentified
MIKVDTDITEGENIPGIRVWTIGGMGLGVVFVLVLVFGTARPVEILVGNGEREAKTVDFKPDIKSGVVFPRWGLLLKPQREMVLSNGHILIPITVDLGDQTPEISACGVHVYSNITNAIFMKMVRLNQRSLDVMGELERIGTGNGFISDGPRSKRSLAVGLLIGKTLASIVHGGWKVYNALSKGRELRALREDLQHMGERTQSRLNSQDARMRALKKLLFVWHADYERALTGVRLFAQSIGCDLGKLEAEVQVGRWAEKWDRVITSLIIQPLNNHLVGSLFTLEMLSGVFLHLDKLYGPSNPFSACPECTLATMTVSHVGGTGTTMHLALELPNMVDRHSYLVMEPSYFPVTLGEGVRFSGTLERTLVVKDGKGFSLDTSQCEGTRSMMTCDVSVVNMRPLGPVKDWNLDSEMTMRSTPVDQQFWLAYPMYDSLLIYAAEDGTCRVRRKSGQFMTLPPGLQQLSPSDGDFAECGGYSVPIPQGAHMTPISVYGKPPPIRKLDYQELIAVQVGSLTGKALQEVLDEDKTSATYDMYMADDNGQGRMIIVNQVLVFCLILGALGCVVWCVKNRTLIRNWWAGVGIFGVTLHGVLRREKRSKELQRAPGAGSEMVSLNRQNQ

SEQ ID NO: 16345 - protein, 609 aa, unidentified; identical to SEQ ID NO: 15523

SEQ ID NO: 16346 - protein, 575 aa, unidentified; identical to SEQ ID NO: 15410

SEQ ID NO: 16347 - protein, 583 aa, unidentified; identical to SEQ ID NO: 15403

SEQ ID NO: 16348 - protein, 580 aa, unidentified
MEGSRTVIYQGDPNEKNTWRLVFRTLTLILNLAILSVTIASIIITSKITLSEVTTLKTEGVEEVITPLMATLSDSVQQEKMIYKEVAISIPLVLDKIQTDVGTSVAQITDALRQIQGVNGTQAFALSNAPEYSGGIEVPLFQIDSFVNKSMSISGLLEHASFIPSPTTLHGCTRIPSFHLGPRHWCYTHNIIGSRCRDEGFSSMYISIGAITVNRDGNPLFITTASTILADDNNRKSCSIIASSYGCDLLCSIVTESENDDYANPNPTKMVHGRFLYNGSYVEQALPNSLFQDKWVAQYPGVGSGITTHGKVLFPIYGGIKKNTQLFYELSKYGFFAHNKELECKNMTEEQIRDIKAAYLPSKTSGNLFAQGIIYCNISKLGDCNVAVLNTSTTMMGAEGRLQMMGEYVYYYQRSSSWWPVGIVYKKSLAELMNGINMEVLSFEPIPLSKFPRPTWTAGLCQKPSICPDVCVTGVYTDLFSVTIGSTTDKDTYFGVYLDSATERKDPWVAAADQYEWRNRVRLFESTTEAAYTTSTCFKNTVNNRVFCVSIVELRENLLGDWKIVPLLFQIGVSQGPPPK

SEQ ID NO: 16349 - protein, 579 aa, unidentified; identical to SEQ ID NO: 15269

SEQ ID NO: 16350 - protein, 574 aa, unidentified; identical to SEQ ID NO: 15216

SEQ ID NO: 16351 - protein, 574 aa, unidentified; identical to SEQ ID NO: 15417

SEQ ID NO: 16352 - protein, 613 aa, unidentified; identical to SEQ ID NO: 8307

SEQ ID NO: 16353 - protein, 569 aa, unidentified; identical to SEQ ID NO: 15408

SEQ ID NO: 16354 - protein, 577 aa, unidentified; identical to SEQ ID NO: 15249

SEQ ID NO: 16355 - protein, 571 aa, unidentified
MDSHIPAKNTWRTVYRVVTILLDIVIIVLAIISLVSLGLKPGEKILTGVNDSVHAELGMMRPALLDIDSKVSTIYRYNLINLPLQLDDIQTAIVSSSRQLADTINSFLAINGSSAVLYPTSPEFSNGFNKELYPNFNQTRDSISIGQLVEFTNFIPTPTTKPGCIRIPTFAAGQSHWCYSHNIIASGCQDHSTSSQYIAMGVIIINQQQSPDFRTTTSITLSDNKNRKSCSVGVSEYGCDLLCSVVTETENEDYKSEPPTDMIYGRLFFNGTYSEVDLPVSTLFSEWVANYPGVGSGVVYRRKMYFPIYGGIKISSNLGNYLSHFYYIPQVPTVNCTDSDEIQITNAKASYSPPKVAPNLWGQALLACNVSVNLPSSCRLLVFNTSSMMMGAEGRIYNINEQYYFYQRSSSYWPVGLIYRLEMTSLDSMTDSGIINTTPIPFEKFPRPASQAGVCSIPSVCPRVCQTGVYQDIWVLSQPSVEMNTTAIGIYLNSAVGRTNPKIGVANTLSWIDAVQLFQPTTPASYSTTTCFKNTARDISYCLSILELSDSLLGSWRIAPLLYNLTLVPNS

SEQ ID NO: 16356 - protein, 577 aa, unidentified; identical to SEQ ID NO: 9016

SEQ ID NO: 16357 - protein, 571 aa, unidentified
MDHAVSRIALENEEREAKSTWRLVFRIAVLLLTVVTLAISVAALVYSMGASTPRDLVGVSTMVSKVEDKITSSISSNQDVVDRIYKQVALESPLALLNTESIIMSAITSLSHQINGAANNSRCGAPIHDPDYIGGIGKELIVDDINGVTSFYPSAYQEHLNFIPAPTTGSGCIRIPSFDMSATHYCYTHNVILSGCIDHSHSHQYLALGVLRTSATGRVFFSTLRSINLDDNQNRKSCSVSATPLGCDILCSKVTEAEEEDYKSVAPTSMVHGRLGFDGQYHEKDLDTTVLFKDWVANYPGVGSGSFIDGRVWFPVYGGLKPNSPSDTAQEGKYVIYKRYNNTCPDGQEYQIRMAKFSYKPGRFSGKRVQQAILSIKVSTSLGEDPVLTVPPNTITLMGAEGRVLTVGTSHFLYQRGSSYFSPALLYPMTVHNKTATLHHPYTFNAFTRPGSVPCQASARCPNPCITGVYTDPYPLVFYRNHTLRGVFGTMLDDEQTRLNPVSAVFDNISRSRVTRVSSSSTKAAYTTSTCFKVVKTNKVYCLSIAEISNTLFGEFRIVPLLVEILKDERA

SEQ ID NO: 16358 - protein, 614 aa, unidentified; identical to SEQ ID NO: 15418

SEQ ID NO: 16359 - protein, 610 aa, unidentified; identical to SEQ ID NO: 15351

SEQ ID NO: 16360 - protein, 618 aa, unidentified; identical to SEQ ID NO: 15243

SEQ ID NO: 16361 - protein, 599 aa, unidentified; identical to SEQ ID NO: 15244

SEQ ID NO: 16362 - protein, 591 aa, unidentified; identical to SEQ ID NO: 15245

SEQ ID NO: 16363 - protein, 587 aa, unidentified; identical to SEQ ID NO: 15246

SEQ ID NO: 16364 - protein, 620 aa, unidentified
MEHGLSAASLANDRAEAKNTWRAVFRIVSLLLTTACVAVSIAALVYSIGAATPEDLEFISPLFDSHNRDVTTALGTIADVDNKIYRQVALEHPVSLLNTESTIMSALTSLSYQINNAANASGCGAPIHDKDYIGGVAKEIYTWDEHNATKYYPSKFLEHLNFIPAPTTGNGCTRIPSFDASATHYCYTHNVILNGCKDYAHSYQYIALGVFKISPTGNVFLSTLRSINLDDNENRKSCSITATPLGCDLLCAKVTEREEDDYASPEPTQLVHGRMGFDGVYHEEALPVATLFRDWAANYPTVGGGGVFDNRVWFGIYGGVRQDTPTEESQRGKFAIYRRVNNTCPDGNTTQVTRARDAYRPTRFGRKLVQQAILSIPVGPELARAPKLSVLDNNVMLMGAEARVMVFGHQALLYQRGSSYFPSALLYPLTLTNGTASAGSPYIFDKFTRPGSPPCHAPARCPNSCVTGVYTDAYPLFWDRNHRVTGVYGMMLDDDTARLNPTAAVFDWTKRGPVMRVSNSNTKAAYSTSTCFRVVKTNRVYCLSIVEVGNTLFGEFRITPLLTEILPEAPSSSARSEVAIPREDTESTGWTDITIDSPFCDLINGTAAREEVEAYAASWP

SEQ ID NO: 16365 - protein, 579 aa, unidentified; identical to SEQ ID NO: 15397

SEQ ID NO: 16366 - protein, 616 aa, unidentified
MEHGLSQVALHNEEEEAKNTWRAFYRILMITLCLIITGLSASAVAYAMRAAQPMDISLSLEGTRQGLAEVKSLASGIQDVTDRIYKQTALETPLAILNTESTIMSALTSLSYQINNAANTSGCGAPVHDPDYVGGIGKELIVDNQLNVTDYHPSRFLEHLNFIPAPTTGSGCTRIPSFDMSATHYCYTHNVILSGCLDHSHSYQYLALGVLRVSATGRVFFSTLRSINLDDTANRKSCSVSATPLGCDMLCSKVTESESDDYNSNEPTAMIHGRFGFDGKYHEVDLNVHGLFSDWVANYAGVGGGTFAEGRVWFSVYGGLKKGSRLESQQQSQYVIYKRANDTCQDGEDHQIKQAKASYKPDRFGNRLIQQAILSIEVAPALGSNPLLSVTSNNITLMGAEGRVMTIGGKSYLYQRGSSYYSPAILYPLALNNGSATTLTPLTFDSFTRPGSPPCQATARCPNPCVTGVYTDVYPLIYSSNHTIRGVYGMMLEDNTARLDPVAAVFDREKRSRVTRVSSSKTKAAYTTSTCFRLVKTDRVYCLSIAEIANTLFGEFRIVPLLVEIKKPGEGTTRATTDSMEGDSEWSDEVMAPRFCQPRNLSAYRVQQEEYAFSWP

SEQ ID NO: 16367 - protein, 577 aa, unidentified
MEPTGSKVDIVPSQGTKRTCRTFYRLLILILNLIIIILTIISIYVSISTDQHKLCNNEADSLLHSIVEPITVPLGTDSDVEDELREIRRDTGINIPIQIDNTENIILTTLASINSNIARLHNATDESPTCLSPVNDPRFIAGINKITKGSMIYRNFSNLIEHVNFIPSPTTLSGCTRIPSFSLSKTHWCYSHNVISTGCQDHAASSQYISIGIVDTGLNNEPYLRTMSSRLLNDGLNRKSCSVTAGAGVCWLLCSVVTESESADYRSRAPTAMILGRFNFYGDYTESPVPASLFSGRFTANYPGVGSGTQLNGTLYFPIYGGVVNDSDIELSNRGKSFRPRNPTNPCPDPEVTQSQRAQASYYPTRFGRLLIQQAILACRISDTTCTDYYLLYFDNNQVMMGAEARIYYLNNQMYLYQRSSSWWPHPLFYRFSLPHCEPMSVCMITDTHLILTYATSRPGTSICTGASRCPNNCVDGVYTDVWPLTEGTTQDPDSYYTVFLNSPNRRISPTISIYSYNQKISSRLAVGSEIGAAYTTSTCFSRTDTGALYCITIIEAVNTIFGQYRIVPILVQLISD

SEQ ID NO: 16368 - protein, 569 aa, unidentified; identical to SEQ ID NO: 15443

SEQ ID NO: 16369 - protein, 567 aa, unidentified
MEHGLSAASLANDRAEAKNTWRAVFRTVSLLLTAACVAISIAALVYSIGAATPEDLEFIPPLFDSHNRDVTTALGSIIDVDNKIYRQVALEHPVSLLNTVSTIMSALTSLSYQINNAANASGCGAPIHDKDYIGGVAKEIYTWDEHNATKYYPSKFLEHLNFIPAPTTGNGCTRIPSFDASTTHYCYTHNVILNGCKDYAHSYQYIALGVFKISPTGNVFLSTLRSINLDDNENRKSCSITATPLGCDLLCAKVTEREEDDYASPEPTQLVHGRMGFDGVYHEESLPVTTLFRDWAANYPTVGGGGVFDNRVWFGIYGGVRQDTPTEESQRGKFAIYRRVNNTCPDDNTTQVARARDAYRPTRFGRKLVQQAILSIPIGPELARASKLSVLDNNVMLMGAEARIMVFGHQALLYQRGSSYFPSALLYPLTLTNGTASAGSPYIFDKFTRPGSPPCHAPARCPNSCVTGVYTDAYPLFWDRNHRVTGVYGMMLDDDTARLNPTAAIFDWTKRSPVMRVSNSNTKAAYSTSTCFRVVKTNRVYCLSIVEVGNTLFGEFRITPLLTEILP

SEQ ID NO: 16370 - protein, 571 aa, unidentified; identical to SEQ ID NO: 8536

SEQ ID NO: 16371 - protein, 513 aa, unidentified
MFKFTLVLVVCLSLVSGDFLRNGVLPIRRGEVRAEVRVGEIMIYEPYSALIPSGDTCLLQILAEVNAQADKIFPSINFPNTTGSNNKFIGLVLAGAAMGVASGALATGIAATIMATSNKKHISENRNAINTLRDENIALKAGLDLASSALDEVSMVIGSIQGYINNDLIPVMANMSCEIKKNTFRTRLLAYWLSLVSKYQNLIANPWSEEPSFSEEQRIKNDASIAALVTSKYGIPATEFKGPDIRIRISLIESKDRILLLMASIYRTQLTGRNLVHLPRIPLSDTNGGSVISNWPNYVVCEGTSTSDCYTLSETCTIENESAFCTIIDVDSPINLTCDEDCGYVSSPTSLAFMGDGEGGAIVNCALISCRCDGRNFIGMQHFLEGSCSVLLLKGTIALRLRELGEIIKDPVVINSSSGHLPPAINLQNNISDLAKEMKVVTKDVGDWGALGGLSATPYPFTIWLVILTVMLLSLIVFVIVLMVKMRRELKRLNSANTSSNFHLSMISESSDN

SEQ ID NO: 16372 - protein, 621 aa, unidentified; identical to SEQ ID NO: 8970

SEQ ID NO: 16373 - protein, 578 aa, unidentified
MPRNTLPRVQSDIAEFYGSSSPIYDTPPIDPHLDNSKNSGYWINTVLLVGCIVLALCGLGIGIASQSSNDLIAKDMISTKSKLDKLTADTGETLALVRQEISPKVSLLQGAILATLPAQINGDTSMVVDTIKGHCKAPIPVAPQPGLPPVKHGDNISPLNPVHYWKCESGTPKLYRSPNVTFIPGPSPLPTTSTPGGCVRIPTFHVGDKLYSYSSNLISSGCRDIGKSYQNIQVGIIVRSQEGIPELNPLLSHTFPIIENRKSCSVVSADKGAYLFCSQPKVSEPDDYKSPGIEPMSLDYVDLNGTVRSWIYTPAEIITDYPYAALYPGVGSGVVMNGKLLFIVYGGLLNGIQVPAYCVSPECPTPNQAKCDSSQYNGYLGGRQVVSGIATVDLTSPGKPMITVETISPDKNWFGAEGRLIVTGGRVYIYLRSTGWHGLLQTGIITSFGPISINWVTNTAVSRPGNPGCSWENRCPKGCLTGVYSDAYPLSPDYTTVATMILHDSTTRKSPVMVYATPSEMVNYASLNGPGQGAAYSTTTCVTVDDEGYCLTAVELSPGLISSMQPVLVATRIPKSCV

SEQ ID NO: 16374 - protein, 564 aa, unidentified; identical to SEQ ID NO: 15531

SEQ ID NO: 16375 - protein, 564 aa, unidentified; identical to SEQ ID NO: 8949

SEQ ID NO: 16376 - protein, 622 aa, unidentified
MLSQLQKNYLDNSNQQGDKMNNPDKKLSVNFNPLELDKGQKDLNKSYYVKNKNYNVSNLLNESLHDIKFCIYCIFSLLIIITIINIITISIVITRLKVHEENNGMESPNLQSIQDSLSSLTNMINTEITPRIGILVTATSVTLSSSINYVGTKTNQLVNELKDYITKSCGFKVPELKLHECNISCADPKISKSAMYSTNAYAELAGPPKIFCKSVSKDPDFRLKQIDYVIPVQQDRSICMNNPLLDISDGFFTYIHYEGINSCKKSDSFKVLLSHGEIVDRGDYRPSLYLLSSHYHPYSMQVINCVPVTCNQSSFVFCHISNNTKTLDNSDYSSDEYYITYFNGIDRPKTKKIPINNMTADNRYIHFTFSGGGGVCLGEEFIIPVTTVINTDVFTHDYCESFNCSVQTGKSLKEICSESLRSPTNSSRYNLNGIMIISQNNMTDFKIQLNGITYNKLSFGSPGRLSKTLGQVLYYQSSMSWDTYLKAGFVEKWKPFTPNWMNNTVISRPNQGNCPRYHKCPEICYGGTYNDIAPLDLGKDMYVSVILDSDQLAENPEITVFNSTTILYKERVSKDELNTRSTTTSCFLFLDEPWCISVLETNRFNGKSIRPEIYSYKIPKYC

SEQ ID NO: 16377 - protein, 632 aa, unidentified; identical to SEQ ID NO: 15421

SEQ ID NO: 16378 - protein, 604 aa, unidentified; identical to SEQ ID NO: 15565

SEQ ID NO: 16379 - protein, 625 aa, unidentified
MATNRDNTITSAEVSQEDKVKKYYGVETAEKVADSISGNKVFILMNTLLILTGAIITITLNITNLTAAKSQQNMLKIIQDDVNAKLEMFVNLDQLVKGEIKPKVSLINTAVSVSIPGQISNLQTKFLQKYVYLEESITKQCTCNPLSGIFPTSGPTYPPTDKPDDDTTDDDKVDTTIKPIEYPKPDGCNRTGDHFTMEPGANFYTVPNLGPASSNSDECYTNPSFSIGSSIYMFSQEIRKTDCTAGEILSIQIVLGRIVDKGQQGPQASPLLVWAVPNPKIINSCAVAAGDEMGWVLCSVTLTAASGEPIPHMFDGFWLYKLEPDTEVVSYRITGYAYLLDKQYDSVFIGKGGGIQKGNDLYFQMYGLSRNRQSFKALCEHGSCLGTGGGGYQVLCDRAVMSFGSEESLITNAYLKVNDLASGKPVIIGQTFPPSDSYKGSNGRMYTIGDKYGLYLAPSSWNRYLRFGITPDISVRSTTWLKSQDPIMKILSTCTNTDRDMCPEICNTRGYQDIFPLSEDSEYYTYIGITPNNGGTKNFVAVRDSDGHIASIDILQNYYSITSATISCFMYKDEIWCIAITEGKKQKDNPQRIYAHSYKIRQMCYNMKSATVTVGNAKNITIRRY

SEQ ID NO: 16380 - protein, 602 aa, unidentified; identical to SEQ ID NO: 15550

SEQ ID NO: 16381 - protein, 688 aa, unidentified
MSQKKSLIIKGHDYSPKDKNQSSKYYNSYESDQDTINPNEFKCMLTLIFLVLLLTIASVIVLGICNVVKLDHESKQISINTMSINKAIGKINELYSLINNELKIRMMVMDTAVNVDIPADISALSMKLTSAITSIEELIQSQTSSVPSNRPSMNQSGGSSGSSQLSNSSRPIPDQGNPNYCNYDKPNRPSMSFTSLNIITPTESAYTEGCHTETVLTSEQFQLVPLNQLLAGDYGEDYCSRYPSLSLRGRRFTYTEERYRGSCSTRTKEAQIIVYGYITDFGYRHPTLMILDTFNPPNYDMIYRCTSVTKLSTGLVICLYTNMTEFELYESPKNTDLIIFEAFDGSQHKGTILNSSKFIYLNDIDMFIPGTGGGIYLNKTIYLPGIVFTTNPPDGNAGCPNSACTNKDPKLCRKGLKYIFNNSYYMVNGFALISQKGRKEYEVTVTMIETDVYHFGSRSRVQYFNSRAKYYQAPNGWFSYPIYGNIYFEKNQKITFDEANYTVYERYTEGSCPINSSCPAFCHSSGYNDIWANDIDSNITFGIYNSDSHSYGRPVFFMANQSGIMYEFVIPGSIIAAGQSTTSCLLFYQEVWCMNVIEIRKTLNSSQEIYGFWTKTPLVCPTKDQYDIAHAFPLPTPSPAPAPSQSVPVTEASTITLIQSVEPQGTPTDIPSTTNRDDIQTITNATSG

SEQ ID NO: 16382 - protein, 635 aa, unidentified
  VARIANT 149: note = Any amino acid
  VARIANT 154: note = Any amino acid
MAPKIDTTKTTATSDSRRYYGVESVEKFADGVTNNKIFILANMLLIIMSSIVMISLNITNLENLNNQKTSLKILNEDVTNKLEQIDTLDQIVKGEIKPKLTLVNSAVSVTIPSQISNLATKLNNQIKTLEMTVNKQCSGNLLGGLLTPXPPGTXDSTNPDDSNNDDSVDDLEGDMRPLNLAELNDCSKYPQSPQPTFAIGPDIHPMPELTEPIQLKNHCAVFPTVALGESIYVYSHQIRKTPCRSEDATHQRVSLGRIADRGFSGPRASPLSTWDLQETNYLSSCSVAASGETGWVLCVTTDKFTRYTVYSGPYTGLKLYKLNVRGQKEEYSIAVSDIKADANIIALSLTRGSGVPKNNKLIFLGIAAVRDVDTTGVLCPEWKCDNIDNNVISCIHSYRVTSDDNNYLMNVVVTVDVAPTGKMTATISLIPMSESYIGSEGGVIDKPGGYGLMISNKGWFARIRYGQTERTIPQRYDWTDYMSLETPYYLYCNGGRICPGSCKTWNFTVPTILNPSGSIIIGVTAKSSEPQTASMITINTPNDLIDQYEIFSDYKSIGSTITKCFLYKRQPWCLVLIEGIPKSTGLTETSIQTFRIYKSCVKSRTYLDSSGNRFYYAIGDNGNKTKVMYKPISES

SEQ ID NO: 16383 - protein, 624 aa, unidentified
MATNKKDVIKTTESTREDKVKKFYGVETAEKVADSISSNKVFILMNTLLILTGAIITITLNVTNLTTIKNQQAMLKIIQDEVNSKLEMFVSLDQLVKGEIKPKVSLINTAVSVSIPGQISNLQTKFLQKYVYLEESITKQCTCNPLSGIFPTTKPPPPPTDKPDDDTTDDDKVDTTIKPVEYYKPDGCNKTNDHFTMQPGVNFYTVPNLGPSSSSADECYTNPSFSIGSSIYMFSQEIRKTDCTTGEILSIQIVLGRIVDKGQQGPQASPLLVWSVPNPKIINSCAVAAGDETGWVLCSVTLTAASGEPIPHMFDGFWLYKFEPDTEVVAYRITGFAYLLDKVYDSVFIGKGGGIQRGNDLYFQMFGLSRNRQSIKALCEHGSCLGTGGGGYQVLCDRAVMSFGSEESLISNAYLKVNDVASGKPTIISQTFPPSDSYKGSNGRIYTIGERYGIYLAPSSWNRYLRFGLTPDISVRSTTWLKEKDPIMKVLTTCTNTDKDMCPEICNTRGYQDIFPLSEDSSFYTYIGITPSNEGTKSFVAVKDDAGHVASITILPNYYSITSATISCFMYKEEIWCIAVTEGRKQKENPQRIYAHSYRVQKMCFNIKPASVVTSLPSNVTIRS

SEQ ID NO: 16384 - protein, 734 aa, unidentified; identical to SEQ ID NO: 15502

SEQ ID NO: 16385 - protein, 1605 aa, unidentified; identical to SEQ ID NO: 8826

SEQ ID NO: 16386 - protein, 597 aa, unidentified
MSTIKNGYFGTPQPSKEPPPTPYNTNCDWFAWVGLILGMLSALIIIILNVTTLVRTFQPNNDLNDLIKHTREIGTSINALNLQFQQDLAPRLSVLTTGVSYSLPSQVSSSTNVILSEIQKTCIPKFETNSTECPVVQNPTNSQGYGLIDRSAIATCIRNGGSVKVESTMTLTDYPSFIPGSTKPGGCIRIPTFSLGAQVYSYSHNVIENGCRDHASSIQYWSIGRVTKFPTGKPFFENTEHWFMNDGLNRKSCTTATSFSGAWLGCTIVTEPEREDYLTEGIARLSLAYQDIYGNRKEWFFSPSQIPVDREYMALYFAVGSGVVVKNKVYLLMYGGLKEPYPGDVYCPNIGCDHLSQEECNQASKPALYGGIQLVNAILSFDDLADRRPTLKFQTIPPSVSWMGAEGRLMYEPSVDKLILYLRSTSWNPFIQLGYLEITDPITIVWTPYNTTGRPGTGYCGVGSRCPKDCVTGVYTDAFPLISDLSLSITTILNHQTERMNPVIVSTTSTEITGQYQLGTNSQGAAYTTTTCFAFYNDIWCVSIVEMTPAAVGEYLPVPFVYKLTIDCPHNSVWSVVRRVGREQIKNVATMFTNVLT

SEQ ID NO: 16387 - protein, 597 aa, unidentified
MENNYFGDIGSSNNDQKSKNSDRCAKIFIGISSTVGLLSILVIIALNVTNLAAILSNKNKGTNDLDTLNQVYSITSEIKDSFISSIIPRVTLINTGTSYLIPALIKESTRSIQYDIYKYCTYQNVAPDQTCPDPAPIGHSSLFSLYDPNLLLNCASKAAVQPQGMTPVVFDSFIPSVTTLKGCTRIPTFALGTFIYSYSHNQIGKGCGDSHTSNQDWVIGSIIEGYNNTPTFKIWQRWYLNDELNRKSCSTAVSGKGAWLLCSIVTMTEAQDYRTPGIMDIFLGYQDAYGRRKSWVYTQSQLNIDYVYAALYPSVGSGVSIGSTVYFLVYGGLETPINGNAYCPRQMCNDQTKNQQVCNKAQQPNWLGGKQMLNAILSFEDQIESQPNITIRTIPVSSQIFGSEGRLYSTPYSQKNYIYVRSTSWYPLMQFGEINLSTDLSIKWANYTSLSRPGAGVCKSTNRCPAECVTGVYTDLFPLSIQDGLAMTVELVGDTQRRGPTMKLVTVNNKVEQYILTTTTQSAAYTTTTCFIFNFQPWCISIVEMSPATIGSMMPTAFLYPIWSSCKGNPFDLPYISAPKPRSDVFGNTNLNPDTNQ

SEQ ID NO: 16388 - protein, 784 aa, unidentified
MDNSTNYYGTSTQKNDNSKQPISTISPHLGNTNSIKSRLIPQDITSILCSWFWGPMVTIILIVLISITLKILMDHETAQQSYSTLITAIRSEIISTKDLVFENISPKINLVNTMVSYTIPSLLNSLRGEILDELLRKQTPIFEYKNHTCPVVQHPAHSSFFKELDQDTITRCIDRGMQISLKGEFNLQEVPSFIPSQTTSRGCTRIPSFSLSPYIWAYTHNVVRLGCSDSGMSDQYLAIGVISEGGGKAPIFETLATWYTDDEINRKSCSVAAGITGAWMGCSIVTETEQNDVGNPGISSIFISYLDIYREKRSWIYTETQLPINGLFTYLTFAVGSGVVVGDKVYLPMYGSLTNDNNYDCFCYSPGCDTFNITKCNEGCRPTWLSNKLFVTVIMIFSNDPTVRPIPTFVILNPKSGWMGAETRLIHNYRHGITYIYTRSSTWHALPQIGRINLKDFSQVLWITYLGIGRPSLDPCPATQRCPRDCIGGVFSDIFPLGRYYEFGVTVYLDSDRNRERPTIALLNVARTIKKTLLTTATQRAAYSTTTCFIFKDEPWCLTVVELNPSAIGEYIPIPFTYTLPLICTSLSDTEGSVMTNNGGDIKVTIPSSSDVRGQTVTLRDLKLNWSNYKTKLPHVFYPQDYSSSGNDIFENDVMINPSAIITATQSTLRRADNPDSGIPGIQSESLVSQSRVQRNSDDAVYITPKPLTTPDQSISNTEDLSINNLTSTSQQINSDETVIKSKSLTISSTNDSIIQTSEVSVDTTVDRSNIKVMVNGTEGSGTS

SEQ ID NO: 16389 - protein, 854 aa, unidentified
MADYYKTGGIITPVKKPTEEERNHKSNVLAYTSLILGILSVIVLILLNITNITMTIKKDSINGALNSKPIMTETQGNKISDLIESDLIPKTNLINNMVSYQIPTSLTQIYSLIKRDVLQACTPKFDHEGSQCPVNSNPFHSGSFSLINRNTFSRCPDPNNNLGMRESIKLMDYPSFIPGPTRPGGCSRDPSFDLGNKIFAYTHNVVPQGCGYTEMTMQYFNIGRVTDVNADMPFFEILTQWYLDDGLNRKSCTVVTSDEGAWILCIVTSESEEKDYADQGIGRVFIGYMDIYGRKKSWYLDEPEIQFDLPMAAMYFSGGSGVSDEGKIYVLIYGGLMTAVSGDVFCDAPGCDNPSQDMCKKASMPKSRSQRQMVNGLFIFDDNPLEAPKPIVKLIPPSQNWVGSRGRLYKSDYPKIFFLYISSDSWHSLPKIGIIAVGDQTYLHWVENVAVSRPGPENCMYGNRCPQECLGAPYTDIFPLDSNFEIGISVTLKSYQVNKNPVITLVTQNKIISETEVTNDHHGAQYTTTSCFKYARSLWCLSIVAFEPATVGERAPVPLLYKVPVYCKASGTRLTIPIPYFSNGSRPIVVLTNELYPPEVPKFQTQDDFNKLQLSPYHFERPGTTGPPSTTSKLQTTRSLHVDTSTQVIKQVTPTTLSEPTTREQTPTTANTLSTKEMLTTVKTIDENTTRITAQHHDTTQRSTITTLNKTAQTTEGTGQHQITTHNITRRDTTPNTDGHSISTARQPNIQSHTAKDENTPDIYNNVRRIGIQRETKTSRSRDRRPKKQKLDDYASKDQHNTFEDQGLWDKISSYLLPIQSDYYGIEDPELDSIDLFDYRHVTSSSHNRVMIYQ

SEQ ID NO: 16390 - protein, 810 aa, unidentified
MIMNPINTQMTNYYGVGGNKDREAIQTSSTNSTCHSALTYTSMIVGLLSLFTLIALNVTNITYLIGSGGSMNAIKEKQESLGALVRDSVSLTTEEIKPKVDLINNIVSYSIPSQLTQIQHTIKNEVLRQCGPSFVYNNTVCPVVENPSHSQHFKMINPYTISECANTGSFIQVKSHISFIDYPSFIPGSTRKGGCVRIPSFSLSDTIFAYAHNIIAQGCQDSSQSDQYLSIGRIEDHGTDIPVIETIAEWYLNDGLNRKSCSVASGDTYAIMGCTIVTSDERTDYLNPGIGRLSITYLDVFGRKKEWIFTQEEIELDREYLALYFSVGSGVIIDDEIYFLVYGDLAEPMPGNVFCHAPGCAAVNQDVCNAATKPNWFGRHQIVNGILSFTADFESRPRLRVRTIPPSKTWLGAEGRLMYSTVARKTYIYVRSTGWHALAQTGIIDLTGDLSIQWVDQLVLSRPGTSGCPAANRCPKECVTGVYTDAFPLGVNYDVSVSVVLATQSTRSNPRLMVVNGTNIIYVKTVTSASQKASYTTTTCFVFKMRIWCLSIIELSPGAVGEFVPVPFLYQLNLGCVDKDTGVTEQLSSYSGKDTYTLTPYETPKTECYLELSGDDMYFAVKVFGNHQSYRLTWKAQAKTTEDIATVSQLCHEVLKYMTDRGDVFNNNTVVDTEHVTLTPVTLSAGTRVTLTKTDSTPVANETTSMSTAIKATLDRTTRSVTTRLTESTAFNHTSSVLNQITVTPTSSTTEANHTSTPITRVSQHETSSVVTHGQLNNTLNATGSWRLRYSNLFERGYSEMMKWWGNNGD

SEQ ID NO: 16391 - protein, 1589 aa, unidentified
MNPLAVHTAAMSNFYGVNATQTTDARKENHIGGQDVFRYTSMIVGLLSLFTIIALNVTNIIYLTESGGTMESIKNSQQSLSGSMKETTGILIEDLKPKTDLINSMVGYNIPTQLSLIYSTIKNDVLKQCTPTFMFNNTICPVAEHPIHSSYFEEINLSSFAACALPNGRVVMNSEVTYTEYPSFIPGSTSPGSCVRLPSFSLSPTIFAYSHTIMGHGCSELDVGDHYFSLGRIADHGHENPVFETITEWFINDKVNRRSCTVAAGQYEGWMGCVIMTETFLDDLSSRDTGRVSITYLDVYGRKREWIYTRSEIRFDQNYASLYFSVGSGVVIGDNVHFLIWGNLYFPIEEPAFCTAPQCRTFNQQQCNQAQRPEAFGGHQMVNGILSFKTTTRGKPVLSVRTFSPKLIPLGTEGRLIHFQNINRTYIYLRSTGWHALPLTGRIIFTVPLNIEWIQQTAVSRPGRSPCGASSRCPQQCVTGVYTDLFPMGPNYEYSMTAFLDSETDRVNPTLAFINTGSIIYRKTLTQSNQKAGYTTTTCFIFKLRIWCLSIVELSPSTITEFEPVPFLYQLDVGCRMSPSGQIMPLSYGERSLSIGPYKPARKECYLEQVGDQYYLIISIPNSIQAYTIRDLDPEKIPHTGLYINDICPVLLNVYTTMSATARMMTAIMVGQWQFRPVNRPGGTRVNLPNKLANATRNEMYSPEDPGHSYYVDRLIDQYNYQTLPEGALVEICLKLNRGNNLTIIQDIQCRVYKYSRVKSNWSIGPTSSPTGITMRDMITQLNKFSTAFSPPLQCNHSFPCPCPCNCSSTIGTTKEPLTRLQHNNSTHTRTAGLNTSHNRLLSTTIKSAHVTNSSKRRDQDSATHSHTSPETPASQTEKHHTATHPHTPPTKDQTGATGHPAANETSHHPTPRTTTNPDIHHTTPPPGNPQPGNTAPHPEAATKAPTTTPQPRTNHTADAAPQADPPQKLNPTEQPIKTPTPTTTPTAPTTYPNRTTEPNPENNDTPIHPHNDPTRDTTTSPANHNTLDPHGDPEAEGTTTSETTSRSKPAGDTKETEHETLDSPKDPHVDTTTSATTTDEGVDKTSTNTTQHAHPTPKQRSQTTDNTTRPDSPQQDTSTQTDTPRDQPNSPGADPGQPPPTDPPEEQREGGQPDNKKQEETSSNNTKPEDAKITPDKAESRETSKPNSSIPTKEEERPNSQPLLRGGESQTLRLSNIEDLHIDDTSPSHTSHSEVQPTPKPPSEENPSFELIDVSHNNPKPDESLTKPCYQIDRHCTDNYLSTIGPLIDCYNKTEEVLCRLQTQTIDYMEKNCPGGYLNTSMASILGVAYSEYGDCRRGESLKPGHNYICMINGTSYLADREFICRKPSYKVMTNLTTTKLFHSSQSPFDTVGHLIGKYPFSYQEFIEWAGHYYPRPTEYMCGLGEFCGYTFVFFLSPDFNAYFEPTIYYKSIEKLNRSPIQIYNLCGRVFEVADQLTEPYHNVIVTPLKNKVLILRSLSYNDFADLGGNKTSCDTILQRRAYFSVETSVAKEARKNKGKLEAVTKSPNEKITRMKRATNPSYGATPSYDTFGDLILSALESLWYKRR

SEQ ID NO: 16392 - protein, 604 aa, unidentified; identical to SEQ ID NO: 15369

SEQ ID NO: 16393 - protein, 604 aa, unidentified; identical to SEQ ID NO: 15528

SEQ ID NO: 16394 - protein, 595 aa, unidentified
MESNNIKYYKDSSRYFGKILDEHKTINSQLYSLSIKVITIIAIIVSLIATIITIINATSGRTTLNSNTDILLSQRDEIHNIQEMIFDRIYPLINAMSTELGLHIPTLLDELTKAIDQKIKIMHPPVDTVTSDLNWCIKPPNGIIIDPKSYCESMELSKTYELLLDQLDVSRKKSLIINRKNINQCQLVDNSKIIFATVNIQSTPRFLNFGHTVSNQRITFGQGTYSSTYVITIQEDGVTDVQYRVFEIGYISDQFGVFPSLIVSRVLPIRMLLGMESCTLTSDRLGGYFLCMNTLTRSIYDYVSIRDLKSLYITIPHYGKVNYTYFNFGKIRSPHEIDKIWLTSDRGQIISGYFAAFVTITIRNYNNYPYKCLNNPCFDNSENYCRGWYKNITGTDDVPILAYLLVEMYDEEGPLITLVAIPPYNYTAPSHNSLYYDDKINKLIMTTSHIGYIQINEVHEVIVGDNLKAILLNRLSDEHPNLTACRLNQGIKEQYKSDGTIISNSALIDIQERMYITVKAIPPAGNYNFTVELHSRSNTSYVSLPKQFNAKYDKLHLECFSWDKSWWCALIPQFSLSWNESLSVDTAIFNLISCK

SEQ ID NO: 16395 - protein, 617 aa, unidentified; identical to SEQ ID NO: 8170

SEQ ID NO: 16396 - protein, 609 aa, unidentified; identical to SEQ ID NO: 8763

SEQ ID NO: 16397 - protein, 632 aa, unidentified; identical to SEQ ID NO: 15527

SEQ ID NO: 16398 - protein, 625 aa, unidentified; identical to SEQ ID NO: 15148

SEQ ID NO: 16399 - protein, 657 aa, unidentified; identical to SEQ ID NO: 15453

SEQ ID NO: 16400 - protein, 665 aa, unidentified; identical to SEQ ID NO: 15553

SEQ ID NO: 16401 - protein, 572 aa, unidentified; identical to SEQ ID NO: 15556

SEQ ID NO: 16402 - protein, 574 aa, unidentified
MEYWGHTNNPDKINRKVGVDQVRDRSKTLKIITFIISMMTSIMSTVALILILIMFIQNNNNNRIILQELRDETDAIEARIQKASNDIGVSIQSGINTRLLTIQNHVQNYIPLALTQQVSSLRESINDVITKREETQSKMPIQRMTHDDGIEPLIPDNFWKCPSGIPTISASPKIRLIPGPGLLATSTTINGCIRLPSLVINNLIYAYTSNLITQGCQDIGKSYQVLQIGIITINSDLVPDLNPRITHTFDIDDNRKSCSLALRNADVYQLCSTPKVDERSDYSSIGIEDIVLDIVTSEGTVSTTRFTNNNITFDKPYAALYPSVGPGIYYDNKIIFLGYGGLEHEENGDVICNITGCPGKTQHDCNQASYSPWFSNRRMVNAIILVNKGLNKVPSLQVWTIPMRQNYWGSEGRLLLLGNKIYIYTRSTSWHSKLQLGTLDISNYNDIRIRWTHHDVLSRPGSEECPWGNTCPRGCITGVYNDAYPLNPSGSVVSSVILDSRTSRENPIITYSTDTSRVNELAIRNNTLSAAYTTTNCVTHYGKGYCFHIIEINHKSLNTLQPMLFKTEIPKSCN

SEQ ID NO: 16403 - protein, 575 aa, unidentified
MAEKGKTNSSYWSTTRNDNSTVNTHINTPAGRTHIWLLIATTMHTVLSFIIMILCIDLIIKQDTCMKTNIMTVSSMNESAKIIKETITELIRQEVISRTINIQSSVQSGIPILLNKQSRDLTQLIEKSCNRQELAQICENTIAIHHADGISPLDPHDFWRCPVGEPLLSNNPNISLLPGPSLLSGSTTISGCVRLPSLSIGDAIYAYSSNLITQGCADIGKSYQVLQLGYISLNSDMYPDLNPVISHTYDINDNRKSCSVIAAGTRGYQLCSLPTVNETTDYSSEGIEDLVFDILDLKGKTKSHRYKNEDITFDHPFSAMYPSVGSGIKIENTLIFLGYGGLTTPLQGDTKCVINRCTNVNQSVCNDALKITWLKKRQVVNVLIRINNYLSDRPKIVVETIPITQNYLGAEGRLLKLGKKIYIYTRSSGWHSNLQIGSLDINNPMTIKWAPHEVLSRPGNQDCNWYNRCPRECISGVYTDAYPLSPDAVNVATTTLYANTSRVNPTIMYSNTSEIINMLRLKNVQLEAAYTTTSCITHFGKGYCFHIVEINQASLNTLQPMLFKTSIPKICKITS

SEQ ID NO: 16404 - protein, 572 aa, unidentified; identical to SEQ ID NO: 8208

SEQ ID NO: 16405 - protein, 572 aa, unidentified; identical to SEQ ID NO: 8527

SEQ ID NO: 16406 - protein, 575 aa, unidentified
MDGDRGKRDSYWSTSPSGSTTKLASSWERSSKVDTWLLILSFTQWALSIATVIICIIISARQGYSMKEYSMTVEALNMSSREVKESLTSLIRQEVIARAVNIQSSVQTGIPVLLNKNSRDVIQMIDKSCSRQELTQLCESTIAVHHAEGITPLEPHSFWRCPVGEPYLSSDPKISLLPGPSLLPGSTTISGCVRLPSLSIGEAIYAYSSNLITQGCADIGKSYQVLQLGYISLNSDMFPDLNPVVSHTYDINDNRKSCSVVATGTRGYQLCSMPTVDERTDYSSDGIEDLVLDVLDLKGRTKSHRYRNSEVDLDHPFSALYPSVGNGIATEGTLIFLGYGGLTTPLQGDTKCRTKGCQQVSQDTCNEALKITWLGGKQVVSVIIQVNDYLSERPKIRVTTIPITQNYLGAEGRLLKLGDRVYIYTRSSGWHSQLQIGVLDISHPLTINWTPHEALSRPGNKECNWYNTCPKECISGVYTDAYPLSPDAANVATVTLYANTSRVNPTIMYSNTTNIINMLRIKDVQLEAAYTTTSCITHFGKGYCFHIIEINQKSLNTLQPMLFKTSIPKLCKAES

SEQ ID NO: 16407 - protein, 576 aa, unidentified; identical to SEQ ID NO: 9004

SEQ ID NO: 16408 - protein, 574 aa, unidentified
MDKGKNTKEPYWTASSDPNIPGSVSDELHLNRSLYKSALISTTQLTISLVVLVLSSIIVARQSSNIRDGPAILETVNISHKEMKEAIMNLIRQEVIARSINIQSSVQTGIPVLLNKNTRDIIQTVGKSCNRQELTQLCESTIAVHHADGITPLNPHEFWRCPAGEPYLGQDPEISLLPGPSLLSGSTTISGCVRLPSLSIGDTIYAYSSNLITQGCANIGKSYQVLQLGYISLNSDMFPDLNPVVSHTYDINDNRKSCSVIAAGNKGYQLCSMPKVDERADYASDGIEDLVLDVLDLKGRTRSHRYKNRDINFDHPFSSLYPSVGSGVALGQSLIFLGYGGLTTPLQGNTKCNLRGCRQVSQETCNEALKVTWLGGRQIVNAIISVTNYLSDRPRIEVTTIPITQNYLGAEGRLLKLGDKIYIYTRSSGWHSQLQIGVLDMGNPLTITWTTHEFLSRPGNAECNWYNTCPKECISGVYTDAYPLSPDAANVATVTLYANTSRVNPTIMYSNTTNAINMLRIQGVDLEAAYTTTSCVTHFGKGYCFHIIEINQKSLNTLQPMLFKTSIPKLCNVG

SEQ ID NO: 16409 - protein, 575 aa, unidentified
MDGDKRKRDSYWSTSPSGSTTKLVSDWGRSGKIDTWLLILAFTQWALSIATVIICTVIIARQGHSMREYSTTIEALNISSKEVKESLTSLIRQEVITRAVNIQSSVQTGIPVLLNKNSRDVTQLIEKSCNRQDLTQLCDSTIAVHHAEGIAPLEPHSFWRCPTGEPYLSPDPEISLLPGPSLLSGSTTISGCVRLPSLSIGEAIYAYSSNLITQGCADIGKSYQVLQLGYISLNSDMFPDLNPVVSHTYDINDNRKSCSVVATGTRGYQLCSMPTVDERTDYSSDGIENVVLDILDLKGRTKSHRYSNSEIDFDHPYSALYPSVGSGIATEGSLMFLGYGGLTTPLQGDTRCRTQGCQQVSQDTCNEALKITWLGGKQVVSVLIQVNDYLSERPKIRVTTIPVTQNYLGAEGRLLKLGDQVYIYTRSSGWHSQLQIGVLDVSHPLTINWTPHEALSRPGNGECNWYNTCPRECISGVYTDAYPLSPDAANVATVTLYANTSRVNPTIMYSNTTNIINMLRIKDVQLEAAYTTTSCITHFGKGYCFHIIEINQKSLNTLQPMLFKTSIPKLCRVES

SEQ ID NO: 16410 - protein, 575 aa, unidentified
MDGDGRKRDSYWSTSLGGSATKLVSDLGRPGKVDTWLLILTFIQWVLSTATVIICIIIAARQGHDMRGYSITVEALNISSKEVKDSLTSLIRQEVITRAVNIQSSVQTGIPVLLNKNNRDVIQMIEKSCNKQELTHLCESTIAVHHAEGIAPLEPHSFWRCPAGEPYLSSDPEVSLLPGPSLLSGSTTISGCVRLPSLSIGEVIYAYSSNLITQGCADIGKSYQVLQLGYISLNSDMFPDLNPVVSHTYDINDNRKSCSVVAAGARGYQLCSMPTVDERTDYSSDGIEDLVLDILDLKGRTKSHRYSSSEIDLDHPFSALYPGVGSGIATEGSLMFLGYGGLTTPLQGDTKCRTQGCQQVSQDTCNEALKITWLGGKQVVSVLIQVNDYLSERPKIKVTTIPITQNYLGAEGRLLKLGDQVYIYTRSSGWHSQLQIGVLDVSHPLTINWTPHEALSRPGNEACNWYNTCPKECISGVYTDAYPLSPDAANVATVTLYANTSRVNPTIMYSNTTNIINMLRIKDVQLEAAYTTTSCITHFGKGYCFHIIEINQKSLNTLQPMLFKTSIPKLCKAGS

SEQ ID NO: 16411 - protein, 576 aa, unidentified
MEETVLKTREYWARSPERHATNHPNVQNREMIKEILTILISFISSLSLVLVIAVLIMQSLHNGAILRCKDVDLESINKSAYSISNAILSVIKQELISSIITTQSSVQVTLSVLINKKIQELSLTIEKSSKVHQNSPTCSGVAALTHVEGIKPLDPDDYWRCPSGEPYLEDELTLNLIPGPSMLAGTSTIDGCVRLPSLAIGKSLYAYSSNLITKGCQDIGKSYQVLQLGIITLNSDLHPDLNPIISHTYDMNDNRKSCSVAVSETKGYQLCSMPRVNEKTDYTSDGIEDIVFDVLDLKGSSRSFKFSNNDINFDHPFSALYPSVHSGIIWHNALYFLGYGALTTALRGNTKCNPMGCPQATQDNCNKFISSSWLYSKQMVNVLIQVKGYLSNKPNIIVRTIPITENYVGAEGKLVGTGKKIYIYTRSTGWHTQLQIGSVNINHPITITWKDHRVLSRPGRSPCAWNNKCPRNCTTGVYTDAYPISPDANYVATVTLLSNSTRTNPTIMYSSSDRVYNMLRLRNTELEAAYTTTSCIVHFDRGYCFHIIEINQKELNTLQPMLFKTAISKACRISNL

SEQ ID NO: 16412 - protein, 574 aa, unidentified
MEYWKHTNNIENTNMKSDMDINRAKSGMLNIATFVFSITTSIVASIAFIIVLISLIQNNNNNRILLQELKEETDAIETRIQKVSNEIGTSIQSGINTRLLTIQSHVQNYIPLALTQQTSNFREFINELIKKEEEKQSRVPIQRMVHDDGIEPLIPDKFWKCSSGNPTLISSPKIRLIPGPGWLATSTTINGCIRLPSLVINNLIYAYTSNLITKGCQDIGKSYQVLQIGIITINSDLVPDLNPRITHTFNINDNRKSCSLALLNADVYQLCSTPKVDERSDYASIGIEDLVLDIVTSEGIIITTRFTNDNITFDKPYAALYPSVGPGIHYNNRIIFLGYGGLEHEENEDVICNVTGCPGKTQADCNQASYSPWFSNRRMVNAIITIDRGINGKPNLRVWTIPMRQNYWGSEGRLLLLGDKIYIYTRSTSWHSKLQLGLIDISNYNNIRIRWTYHDVLSRPGSEECPWGNSCPRGCITGVYNDAYPLNPSGSVVASVILNSHTSRENPVITYSTDTSRVNELAIRNSTLSAAYTTTNCVTHYDKGYCFHIIEINHKSLNTLQPMLFKTEIPKSCN

SEQ ID NO: 16413 - protein, 575 aa, unidentified
MDGDGRKRDSYWSTSPGGSATKLVSDLGRPSKVDTWLLTLTFIQWALSTVTVIICIIIAARQGYGMRGYSVTVEAFNISSKELKDSLTSLIRQEVITRAVNIQSSVQTGIPVLLNKNNRDVIQMIEKSCNKQELTHLCESTIAVHHAEGIAPLEPHSFWRCPAGEPYLSSDPEVSLLPGPSLLSGSTTISGCVRLPSLSIGEAIYAYSSNLITQGCADIGKSYQVLQLGYISLNSDMFPDLNPVVSHTYDINDNRKSCSVVAAGARGYQLCSMPTVDERTDYSSNGIEDLVLDILDLKGRTKSHRYSSSEIDLDHPFSALYPGVGSGIATEGSLMFLGYGGLTTPLQGDTRCRTQGCQRVSQDTCNEALKITWLDGKQVVSVLIQVNDYLSERPKIKVTTIPITQNYLGAEGRLLKLGDQVYIYTRSSGWHSQLQIGILDVSHPLTINWTPHEALSRPGNEECNWYNTCPKECISGVYTDAYPLSPDAANVATVTLYANTSRVNPTIMYSNTTNIINMLRIKDVQLEAAYTTTSCITHFGKGYCFHIIEINQKSLNTLQPMLFKTSIPKLCKAGS

SEQ ID NO: 16414 - protein, 572 aa, unidentified; identical to SEQ ID NO: 8915

SEQ ID NO: 16415 - protein, 620 aa, unidentified; identical to SEQ ID NO: 15395

SEQ ID NO: 16416 - protein, 571 aa, unidentified
MEDYSNLSLKSIPKRTCRIIFRTATILGICTLIVLCSSILHEIIHLDVSSGLMDSDDSQQGIIQPIIESLKSLIALANQILYNVAIIIPLKIDSIETVIFSALKDMHTGSMSNTNCTPGNLLLHDAAYINGINKFLVLKSYNGTPKYGPLLNIPSFIPSATSPNGCTRIPSFSLIKTHWCYTHNVMLGDCLDFTTSNQYLAMGIIQQSAAAFPIFRTMKTIYLSDGINRKSCSVTAIPGGCVLYCYVATRSEKEDYATTDLAELRLAFYYYNDTFIERVISLPNTTGQWATINPAVGSGIYHLGFILFPVYGGLISGTPSYNKQSSRYFIPKHPNITCAGNSSEQAAAARSSYVIRYHSNRLIQSAVLICPLSDMHTARCNLVMFNNSQVMMGAEGRLYVIDNNLYYYQRSSSWWSASLFYRINTDFSKGIPPIIEAQWVPSYQVPRPGVMPCNATSFCPANCITGVYADVWPLNDPEPTSQNALNPNYRFAGAFLRNESNRTNPTFYTASASALLNTTGFNNTNHKAAYTSSTCFKNTGTQKIYCLIIIEMGSSLLGEFQIIPFLRELIP

SEQ ID NO: 16417 - protein, 574 aa, unidentified
MQDSHGNTQILNQANSMVKRTWRLLFGIATLILLVSIFVLSLIIVLQSTPGNLQNDINIIRKELNELMENFETTSKSLLSVSNQITYDVSVLTPIRQEAIETNIISKIKDHCKDRVIKEGSTCTLNGSPLHDVSFLNGFNKFYFTYKDNMQIKFKSLLDYPNFIPTATTPHGCIRIPSFSLGQTHWCYTHNINLLGCADPASSNQYVSLGTLQVLKMGDPYFKVEHSHYLNDGRNRKGCSVVAVPDGCLRNCVTMTKNETENFKDLNWQHNYLHTYHIMVPLKTRIINPPGSSRDWVHIAPGVGSGLLYAKLLIFPLYGGLTEKSVIHNNQSGKYFFPNSTKLQCRNSTMEKIKGAKDSYTITYFSGRLIQSAFLVCDLRQFLSEDCEILIPSNDYMMVGAEGRLYNIENNIFYYQRGSSWWPYPSLYRIRLNLSKKYPRITEIKFTKIEIAPRPGNKDCPGNKACPKECITGVYQDILPLSYPNTAFPHLKQAYYTGFYLNNSLERRNPTFYTADNLDYHQQERLGKFNLTAGYSTTTCFKQTTTARLYCLYIIEVGDSVIGDFQITLFLAAQ

SEQ ID NO: 16418 - protein, 565 aa, unidentified; identical to SEQ ID NO: 8390

SEQ ID NO: 16419 - protein, 565 aa, unidentified; identical to SEQ ID NO: 15175

SEQ ID NO: 16420 - protein, 582 aa, unidentified; identical to SEQ ID NO: 15494

SEQ ID NO: 16421 - protein, 582 aa, unidentified; identical to SEQ ID NO: 8729

SEQ ID NO: 16422 - protein, 576 aa, unidentified; identical to SEQ ID NO: 15490

SEQ ID NO: 16423 - protein, 568 aa, unidentified; identical to SEQ ID NO: 9025

SEQ ID NO: 16424 - protein, 595 aa, unidentified; identical to SEQ ID NO: 15401

SEQ ID NO: 16425 - protein, 583 aa, unidentified; identical to SEQ ID NO: 15402

SEQ ID NO: 16426 - protein, 595 aa, unidentified; identical to SEQ ID NO: 15251

SEQ ID NO: 16427 - protein, 582 aa, unidentified; identical to SEQ ID NO: 15407

SEQ ID NO: 16428 - protein, 595 aa, unidentified; identical to SEQ ID NO: 15252

SEQ ID NO: 16429 - protein, 593 aa, unidentified; identical to SEQ ID NO: 15546

SEQ ID NO: 16430 - protein, 580 aa, unidentified; identical to SEQ ID NO: 15404

SEQ ID NO: 16431 - protein, 588 aa, unidentified; identical to SEQ ID NO: 15409

SEQ ID NO: 16432 - protein, 582 aa, unidentified
MHNRTQSVSSIDTSSDVYLPRRKKAVTKFTFKKIFRVLILTLLLSIIIIIAVIFPKIDHIRETCDNSQILETITNQNSEIKNLINSAITNLNVLLTSTTVDLPIKLNNFGKSIVDQVTMMVRQCNAVCRGPGDRPTQNIELFKGLYHTSPPSNTSTKLSMITEASNPDDIVPRPGKLLGCTRFPSFSVHYGLWCYGHMASTGNCSGSSPSVQIIRIGSIGTNKDGTPKYVIIASASLPETTRLYHCSVTMTSIGCYILCTTPSVSETDDYSTMGIEKMSISFLSLDGYLTQLGQPTGLDNQNLYALYPGPGSGVIFRDFLIFPMMGGIRLMDAQKMLNRNITYRGFPPSETCTESELKLKQEVANMLTSPYYGEVLVLNFLYVCSLLDNIPGDCSVQLIPPDNMTLGAESRLYVLNGSLIMYKRGSSWWPYTELYQINYRVNNRAFRVRESVRINTTSTSRPGVQGCNLEKVCPKVCVSGIYQSPGIISAPVNPTRQEEGLLYFLVWTSSMSSRTGPLSSLCDHSTCRITYPIGDDTIFIGYTDSSCFMSSIKEGIYCIAFLELDNQPYSMMAIRSLSYIIN

SEQ ID NO: 16433 - protein, 572 aa, unidentified
MKKEDYQYYTSADPNKKTMQMIDQLNLSYVASVITSVASLISLIVLIAVNISTLVKNNEQNNYLNEGKIDDVYQKLSVHSSDQAELIIPQISIINRQVSFQLPVQLASMQKDIVNDIAKICSPLYETNLTMCPVVLNPVHSPFFSLATPTLLENCFNNKTLPQLPENLSFSEFPSFIPGPTRPGGCSRTPSFSLSGSLFSYTHNIIEDKCKTTSHSSEFMALGVIVTGNNNSPKLENIKTWHLDDNLNRKHCTTVAKMNGAWFACNIVDSGELDDYATEGISKIYLSYRDIFGTTREWIYVSDEIQKDYGYNALYFGVGSGVIKDGKVYFLMYGGLSEYIDEDAYCHAPGCENPEQQICNQAQQPEQYNSCQMVNALLEFDDRITYKPRLKIITFSPSNVRFGSEGRLYGFPDEESIYIYLKSSSWHSLLQVGKFQLSNKPVIDWTVHYFMSRPGSDPCKANNRCPKSCVTGVYCDFYPFNTNYSLGISGYLRSQFDTINPWIRMASSTSLIAQSQLSSDNQKASYSTTTCFIYNRDLWCLTIFEFSPATIGEYQPVPFLYKVTTNCWKSGN

SEQ ID NO: 16434 - protein, 767 aa, unidentified
MKMVNLQDYYGVNNIKSANEDNEKVKNKSSNYSKIITDLALIFGVISLLTLIALNITNIILNIKQTTSQKTSTNLGSAPENLLKTISNDLNNEIKPQVGLINNAVSYRLPMTLNNIYSFLKKDLLQACMPKFNFGNSTCPLGDQLTHTKYFSELNLQNLIECPDYGYTAGIAGNVNLMPFNSFVSTSSTPSGCVYNPSFSLSSTIYTYLQINTAKSCNYDGSTSVTWTLGKIDESDLGPPSLEPIITWFINNNNNLRPCSSASSYLSSWLMCNVINQPMENDINDIGGMGFYLAYQDLYGRKREWFYNYESIIKDTDYYTIFISQGSGISLGDNIYFLLYGSINPINNLNSFCRAPGCHHLSQGACNAADLNSRFGNKQMVNMILSFSADITKKPQITIKMISPANNWQGSPGRLMYFPSVNRTYIYKSSYGWHTLPQTGIIDVNNPNNITWIDQYTSARPGYPPCTAETRCPNSCYSGIYLDIFPLSEYYEYGVTISLNSTIYNKNPMISVIDISTVIYNKILLETDNLIDMTTTTCFNYKQEVWCVSIIQITDTNEAFTQPLPIMYRLPFKCNRYQRLRPRPVPIHFNNASENPFQNYRTTRSVNGQYFTTSTPLPSKYPITISYLNVSEENNTHYNDSTTLQDHYKNENNVLNSTTAEYREHENQKQNDKNGVEDTKNTMEYSGDYDYNMTQKYDHHNPTSTTPELLNYGVTAVNNSYPNTSYSTPLVKNYTDKVTVENKTISNNETMYRSIYRLLERIGGGFS

SEQ ID NO: 16435 - protein, 613 aa, unidentified
MSNYFGNEKLPRAETPTPKRDTYNQIVVTATAIVSLISIVVLIALNITNLAATLRSTPGEDKFNLKLDNVLQISKDINTVLIGAINPKVGLINTATSYKLPGLITTQARAIRDEINKVCIPRYQVNQTQCPVTQTTSNSAKFKLYDPNFVTQCSGGVPQLATMNQFQITPFASFIPTGTSLTGCVRIPTFDLGEHIYSYSHNLMDGNCRDSTQSNQYWSIGVITDGLNNTPAFKEVVNWFLNDGYNRKSCSTAVSGFGAWLACSIVTQTEKADYESPGIEDIMLLYMDIYGTRKQWLYTQNEIDMPDARNSLYFSVGSGVVIEGTVYFLAYGGMTGNIPGNAYCPVSECVRLSRDQTICNRAQRPRMFGAKQILSSIVSFEDQITEKPRISVKTVPPTEVIMGAEGRLYRTPYSEKSYIYLRSSSWYGGLMFGEIDLQGSLNITWRKFTTVARPGAGACMSSNRCPAECITGVYTDFFLLSTEQFLGVTIELTGGKLRRGPAIKLADQTNVIASQLLVNPTKEAAYTTTTCFIYSSRPWCISIIEMIPGAIGSYQPVAILYPVWSTCNQDLFKLDYDSWPKNGTYLVDPTTPYPYAEGPSTTMHTTQSTTRLS

SEQ ID NO: 16436 - protein, 161 aa, unidentified
AVVMNDGGWIFLKPTVADIGKTITVRNGTCVFSSLDIGNECEETMTYPCITLAATEEPVDLDCFCRDVKNVMVTYPTCKRNTRTRRDVTIQDHPPSVTLTKPSLLKHVGGAEEHLQKVENWILMNSWKVVLVTVALLYGFGNKLQTWILIIVTLIVAPAYA

SEQ ID NO: 16437 - protein, 167 aa, unidentified
LKLSMLNGLVVMSVNVTDAMGPIVLPTSKGNNTCQLRAMDVGTMCEDDITYLCPALEAGNDPEDIDCWCDRAPVYVHYGRCMKTRHQRRSRRSLTVQSHGESTILNKKGAWLDSTKVTRYLTKTETWMIRNPGYVLVAAVIGWMLGSNRSQKIIFVVLLLLVAPAYS

SEQ ID NO: 16438 - protein, 75 aa, unidentified
AVNIASHPEIVPLKPVTYMPTLGSVNDRVGKTEEWVTNNMVKTLLFVFIMFAIFGFDWKTVVVLCLAALALPSFA

SEQ ID NO: 16439 - protein, 75 aa, unidentified
SLVIQDHPHSETVAKPTLWLKWNTVNDRVGMTEEWVMRNTWKATILTLAIIAVTGLNWKGVLLLVVALMFAPNLA

SEQ ID NO: 16440 - protein, 75 aa, unidentified
SLSITEHPSSVSLDKPTLWHHWNSVNDRIGKSEEWIVTNAWKSLVIAIVVIMVFGISYQSMIVICIAALIAPSYS

SEQ ID NO: 16441 - protein, 75 aa, unidentified
AVTLPSHSTRKLQTRSQTWLESREYTKHLIRVENWIFRNPGFALAAAAIAWLLGSSTSQKVIYLVMILLIAPAYS

SEQ ID NO: 16442 - protein, 91 aa, unidentified
FLTVLCGCVVIDMQVSTAKGTEIFEGKTNRTDYLHLVKLPADGCWSGILVTKKCPKVTDLAKDLESTDCGSTWTEFTLRYRRCAVKKREKR

SEQ ID NO: 16443 - protein, 76 aa, unidentified
SVALAPHGTGNLHTGEAPMWKSHTDASKYLQRVERWALRNPGYLGILVAIGWLLGRTTAQRVIYITLLVLIGPAYS

SEQ ID NO: 16444 - protein, 75 aa, unidentified
SIMIPTHSTGGLHQGTEGWHRTNNVKNFLMRVEKWSLRNPGYTALIAILGWTLGTTTAQKVIFIALLLMIAPVYG

SEQ ID NO: 16445 - protein, 65 aa, unidentified
QKVDDKSPLTRFKEDLSTLETEAFQMLKRHAFSTILALITLAIVLKWPIWVVVLLGFLAWNVVKG

SEQ ID NO: 16446 - protein, 61 aa, unidentified
PQPQVSNQVGLLEEVEMIGFRFFRENVPVIVVCLLVAAVAMRWPMWSVVLISVLTWNVVKA

SEQ ID NO: 16447 - protein, 66 aa, unidentified
DTPKATETVKDRLKENMADLEASAFTWLKKNTFTTMVFIIVVGIALKWPLWIVALLVAACWSTVLA

SEQ ID NO: 16448 - protein, 65 aa, unidentified
AEEKGKTMLGQFKEDLSTLETEAFLLFKKHAFSTILVLLVLAIVMKWPVWVVVILGILAWNVVKG

SEQ ID NO: 16449 - protein, 75 aa, unidentified
SVLIPSHAQGELTGRGRKWLEGDSLRTHLTRVEGWVWKNKLLTLAMFAVVWLALESVVTRVAVLVVLLCLAPVYA

SEQ ID NO: 16450 - protein, 75 aa, unidentified
SITLPSHASQKLETRSSTWLESREYSKYLIKVENWILRNPGYALVAAVIGWTLGSSRSQKIIFVTLLMLVAPAYS

SEQ ID NO: 16451 - protein, 66 aa, unidentified
SVTETTHESSGGEHWDYSEYLTDFEHKMSKYKMPVLIILVGYLVLKTQNMALLIILVIAQFYLADA

SEQ ID NO: 16452 - protein, 525 aa, unidentified
MASLLKSLALFKRAKDKPPLAAGSGGAIRGIKHVIVVPIPGDSSITTRSRLLDRLVKMVGDPDISGPKLTGALISILSLFVESPGQLIQRITDDPDISIKLVEVVQSDKTQSGLTFASRGTSMDDEADRYFTYEEPNDGEERQSYWFENRDIQDIEIQDPEGFNMILATILAQIWILLAKAVTAPDTAADSELRRWVKYTQQRRVIGEFRLDKGWLDTVRNRVAEDLSLRRFMVALILDIKRTPGNKPRIAEMICDIDTYIVEAGLASFILTIKFGIETMYPALGLHEFAGELSTIESLMNLYQQMGELAPYMVILENSIQNKFSAGAYPLLWSYAMGIGVELENSMGGLNFGRSYFDPAYFRLGQEMVRRSAGKVSSNLASELGITEEEARLVSEIAAYTSDDRNNRTSGPKQAQVSFLRTDQGSEAQHSASKKDEARAPQVKKETRTSSKSDKHKEGTDKEPVSSSAMTLIDVDTTLEADTDPLESKKSAEALLRLQAMAGILGDSTLGNDSLRAYNDKDLLN

SEQ ID NO: 16453 - protein, 337 aa, unidentified; identical to SEQ ID NO: 8339

SEQ ID NO: 16454 - protein, 905 aa, unidentified
GEARGLTMGEKWKERLNQLNREDFFRYRKEAITEVDRAPARKARRANDITSGKPVSRGTAKLRWMVERGFVKPHGKVVDLGCGRGGWSYYAATLKHVQEVRGYTKGGPGHEEPMLMQSYGWNLVTLKSGVDAYYRPPESSDTLFCDIGESSSSVAVEEARTIRVLECVQGWLELGPTEFCIKVLCPYTPKVIEKLEGLQRKYGGGLVRVPLSRNSTHEMYWVSGATGNLVNSVNMTSQVLTGRFDKRVWVGPKYEEDVDLGSGTRSVSRKAQKPNMEKIKHRIKKLQEEYANTWQEDKNHPYRTWNYHGSYEVKATGSASSLVNGVVRLLSKPWDALTSVTTMAMTDTTPFGQQRVFKEKVDTKAPEPPRGAATVMNEVSNWLWDYLSREKKPRLCTKEEFIKKVNSNAAIGAMFEEQNQWKSANDAVQDPEFWRLVDEERENHLKGECHTCIYNMMGKREKKPGEFGKAKGSRAIWFMWLGARFLEFEALGFLNEDHWMSRENSGGGVEGLGVQKLGYILRELGEMPGGKLYADDTAGWDTRITRADLENEAKIMEKMDEHHKKLAKAIIELTYRHKVVKVMRPGKDGKTLMDVISREDQRGSGQVVTYALNTFTNIVVQLIRMMEAEGILTSTDVENLGKGKLQIVRNWLISFARQRVRKMAVSGDDVVVKSEDERFATALHFLNAMSKIRKDIPEWKASNGWNDWQQVPFCSNHFQELVMKDGRKLVVPCRGQDELVGRARISPGSGFGVKDTACLAKAYAQMWLLLYFHRRDLRLMANAICSAVPINWVPTGRTTWSIHGKGEWMTSEDMLDVWNRVWIEENEHMEDKTPVRSWNEVPYIGKREDIWCGSLIGTRSRATWAENIYAAINQVRAIIGNEEYEDYMPSQRRFEETRVVIDPVF

SEQ ID NO: 16455 - protein, 337 aa, unidentified; identical to SEQ ID NO: 10217

SEQ ID NO: 16456 - protein, 337 aa, unidentified; identical to SEQ ID NO: 8212

SEQ ID NO: 16457 - protein, 337 aa, unidentified
KPGEFGCAKGSRTIWYMWLGSRFLEFESFGFLNEEHWASRELSGGGVESIPLFYLGYHLREMAKKPGKLYADDTAGWDTRITEADLDDECILCDYMEDEHKQLALSLFELCYKNKVALCPRPGRHGGTVMDVIFRRDQRGSGQVVTYALNTLTNIKVQLIRLAESEGVLDEDFNDHGIETWLNHYGEERLSRLLISGDDCLVNAFDERFGKALTWLNTMEKIRKDIDLCAPSNGYENFEKVEFCSNHFHELMLKDGRQLVVPCRSQNELVGRASVNQGGSATVAGTACLAKAYAQMWNLLYFHRRDLRLLGFAIMSATPSNWIPTGRTTWSIHATKD

SEQ ID NO: 16458 - protein, 231 aa, unidentified; identical to SEQ ID NO: 9315

SEQ ID NO: 16459 - protein, 908 aa, unidentified
GVTISNTRGMEWKRKLNAMNKETFQRYRRDGIVEVDRTAAREALKSGNVTGGHAVSRGSAKLRWLVDKGYLRLMGDVTDLGCGRGGWCYYAAAQRNVVSVRGFTKGGDGHEEPIPVQTYGWNIVTLRSKVDVFYMPTHMTDTLLCDIGESSSNMLVEEERTLRVLNLVEEWIRKSKPTHFCCKVLAPYMPNVLEKIDKLMKVHGGALVRVPLSRNSTHEMYWVSDARGNAMNAVASLSRTLLDRMIHLTGKVHWEDDVNLGTGTRAVNSVADPPNWDKIGLRVRKLEQEYKASWMYDAEHPYKTWTYHGSYETSTSGSASSMINGVVKELTHPWDTNSGVTNVCMTDTTPFGQQRVFKEKVDTKAMEPPTGTREVMRIVNRWLTNYLSRTKKPRLCTPDEFIAKVNSDAALGTMFNDQGNWPSAKDAVRDHGFWRQVDIERQHHLEGRCVSCVYNMMGKREKKLTEFGRAKGSRAIWYMWLGARYLEFEALGFLNEDHWLSRENSKGGVEGIGLQYLGYILEDMGGMTGGQMYADDTAGWDTKITNADLEDEMEITKLMAHTHKKLATAIMDLTYMNKVVRVMRPGKGGKTLMDIISRKDQRGSGQVVTYPLNTWTNLKVQLIRMAEGEGVILPEDTLSLTGCSRRNLEMWLVRNGEERLTRIAASGDDVVVKPIDDRFAEALHFLNSMAKIRKDINEWKPSTGWNSWEGVPFCSHHFHKLSLKDGRTLTVPCRDQDELIGRARVSPGAGWTLRETAGLSKAYAQMWMLIHFHRRDLRTIAFAICSAVPKDWVPTGRTSWSIHARGEWMTNEDMLAVWNRVWITENPYMFNKETIHDWRDVPYLRKQLDKNCGSMIGVRSRATWAENIRVSVNQVRGYIGKHENYLDYLQAQNRFSIPAEFTMGNILI

SEQ ID NO: 16460 - protein, 907 aa, unidentified
GKKVEYTLGIKWKNRLNAMDKREFSVYKRDGILEVNRTPAQEALKSGNVTGGHAVSRGSAKLRWLHEKGYVDLSGHMVDLGCGRGGWSYYAAAQKKIVRVKGYTKGGPGHEEPVPVQSYGWNLVTMRSNVDVFYLGTEKCDTLVCDIGESSSSYMVEEERTLRVLNMFETWLKEQHPENFVCKVLAPYMPAVIEKIDVLMKNFGGALVRVPLSRNSTHEMYWVSGAKGNAMNAVSSLSRQLIARMEKPKYVMCLEEDVNLGTGTRAVTCEAEPPNMDKIGHRVERLRKEYKQTWFYDNEHPYRTWVYHGSYETKTTGSASSMLNGVVKEMSKPWDTIYGVTSVCMTDTTPFGQQRVFKEKVDTKASEPKAGIREVMRITNRWLLNELSREKTPRLCTPDEFIAKVNSDAALGVMFSDQGDWTTAKEAVRDPRFWKLVDAEREEHLQGRCTTCIYNMMGKREKKSTEFGRAKGSRAIWFMWLGARYLEFEALGFLNEDHWLERSNSHGGVEGIGLQYLGYVIEEMSHIPGGNFYADDTAGWDTKITNADLEDELMIVERMGKTHRRLAQSIMELTYMNKVVRVMRPGTRGKTMMDVISRKDQRGSGQVVTYPLNTWTNLKVQLIRMAESEGVIHGDDVETLSSSGRINLEMWLVMNGADRLKRMACSGDDVVVKPIDDRFAGALVFLNGMAKTRKDINEWKPSVGWHNWEGVPFCSHHFHQLWLRDGRSIIVPCRDQDELIGRARVSPGVGWTLKETAGLSKAYAQMWLLMHFHRRDLRMMAFAICSSVPVNWVPTGRTSWSLHARGEWMTTEDMLQVWNRVWIDDNPHMMKKTHVHDWRDIPYSCKGQDISCGSLIGTRSRATWADNIKTAVNQVRGIIGRDEKYMDYLAIQNRFMPPLQFRLGSVL

SEQ ID NO: 16461 - protein, 894 aa, unidentified
SLEKSATGGLGHRWKKILNAMSQDDFNSYRLYGVDETDKGDYVSRGGLKLRELTLKYGWKPEGICVDLGCGRGGWSQHLAMDPRVTRIEAYTLGGSTRENPQPVKTLGHNLIRFKTGVNVYNMVPTFANTIVCDIGESDPKTEVEASRTIRVLSTLGTWLEKNPNAEFVCKVLCPYPVEVLRLLETFQHKYGGRIVRSTFSRNSSAEMYYISGGRNNIVKVVFTTLHALIARLRTKPDKIVKEPIRLPVGTRSDPGHKVKDMNPKMIATRVEKLRNEHKDTWFIDSNHPYQSFRYVGSYVTDDINPGGQTVNPLMRKMMWPWELVGGVVNFMMTDVSTYAQQKVLREKVDTLSPEPPKNIKTINRLITEFQIRSYTKRGLRPRILTMEQYADNVKSSAAIGSWSSDVPWNNVRAALSDANFHALVDEERRLHLAGDCRMCVYNTMGKKEKKPASMGVAKGSRTIWYMWLGSRFLEYEALGFLNEDHWVSRENLACGVGGVGVNYFGYYLQEISKKGKFFIADDIAGWDTRINESDLADEEHLIMSMISDTRHRALATAVFKFAYQNIVALFPRNHPGFGSGTVMDVVARTDQRGSGQVVTYALNTITNAKIQLGRMIEAEGLLGAPESVITKWLDDNGEDRLSAMVVAGDDVVVATNNDKFSHSLDYLNLNGKIRKDIDPSLPSRVQTNWETVEFCSHHYHPMTLRDGRRIIVPCRDQNEVIGRGRIQKGGLVTIADSACLAKAYGQMWALYFFHRRDLRMAFMAITSSVPVDWFPEGRTSWSIHQNKEWMTTEDMLRVWNTVWIHDNNWMEDKTEVTAWKDIPYLPKSIDIKCGSQIGSKDRATWSRELPSTVMAIRRILDHETRMENVYKDFLSGMGRFREENDPMAAGVRF

SEQ ID NO: 16462 - protein, 887 aa, unidentified
LEKSTAVGLGIKWKTLLNSLDKDTFDKYKVRGVNETERGDYVSRGGLKLDEVIRKYNWKPNGRVVDLGCGRGGWSQRVVMEESVSSVYGYTVGGQEKEVPQKFLTKGYNLTNLKSGVDVYRLPPTRCDTIMCDIGESDPNPAKEKTRTLKVLELLENWLSVNPSAEFVCKILSPYSLEVLRKIETLQQKHKGRLVRLTYSRNSTAEMYYVSGSRSNAVRDVYMTLAALVARFSRHLDSIVLPPPDLLKGTRADPTASVASMDVSDMEDRVKRIKHENQTTWFVDPEHPYKSFKYFGSFVTDDVKVGGQAINPLVRKIMWPWEAITSVVGFLMTDVSTYSQQKVLREKVDTVIPPHPPQVREVNKLITQHLVKLFRSRNLQPRILSKEEFIANVRNDAAIGSWSKNVPWRDVQDAVQDQAFWNLVGQERRLHLQGKCEMCLYNTMGKKEKKPSLAGEAKGSRTIWYMWLGSRFLEFEALGFLNADHWVSRENFPGGVGGLGVNYFGYYLKDIAGRGKYLFADDIAGWDTKISSEDLEDEETLLTELTANPYHKALIRATMKLAYQNIVAMFPRTHSKYGSGTVMDVVGRRDQRGSGQVVTYALNTVTNGKVQVARVLESEGLLNADINVIDKWLTKNMENVLSNMVIAGDDVVVSTDNREFSSSLEYLELTGKTRKNIPQGAPSRMECNWEKVEFCSHHYHEMYLRDGRNLIVPCRHEDEIVGRSRLQKGGVVSLAESACMAKAYAQMWALYFFHRRDLRLGFVAITSSVPTNWFPIGRTSWSIHQHHEWMTTCDMLRVWNDVWIHDNPWMTMKEPINAWEDIPYLHKKQDIECGSLIGSKERATWARDMENSVLSVRKILDSETGTNNSYKDELSVMSRFRKGNDVI

SEQ ID NO: 16463 - protein, 889 aa, unidentified
SINKAPVGGMGYRWKRELNKKSLSEFNDYRSRGVNETERGDYVSRGGLKMDELITKFGWEPKGRVVDLGCGRGGWAQRLVADRRVTKVNAYTLGGAERENPQKFTTTGYNLATFKTGVNVYAMNPQSANTIVCDIGESDPKPEVEFSRTMKVLNLLEDWLDKNPQAAFVCKVLAPYHLDVLRKIEGLQHKFDGRLVRLSHSRNSTAEMYYISGTRQNPVAAVYAVLAVLCRRFTINDPEFRIDPPKLSQGTRCDPSSKVKELDEDKVSTRIRRLKDENARTWFYDEEHPYNSFKYYGSFAADTRSGGGQTVNPMIRRVMWPWEEQKRTTSYMMTDVSTYAQQKILREKVDTLTEEPPANIKRVNRLIMKYFVRMFKDRGLKPRILTAADYARNVQSHAAIGAWSKEIPWTSVNEALADSEFWNMVDRERAKHLAGDCEMCIYNTMGKKEKKPTVAGLAKGSRTIWYMWLGSRFLEYEALGFLNEDHWVARENFPGGVGGEGVNYFGYYLEEIAKKGKYLVADDVAGWDTRITQADLDDEEYFILEQITDPYHRKLVKALFMFAYKHIVALFPRDHPRFASNTVMDVVVRTDQRGSGQVVTYSMNTITNGKTLVGRELEACGLLEASDEEIWRWLLLYCVAFLSRSVVAGDDAVVATDNPQFMSSLKYITLAGKIRKDIDLETPSRFSTNWEEVEFCSHHYHRLHMKDGREIIAPCRDQFEIIGRSRIQKGGVVSLGDSGCLAKAYAQMWALYFFHRRDLRLGFAAITSCVPKDWVPTGRTTWSVHHGSEWMTTEDMLSVWNRVWIENNKWMSDKTPVCHWGEVPYLHKKQDIACGSQIGSHARSVWSRDMESHVERVRKTVVLEKGHQEFPNALGMFARYAKPEVSLFR

SEQ ID NO: 16464 - protein, 890 aa, unidentified
SLEKSATGGLGHRWKKLLNAMTLLEFNAYRSCGVDETEKGDYVSRGGLKLREITMKYGWKPEGICVDLGCGRGGWSQHLAMDPRVTRVESFTLGGTARENPQPIKTLGHNLIRFKSGVNVYNMTPTHANTIVCDIGESDPKPEVETSRTLRVLKTLELWLARNPNAEFVCKVLCPYPVEVLKCLETLQHKYGGRIIRSTYSRNSSAEMYYISGGRNNMVKVIFTTLHSLISRIRTRPEKIVKESVSLPVGTRSDPGHKIKSMDPKMIATRVEKIKKEHADTWFVDNNHPYQSFRYVGSYVTDDVTPGGQTVNPLMRKMMWPWETVGGVVNFMMTDVSTYAQQKVLREKVDTLSPEPPNDIQRVNRWITEFLCASFMRRGLKPRILTMEQYINNVKSSAAIGSWSSDVPWSSVREALADKRFHQMVEEERKLHLAGDCRMCVYNTMGKKEKKPSAMGVAKGSRTIWYMWLGSRFLEYEALGFLNEDHWVSRDNLACGVGGVGVNYFGYYLQEIARKGKFFIADDIAGWDTRINESDLADEEFLIMSLICDPYHRSLAKAVFRFAYQNIVALFPRNHPGFGSGTVMDVVARTDQRGSGQVVTYALNTITNAKIQLGRMLEAEGLLDAHEHVIKKWLNDNGEEALSGMVVAGDDVVVATNNGNFSRSLRYLHLNGKIRKDIDPSLPSKVETNWEVVEFCSHHYHVMTLKDGRRIIVPCREQNEIIGRGRIQKGGLVTLAESACLAKAYGQMWALYFFHRRDLRMAFLAITSSVPIDWFPEGRTSWSIHQNKEWMTTEDMLRVWNTVWIQDNPWMEDKMEIENWRDIPYLPKSMDLKCGSLIGTKERAAWSKDLPSTVTAVRKIIDQDTKTENVYQDFLGGMGRFQTYTDPMAT

SEQ ID NO: 16465 - protein, 903 aa, unidentified
GGSEGDTLGDLWKRRLNSCTREEFFVYRRTGILETERDRARELLKRGETNMGLAVSRGTAKLAWLEERGYATLKGEVVDLGCGRGGWSYYAASRPGVMSVRAYTIGGRGHEVPKMVTSLGWNLIKFRSGMDVFSMQPHRADTIMCDIGESNPDATVEGERTRRVILLMEQWKIRNPTAACVFKVLAPYRPEVIEALHRFQLQWGGGLVRTPFSRNSTHEMYYSTAVTGNIVNSVNIQSRKLLARFGDQRGPTRVPELDLGVGTRCVVLAEDKVKEQDVQERIRALREQYNETWHMDEEHPYRTWQYWGSYRTTPTGSAASLINGVVKLLSWPWNAREDVVRMAMTDTTAFGQQRVFKEKVDTKAQEPQPGTRVIMRAVNDWILERLAQKSKPRMCSREEFIAKVRSNAALGAWSDEQNRWASAREAVEDPAFWHLVDEERERHLMGRCAHCVYNMMGKREKKLGEFGVAKGSRAIWYMWLGSRFLEFEALGFLNEDHWASRESSGGGVEGISLNYLGWHLKKLSTLNGGLFYADDTAGWDTKVTNADLEDEEQILRYMEGEHKQLAATIMQKAYHAKVVKVARPSRDGGCIMDVITRRDQRGSGQVVTYALNTLTNIKVQLIRMMEGEGVIGAEDAHNPRLLRVERWLKEHGEERLGRMLVSGDDCVVRPMDDRFGRALYFLNDMAKTRKDIGEWEPSAGFSSWEEVPFCSHHFHELVMKDGRTLVVPCRDQDELVGRARVSPGCGWSVRETACLSKAYGQMWLLSYFHRRDLRTLGFAISSAVPVDWVPTGRTTWSIHASGAWMTTEDMLDVWNRVWILDNPFMQNKERITEWRDVPYLPKAQDMVCSSLVGRKERAEWAKNIWGAVEKVRKMIGPERFKDYLSCMDRHDLHWELKLESSII

SEQ ID NO: 16466 - protein, 904 aa, unidentified
RGGGNGETVGEKWKERLNRMTALEFYAYKRSGITEVCREPARRALKDGVVTGGHAVSRGSAKLRWMVERGHVNLVGRVVDLGCGRGGWSYYAASQKQVLEVRGYTKGGAGHEEPMNVQSYGWNIVRLKSGVDVFYLPSEPCDTLLCDIGESSSSPAVEEARTLRVLGMVETWLERGVKNFCIKVLCPYTSAMIERLEALQRRYGGGLVRVPLSRNSTHEMYWVSGAKSNIIRSVNATSQLLMHRMDIPTRKTKFEEDVNLGTGTRAVESRADPPDMKKLGSRIERLRKEYGSTWHYDENHPYRTWHYHGSYEADTQGSASSMVNGVVRLLSKPWDALSSVTNIAMTDTTPFGQQRVFKEKVDTRTPDPKQGTQRVMAITSQWLWDRLARNKTPRMCTRQEFINKVNSHAALGPVFREQQGWGSAAEAVVDPRFWELVDNEREAHLRGECLTCVYNMMGKREKKLGEFGKAKGSRAIWYMWLGARFLEFEALGFLNEDHWLSRENSGGGVEGLGLQKLGYILEEISRRPGGKMYADDTAGWDTRITKCDLENEARILEKMDGIHKKLARAVIELTYKHKVVRVLRPAPQGKVVMDIISRPDQRGSGQVVTYALNTYTNLVVQLIRNMEAEAVINERDMEELQNPWKVINWLEGNGWDRLRSMAVSGDDCVVKPMDDRFAYALNFLNDMGKVRKDVQEWKPSPGWTNWEEVPFCSHHFNKLPMKDGRTIIVPCRHQDELIGRARVSPGKGWSLSETACLGKSYAQMWLLLYFHRRDLRLMANAICSAVPVSWVPTGRTTWSIHGRGEWMTTEDMLEVWNRVWIIENEYMEDKTPVTEWTDVPYLGKREDLWCGSLIGHRPRSTWAENIWAAIYQVRRAIGETEEYRDYMSTQVRYGSEEGPSAGVL

SEQ ID NO: 16467 - protein, 831 aa, unidentified
GRQYKFTLNKLNKHDFLQFKGENVYELENKDDFPSRGFAKMDWMIKSTLFQPRGFVVDGGCGAGGFSARMCFEKPVAKILGYTIGKDKHHTPDLNGKKVYKKFNWEIGDLFKKRIRCDTFVMDIGESHPNQEIEAIGDLKRLNWFKENVDCKNWCIKIMVPTHEQVLHALPKGSTLIRNPWSRNSTLEMYCVPGSNEPGRMVSNVIKVLNQRINRTSWQGSIMKKLYYPEDEEQVGSTKVNYIIEKEKLQNFTLQEERRVFNHWKCLGSVEASRKGSSGQNYNSIITAITSGLRKVVPSIEHWMLTSTKPEDTFSTFLRKVDQPPQPLGNYKSEFQEKFKWVQQWYKSKNKHGRILTNEEVISKFKSDGALGFRCQHYGSIQEALENPNFFKDLEAEEINHLHGKCTRGVFDVIGKKEKKDLYGKPKGSRLIMYLDLVERFLEHKYLGFLNSDHWCHPENLPSGVSAVSPYEYPRMIVEKCKIDPRSDLMENWVIQDDTAGWDTRLHDDVLECEQSFLCDFAESEEHIKHILRIYKNYRNPMIKLTDDSGTRDLILIGKGQRCSGTVVTYSMNTITNTVVQMMRMQEVLELSNEECLHKMMVSGDDCLLVLKPEEAIKVSKSLKFINSTGFIRKDVPRHVPSPVVKDWKNISFCSHGIAKGRMQNGEYLWTLGKNEAEIIGKAQLQIGAFGDEINEQSQAKAMALYLLLTFPMRRDIRLIAKAIMACCQEGLVPMGKVKEPLIWGEPWLDSMDIVNIINKIYGTNFYTLEEVPYVRHSLDMERGSTIHTNERSNWKKFLLEKMVPDLSRRNNTAPNMNWLVRNGNRGNLLV

SEQ ID NO: 16468 - protein, 607 aa, unidentified
YIFSSDTGQGHLQQKSVRQTVLSEVVLERTLLDDVYAPRLDLNKEELLRKKLQLNPTQANRSRYQSRKVENMKAITTMRMLRGLGHYLKTDNKVECYRTLYPVPLYSSSVNRSFSCPKVAVEACNVVLKENFPTVASYCITPEYDAYLDMVDGATCCLDTASFCPAKLRSFPKKHSYLEPTIRSAVPSAIQNTLQNVLAAATKRNCNVTQMRELPVLDSAAFNVECFKKYACNNEYWDTYRDNPIRLTEENVTNYITKLKGPKAAALYAKTHNLCMLQDIPMDRFVMDLKRDVKVTPGTKHTEERPKVQVIQAADPLATAYLCGIHRELVRRLNAVLLPNVHTLFDMSAEDFDAIIAEHFQHGDQVLETDIASFDKSEDDAMALTALMILEDLGVDQELLTLIEAAFGEISSIHLPTKTKFKFGAMMKSGMFLTLFVNTIINIVIASRVLRERLTNSPCAAFIGDDNIVKGVKSDKLMADRCATWLNMEVKIIDAVVGEKAPYFCGGFILCDTVTGTACRVADPLKRLFKLGKPLAADDEHDDDRRRALFEEAERWNRAGISVELCKAVESRYEIVGTSIIIAAMATLARNVATFKHLRGNPIHLYG

SEQ ID NO: 16469 - protein, 607 aa, unidentified
YIFSSDTGQGHLQQKSVRQTVLSEVVLERTELEISYAPRLDLEKEELLRKKLQLNPTPANRSRYQSRKVENMKAITARRILQGLGHYLKAEGKVECYRTLHPVPLYSSSVNRAFSSPKVAVEACNAMLKENFPTVASYCIIPEYDAYLDMVDGASCCLDTASFCPAKLRSFPKKHSYLEPTIRSAVPSAIQNTLQNVLAAATKRNCNVTQMRELPVLDSAAFNVECFKKYACNNEYWKTFKENPIRLTEENVINYITKLKGPKAAALYAKTHNLNMLQDIPMDRFVMDLKRDVKVTPGTKHTEERPKVQVIQAADPLATAYLCGIHRELVRRLNAVLLPNIHTLFDMSAEDFDAIIAEHFQPGDCVLETDIASFDKSEDDAMALTAMMILEDLGVDAELLTLIEAAFGEISSIHLPTKTKFKFGAMMKSGMFLTLFVNTVINIVIASRVLRERLTGSPCAAFIGDDNIVKGVKSDKLMADRCATWLNMEVKIIDAVVGEKAPYFCGGFILCDSVTGTACRVADPLKRLFKLGKPLAADDEHDDDRRRALHEESTRWNRVGILPELCKAVESRYETVGTSVIVMAMATLASSVKSFSYLRGASITLYG

SEQ ID NO: 16470 - protein, 608 aa, unidentified
YIFSSETGQGHLQQKSVRQCKLQDAVLERVTHEKYYAPRLDLEKEKLLQKKLQLCASEANRSRYQSRKVENMKAITADRLISGLGTYVSTEAQAVECYRVTYPVPQYSAVIPNKFSSATVAIKVCNLVIQENYPTVASYCITDEYDAYLDMVDGASCCLDTATFCPAKLRSYPKKHSYLQPEIRSAVPSPIQNTLQNVLAAATKRNCNVTQMRELPVLDSAAFNVECFKRFACNDEYWDIFKNSPIRLTTENVTQYVTKLKGPKAAALFAKTHNLKPLHEIPMDQFVMDLKRDVKVTPGTKHTEERPKVQVIQAADPLATAYLCGIHRELVRRLNSVLLPNIHTLFDMSAEDFDAIIAEHFHYGDPVLETDIASFDKSEDDAIALSALMILEDLGVDQPLLDLIEAAFGNITSVHLPTGTRFKFGAMMKSGMFLTLFVNTLVNIMIASRVLRERLTTSACAAFIGDDNIVHGVVSDNLMADRCATWLNMEVKIIDAVIGVKAPYFCGGFILVDQITGTACRVADPLKRLFKLGKPLPLDDDQDVDRRRALYDESLRWNRIGITSELVKAVESRYEVVLSSLIIIALSTLADSVKNFKRIRGNPITLYG

SEQ ID NO: 16471 - protein, 608 aa, unidentified
YIFSSETGQGHLQQKSTRQCKLQNPILERSVHEKFYAPRLDLEREKLLQKKLQLCASEGNRSRYQSRKVENMKAITAERLLQGIGAYLSAESQPVECYKVNYPVPIYSTTRSNRFSSADVAVRVCNLVLQENFPTVASYTITDEYNAYLDMVDGASCCLDTATFCPAKLRSFPKKHSYLRPEIRSAVPSPIQNTLQNVLAAATKRNCNVTQMRELPVLDSAAFNVECFKKYACNDEYWDTFKNNPIRLTTENVTQYVTKLKGPKAAALFAKTHNLQPLHEIPMDRFVMDLKRDVKVTPGTKHTEERPKVQVIQAADPLATAYLCGIHRELVRRLNAVLLPNIHTLFDMSAEDFDAIIAEHFQFGDAVLETDIASFDKSEDDAIAMSALMILEDLGVDQALLDLIEAAFGNITSVHLPTGTRFKFGAMMKSGMFLTLFINTVVNIMIASRVLRERLTNSPCAAFIGDDNIVKGVKSDALMAERCATWLNMEVKIIDAIVGVKAPYFCGGFIVVDQVTGTACRVADPLKRLFKLGKPLPLDDDQDGDRRRALYDEALRWNRIGITDELIKAVESRYEVFYTSLVITALTTLAATVSNFKHIRGNPITLYG

SEQ ID NO: 16472 - protein, 606 aa, unidentified
YIFSSDTGQGHLQQKSVRQTVLSEVILERTELEIAYAPRLDLAKEELLRKKLQVNPTPANRSRYQSRKVENMKALITQRMLKGLGHYLRAEGKVECYRTLYPVPLYSACVDRAFSNPKFAVEACNVMLKENFPTVTSYGIVPEYDAYLDMVDGASCCLDTASFCPAKLRSFPKKHSYLDPTIRSAVPSAIQNTLQNVLAAATKRNCNVTQMRELPVLDSAAFNVECFKKYACNQEYWDTFKDNPIRLTTENVTNYITKLKGPKAAALYAKTHNLAMLQDIPMDRFVMDLKRDVKVTPGTKHTEERPKVQVIQAADPLATAYLCGIHRELVRRLNAVLLPNVHTLFDMSAEDFDAIIAEHFVQGDSVLETDIASFDKSEDDAMALTALMILEDLGVDQELLTLIEAAFGEISSVHLPTKTKFKFGAMMKSGMFLTLFVNTIINIVIASRVLRERLTHSPCSAFIGDDNIIKGVKSDKLMADRCATWLNMEVKIIDAVVGEKAPYFCGGFILCDTVTGTACRVADPLKRLFKLGKPLAADDEHDDDRRRALQEETARWNRVGIFEELCKAVESRYEVVGTSVIIMAMAALARSTSSFRCLRGNPITLY

SEQ ID NO: 16473 - protein, 607 aa, unidentified
YIFSSDTGQGHLQQKSVRQTALSEVVLERTELENSYAPRLDLIKEESLRKKLQLNPTQANRSRYQSRRVENMKAVTTKRLLGGLGHYLKSEGKVECYRTLYPVPLYSASVNRVFSNPRVAVEACNAMLKENFPTVASYCITPEYDAYMDMVDGASCCLDTASFCPAKLRSFPKRHAYLEPTIRSAVPSAIQNTLQNVLAAATKRNCNVTQMRELPVLDSAAFNVECFKKYACNNEYWETYKECPIRLTEENVTNYITKLKGPKAAALYAKTHNLSMLQDIPMDRFVMDLKRDVKVTPGTKHTEERPKVQVIQAADPLATAYLCGIHRELVRRLNAVLLPNVHTLFDMSAEDFDAIIAEHFQPGDSVLETDIASFDKSEDDAMALTALMILEDLGVDQELLTLIEAAFGEISSIHLPTKTKFKFGAMMKSGMFLTLFVNTVINIVIASRVLRERLTQSPCAAFIGDDNIVKGVKSDKLMADRCATWLNMEVKIIDAVVGIKAPYFCGGFILCDTVTGTACRVADPLKRLFKLGKPLAADDEHDDDRRRALQEESARWNRVGIHSELCKAVESRYETTGTSVIITAMTTLAQSVPAFKHLRGNPVTLYG

SEQ ID NO: 16474 - protein, 607 aa, unidentified
YIFSSDTGQGHLQQKSVRQTVLSEVVLERTELEIAYAPRLDLEKEEALRKKLQLNASQANRSRYLSRKVENMKAVTTNRILKGLGHYLRSEGRVECYRTLHPVPLYSACVDRAFASPRVAIEACNVVLKDNFPTVASYCIMPEYDAYLDMVDGASCCLDTASFCPAKLRSFPKKHTYLEPTIRSAVPSAIQNTLQNVLAAATKRNCNVTQMRELPVLDSAAFNVECFKKYACNNEYWETYRENPIRLTTENVTNYITKLKGPKAAALFAKTHDLTMLQDIPMDRFVMDLKRDVKVTPGTKHTEERPKVQVIQAADPLATAYLCGIHRELVRRLNAVLLPNIHTLFDMSAEDFDAIIAEHFLNGDSVLETDIASFDKSEDDAMALTALMILEDLGVDQELLTLIEAAFGEITSIHLPTKTKFKFGAMMKSGMFLTLFVNTVINIVIASRVLRERLTNSPCAAFIGDDNIVKGVKSDKLMADRCATWLNMEVKIIDAVVGEKAPYFCGGFILCDTVTGTACRVADPLKRLFKLGKPLAVDDEHDDDRRRALHEESQRWCRVGIFEELCKAVESRYETVGTAVIVMAMATLAGSVQSFRHLRGDPICLYG

SEQ ID NO: 16475 - protein, 609 aa, unidentified
YIFSSDQGTAHLSQHNTQTNNTTEVLMRTSVLPSNDHGTPDLLAEMKKRLAYQMRPTQKNKSRYLSAKVHNMKHKIVQCLQRGAGHYLREQHALPLWKNTFPKPRYSDACVVKFESVNTAIVAANMFIGCNYPTLSSFGVTDKYDAYLDMVDGLNCNLDTVTFEPAKVRSLPKKSKYNQPLIQSQVPGPMASTLQSILMAATKRNCNVTQMRELPTMDSAAMNVEAFKKFACKDTDLWTEFAEKPVRLSPGQIEEYVFHLQGAKANVMHSRVEAACPDLSEVAMDRFTLDMKRDVKVTPGTKHVEERPKVQVIQAADPMATAYLCAIHRELVRRLKAVLKPSIHVLFDMSSEDFDAIVGHGMKLGDKVLETDISSFDKSQDQAMAVTALMLLEDLGVEEDLLTLIEASFGDITSVHLPTGTRFQFGSMMKSGLFLTLFVNTLLNITIAARVLREQLADTRCAAFIGDDNVITGVVSDDMMVARCASWLNMEVKIMEMEIGDRSPYFCGGFLLLDTVTGTVSRVSDPVKRLMKMGKPALNDPETDVDRCRALREEVESWYRVGIQWPLQVAAATRYGVNHLPLATMAMATLAQDLRSYLGARGEYVSLYA

SEQ ID NO: 16476 - protein, 607 aa, unidentified
YIFSSDTGQGHLQQKSVRQTTLSEVVLERTELEHSYAPRLDLEKEEILRKKLQLNPTPANRSRYQSRRVENMKAVTTKRLLGGLGSYLKTEGKVECYRTLYPVPEYSASVNQVFSSPRVAIEACNAVLKENFPTVTSYCITPEYDAYMDMVDGASCCLDTASFCPAKLRSFPKRHAYLEPTIRSAVPSAIQNTLQNVLAAATKRNCNVTQMRELPVLDSAAFNVECFKKYACNNEYWETYREHPIRLTEENVTNYITKLKGPKAAALYAKTHNLSMLQDIPMDRFVMDLKRDVKVTPGTKHTEERPKVQVIQAADPLATAYLCGIHRELVRRLNAVLLPNVHTLFDMSAEDFDAIIAEHFQPGDSVLETDIASFDKSEDDAMALTALMILEDLGVDPELLTLIEAAFGEISSIHLPTKTKFKFGAMMKSGMFLTLFINTVINIVIASRVLRERLTNSPCAAFIGDDNIVKGIKSDKLMADRCATWLNMEVKIIDAVVGTKAPYFCGGFILCDTVTGTACRVADPLKRLFKLGKPLAADDEHDDDRRRALHEESARWNRVGIHSELCKAVESRYETTGTSVIITAMTTLAQSVSAFKHLRGNPLTLYG

SEQ ID NO: 16477 - protein, 608 aa, unidentified
YIFSSETGQGHLQQKSVRQCKLQEPILDRAVHEKYYAPRLDLEREKMLQKKLQLCASEGNRSRYQSRKVENMKAITAERLISGLGTYLSSEVNPVECYRVNYPVPIYSSTVINRFTSAEVAVKTCNLVIQENYPTVASYCITDEYDAYLDMVDGASCCLDTATFCPAKLRSYPKKHSYLQPEIRSAVPSPIQNTLQNVLAAATKRNCNVTQMRELPVLDSAAFNVDCFKKYACNDEYWDTFRDNPIRLTTENVTQYVTKLKGPKAAALFANTHNLKPLQEIPMDQFVMDLKRDVKVTPGTKHTEERPKVQVIQAADPLATAYLCGIHRELVRRLNAVLLPNIHTLFDMSAEDFDAIIAEHFHHGDPVLETDIASFDKSEDDAIAISALMILEDLGVDQPLLDLIEAAFGNITSVHLPTGTRFKFGAMMKSGMFLTLFVNTLVNIMIASRVLRERLTTSACAASIGDDNIVHGVVSDTLMAERCATWLNMEVKIIDAVIGIKAPYFCGGFILVDQITGTACRVADPLKRLFKLGKPLPVDDTQDCDRRRALHDEAMRWNRIGITDELVKAVESRYEIILAGLIITSLSTLAESVKNFKSIRGSPITLYG

SEQ ID NO: 16478 - protein, 335 aa, unidentified
MTLDAVITHWKWQNQYSPGGPTVLWSQRSRLGCWETQMRLPGFGQVMIKAHRNGTLMMICSGHDPKLQNDMCCGPPVCYGIFCREGLHEREQQCWPTIIRFNQGHPALFDNSSASFSETQKYLRGTPELDFIRFKNSVNYTPASGPMITWKSLKFQAAQLEDMRNPRIGQIGFSTNLGPGIHAYGPAMPSRQERVWWEDHPEISKGQPPFTCPEDWLECEEDSENEELSVSPLTGWEPHRDLKKWVNFALPYGWSLMDPLGNRFRSQRKDDSDESTSTDSEEELQEIQQINPAEVGPSRPPGGYSKLRRRRRVPAARLYATTDSSEEDLDLKTSQ

SEQ ID NO: 16479 - protein, 417 aa, unidentified
WKNIKRTVLLLNLLLVAQKVQNQDVGTILSFDVTCLKSITSLGRNDPGNDPSIMSHVLPVVTPWPMSQDHYAPTLFGLLDRYYKGYLENPATFQTWKFTCQEDPSGKRYMGTQFWVPPLGQVNIQFYKNYQIVTCCQALDPFANIFHGTEEEMYDIDSGPDVWCTPSLCFKVIYEGAIGQKQEQKSWLCRLGYGHRMGANDYRRVDLYAMKQGKKNPYGDKGDAALQYAYQVKRGCKAGCLASPVLNFKALQFHRTLMADLTNPKIGQGYLAHGYHAAMEAYGPQRGSSEERVWWNATRNQGKKDEYYREGGEEPHYPNTPAPHKKTWEERHKVLKLSPFATPSDIQRWTTRALPYGWKVIDGNGDDYTSRRNIRTLTEMTQEEIRKRWERGYCDPFIDSGSDSDGPLSKPQTVKVW

SEQ ID NO: 16480 - protein, 249 aa, unidentified
MASGGTPEKARVACRRVDLSSFLAQPDDYPTAADSKEDLILKLACTTLFSEKHAHEIYENYKLHLKRDELRGGKEWVIIYSCKHCYTVFMDNSRLTLGPSGLFKVIRNKKGPYMLCQMLTRHLTDRCDPRTKPFQSSSSLHPNLVTENPRGTGGGTPGQHTLGGDQDMRVDTSGIKPLSSLCQCARDDPGRSDNPLEMAEPVQPWWTDSSLEPEITTWVLGDPDATARFWTGDDKGPQEWDFDDDLLGP

SEQ ID NO: 16481 - protein, 249 aa, unidentified
MASSSWTPSPSPRGQRRITRKELWEVDLSRGDEFFPSSSDCKDTQLRLMLLSVYSLRQTKNLLTHFEIESRTLDNEYGYLIYTCNYCAKRQIDCNRWHYNHDFKLFEAERNDKGDQRSVSQCWRHLRYRCPNLPLDVRSSLQLTKWDDLLCKRIASYQMQGSGGKRRATERTISPGHQPIPNQQPEPQSSLSTDSTLLQDPGEGQSSRDHLDEEPGTGLPNMDWTVEWDGEISDSALQEFDFDLSLFGQ

SEQ ID NO: 16482 - protein, 209 aa, unidentified
MASKYPEEGPITEGVEEDFNSHSTSGLDLTSGNKEEPLISLALLSMHTSKIVVWIRDHFFVKILSFGGKQKLYYICNQCHKGIPESGYITLNTKYYLYEKGPTETGTKGLTLMRRHVQNSPCFLNSRKESGTPKTDPTRPATSYSLCRSDYQEAGCSRPTPSNSESVCNGLGQPSERGHTSGESGGIMEEVSFISWLEGLWGEGFDYAN

SEQ ID NO: 16483 - protein, 209 aa, unidentified
MASNYPEEGPVTEGVEEDFNSHSTPGLDLTSGNKEEPLISLALLSMHTSKIVIWIRDHFFVKILSFGGKQKLYYICNQCHKGIPESGYIVLNTKYYLYEKGLTETGTKGLTLMRRHVQNSPCFLSSRKESGTPKTDPIRPATSYSLCRSDHQEAGCSRPTPSNSESVCDGLGQPSERGHPSSESGRPMEEVSFISWLEGLWGEGFDYAN

SEQ ID NO: 16484 - protein, 278 aa, unidentified
MDPNQEEEPVAGTSGMNQDPVPFIPEGIAAANESDDEEPEQFLYKVYQESVKKNGGDYPKLEDWIPSPEEMSKSVCISLILTCLYNAEKAAQIKDWGYIVHWEQSPTDSKYFLIKYECPMCDSINQEPMPIWWDDRLKLWRKMGCRAVMGSIVYALKNHVDKCNSQVHPLRKTGNRRPRPRIDPIRRCNRLTGNYVPGRRGSTKPSNPSSHPSSGIPLAPGPRQCSTNTSNPPESLLRLLPGNDAISPALAISMSGGQIWEEVYNDLLLDATLGTSDN

SEQ ID NO: 16485 - protein, 300 aa, unidentified
MDSYQEEESVASTSGIQNLQTLSELVGPENAGEGELVIAEEPEENPRRPKRYTKREVKCVSYHAYRELEEKHPQHIKLQDWIPTPEEMSKSLCTRLILCGLYSAEKAGEILRMPFTVSWEQSDTDSKCFIVSYTCIFCDAIIHDPMPIMWDPEVKIWVKYKPLRGIVGSAVFIMHKHQRNCSFVKPSTSYSEGPKPRPRHDPVLRCDMFEKHHKPREKRPRKRSIDNESCASSSDTLANEPGSLCTNPLWNPGSLLQGVLEESSNFSNLEVHMSGGPFWEEVYGDSILGPPSGSGEHSVL

SEQ ID NO: 16486 - protein, 300 aa, unidentified
MDSYEKEESVASTSGIQDLQTLSELVGPENAGEGELTIAEEPEENPRRPRRYTKREVKCVSYHAYKEIEDKHPQHIKLQDWIPTPEEMSKSLCKRLILCGLYSAEKASEILRMPFTVSWEQSDTDPDCFIVSYTCIFCDAVIHDPMPIRWDPEVGIWVKYKPLRGIVGSAVFIMHKHQRNCSLVKPSTSCSEGPKPRPRHDPVLRCDMFEKHHKPRQKRPRRRSIDNESCASSSDTMANEPGSLCTNPLWNPGPLLSGLLEESSNLPNLEVHMSGGPFWEEVYGDSILGPPSGSGEHSVL

SEQ ID NO: 16487 - protein, 298 aa, unidentified
MATWEEKKELTHLHQEGDDPLTELSILLDLDNMDPNEGPDQNPGGEKIHLQLSNTPGNTSEKTYQFGFMDKEEQDPDLKMRDWVPEPDKMSKWACIRLMLCGLYNAQKAGEILSFNYDIHWEQSKEDKDFFEVEYHCKMCMTVLHEPMPVKWDHENGLWLKMGPLRGDLGSVVHTLRRHYNRCLSTLPSTGEPVKPRTRANPVRRYREMQVVVEARPKRSRWGMAPGERAHTSSDHAMALMPGPCGPFSQDHPGSLLEGIQGTGPGTSEMAVAMSGGPFWEQVYNDSIFGTPSGSGNN

SEQ ID NO: 16488 - protein, 308 aa, unidentified
MASWEDQEELRELLHHLPEDDPPADLSHLLNLDEMEPKVLGGQNPGDEKLRQQVIKPPSIHPSTVTWHFGYKDKEDQQPEIKMRDWVPDPSKMSKSTCMRLILLGLYQACKAQEIIKMDFDVHWEQSRVNKQYFEVEYSCRMCRTVLHEPMPIMYDPETELWVKPGRLRGPLGSAVYTLKKHYERCLSALPSFEGTRLPKRRANPSRRYEAFREHTPTRKRRSKEGISTDQQPSTSSGDPVALISGPCGPHSIQPPGCILQELPKPEVGTSEMAVAMSGGPFWEEVYGDSIFGAPFGTSDDQLLSQFD

SEQ ID NO: 16489 - protein, 308 aa, unidentified
MASWEDQEELRELLHHLPEDDPPADLSHLLNLDEMEPKVLGGQNPGDEKLRQQVIKPPSIHPSTVTWHFGYKDKEDQQPEIKMRDWVPDPSKMSKSTCMRLILLGLYQACKAQEIIKMDFDVHWEQSRVNKQYFEVEYSCRMCRTVLHEPMPIMYDPETELWVKPGRLRGPLGSAVYTLKKHYERCLSALPSFEGTRLPKRRANPSRRYEAFRKHTPTRKRRSKEGISTDQQPSTSSGDPMALISGPCGPHSIQPPGCILQELPKPEVGTSEMAVAMSGGPFWEEVYGDSIFGAPFGTSDDQLLSQFD

SEQ ID NO: 16490 - protein, 324 aa, unidentified
MASQQEKNSIVPEDDFMEELRAFLAEFPIAEQPLEDDVFQAEGQQPSQFLEDPGEGPSGASAQAGASSGPPKVSGKLWNMMAHHPNRGTTSHGPDEPPTGREPRLRWLQEARMETAYIRFEKDLEKFFPTPEQREFFIQRAIITAAGYKPDLAIYTAHNGWYACIQPHTGDLGEKYEVYYKCLKCGNEQWDPLLYDWDPSVLMFLRAWWKTPHTSSPLTAMRRHDAVCAGIYSDSSSSTEPPKRRQRGDPGHRWGAYKRTFDSGPLEQLVLTHTCAYTTEWPEPKRIHLGDLETVCPALPDPGEGGTNSEMEPQYQQGSWTFDQ

SEQ ID NO: 16491 - protein, 334 aa, unidentified
MASYKTQGSVKDDLVSFLQEFPLEDLDDIPTPAPCGMFEEYFPPTPMDPVAMGSEYNVAPLAELPDQLLSVTFPASPASTESSSEAGAQDYTGEGTAAGEAPPEAGPSRSNSQPGGTPFFWLQEARKRSDYDCWGLNYFFPKPGQREFYIQRSILTTAGYRPDLLRYSAAGGWYPIILPHEGVLGNTFQVYYLCLKCGDEVWDPLLYLWDQDLLAFYRAWETTPHTSSPLSVLRRHDASCRYLHHNAYNYSERPNIRKPRRDPGLRWCTGKRRLLRDSCEELVHPGTLPNPTQWTQLTPSHMHPLAALSELLQPELQTSPSSPLEGTKKRKLAE

SEQ ID NO: 16492 - protein, 308 aa, unidentified
MASWEAQEELRELLHHLPEDDPPADLTHLLELDEMEPKVLCGENPGDEKLKKQVIKTPPMHPSTVTWHFGYKQKEDQQDNIKMRDWVPDPSKMSKSTCKRLILLGLYQACKAQEIIKMDYDVHWEKSVVNEQYFEVEYNCKMCRTVLHEPMPIMYDPETELWVKPGRLRGPLGSAVYTLKKHYERCLLTLPSLKGTRLPKRRCNPSRRYETFREHPPTRKRRSKEGIPTDQQPSTSNGDPMALLSGPCGPHSIQPPGCLLQELPKPEVGSPEMAVAMSGGPFWEEVYGDSIFATPLGSSEDQLLSQFD

SEQ ID NO: 16493 - protein, 300 aa, unidentified
MDSYQEEEPVASTSGLQDLQTLSELVGPENAGEGDLVIAEEPEENPRRPRRYTKRDVKCVSYHAYKELEDKHPHHIKLQDWIPKPEEMSKSICKRLILCGLYSGEKAREILKKPFTVSWEQSETNPDCFIVSYTCIFCDAVIHDPMPVVWDSEVEIWVKYKPLRGIVGSAVFIMEKHQKNCSLVKPSTSCPEGPKPRRRHDPVLRCDMFEKHHKPRPKRSRKRSIDHESCASSGDTVANESGPLCTNTFWTPGPVLQGLLGESSNLPDLEVHMSGGPFWKEVYGDSILGPPSGSGEHSVL

SEQ ID NO: 16494 - protein, 299 aa, unidentified
MDTYEEEESVASTSGVQDLQTLSELVGPEAAGEGEDTLSDTEEVSRRSRKNTKRGAKMITFHAYKEIEDKNPQNLKLHNWIPTPEEMSKSICSKFILHGLYSAEKVIEILNMPFEISWDQSETNPKCFIVSYTCIYCSAIIHEPMPVTYNADVGVWVKFNRLRGVVGSAVFMMKKHEKNCCFIKPSPSKQEGPKPRPRHDPVLRCKAFERNYKPRPKRPRPGSISNEPCASSSDPLAVQPGSLCTDPVWDPAAILQVLSEQRENSQSLAIHMSGGPFWEEVYGDSYMGPPTGPGDHTVL

SEQ ID NO: 16495 - protein, 305 aa, unidentified
MAAQQEKTELKEFLAEFPFNDPDDDLWVPVNIPPAPFQPYADPCDKEEGEYLLPKEQVFTTPSEAETSEDNDPLPGTSTAVNRSTGEEPKFKWLQVARRETDYDRFDLGKFFPDRLQREFILQRAILTAAGYQPTLVEHCAKMGWYACLQPHHGALGETTEVYYKCLKCGSEQWDPLLYIWDKHMLMFKRAWTRTPHTSSPLSNLRRHDAICPGLNPLLPYSSTEPLLRKPRRDPGDRWRERKRKISGGGPTAVLPADTFAHAFEWPQFKRMHSSNLGAVPILVQTLQSKCARFEMETHQDRGIV

SEQ ID NO: 16496 - protein, 305 aa, unidentified
MAAQQEETELKEFLAEFPFNDPDDDLWVPVNIPPAPFQPYADPHDEEEGEYLLPKEQVFTTPSEAETSERDDPLPGTSTTINEPTGEEPKFKWLQVARRETDYDRFDLGRFFPDRLQREFILQRAILTAAGYQPTLVEHCAKMGWYACLQPHHGALGETTEVYYKCLKCGSEQWDPLLYIWDKHMLMFKRAWTRTPHTSSPLSNLRRHDAICPGLNPLLPHSSTEPLLRKPRRDPGDRWRERKRKISRGGPTAVLPADTFTYASEWPQPERMHSGGLGTVPILVQTMQSKCARFEMETLQNRGIV

SEQ ID NO: 16497 - protein, 300 aa, unidentified
MDSYEKEESVASTSGIQDLQTLSELVGPENAGEGELTIAEEPEENPRRPRRYTKREVKCVSYHAYKEIEDKHPQHIKLQDWIPTPEEMSKSLCKRLILCGLYSAEKASEILRMPFTVSWEQSDTDPDCFIVSYTCIFCDAVIHDPMPIRWDPEVGIWVKYKPLRGIVGSAVFIMHKHQRNCSLVKPSTSRSEGPKPRPRHDPVLRCDMFEKHHKPRQKRPRRRSIDNESCASSSDTMANEPGSLCTNPLWNPGPLLSGLLEESSNLPNLEVHMSGGPFWEEVYGDSILGPPSGSGEHSVL

SEQ ID NO: 16498 - DNA, 10717 bp, synthetic construct
  source 1..10717: mol_type = other DNA
gaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctccccccccccctccccacccccaattttgtatttatttattttttaattattttgtgcagcgatgggggcgggggggggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgcgctgccttcgccccgtgccccgctccgccgccgcctcgcgccgcccgccccggctctgactgaccgcgttactcccacaggtgagcgggcgggacggcccttctcctccgggctgtaattagcgcttggtttaatgacggcttgtttcttttctgtggctgcgtgaaagccttgaggggctccgggagggccctttgtgcggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcgtcggtcgggctgcaaccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattcgggccgcgttgacgcgcacggcaagaggcgaggggcggcgactggtgagagatgggtgcgagagcgtcagtattaagcgggggagaattagatcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaaaaaagcacagcaagcagcagctgacacaggacacagcaatcaggtcagccaaaattaccctatagtgcagaacatccaggggcaaatggtacatcaggccatatcacctagaactttaaatgcatgggtaaaagtagtagaagagaaggctttcagcccagaagtgatacccatgttttcagcattatcagaaggagccaccccacaagatttaaacaccatgctaaacacagtggggggacatcaagcagccatgcaaatgttaaaagagaccatcaatgaggaagctgcagaatgggatagagtgcatccagtgcatgcagggcctattgcaccaggccagatgagagaaccaaggggaagtgacatagcaggaactactagtacccttcaggaacaaataggatggatgacacataatccacctatcccagtaggagaaatctataaaagatggataatcctgggattaaataaaatagtaagaatgtatagccctaccagcattctggacataagacaaggaccaaaggaaccctttagagactatgtagaccgattctataaaactctaagagccgagcaagcttcacaagaggtaaaaaattggatgacagaaaccttgttggtccaaaatgcgaacccagattgtaagactattttaaaagcattgggaccaggagcgacactagaagaaatgatgacagcatgtcagggagtggggggacccggccataaagcaagagttttggctgaagcaatgagccaagtaacaaatccagctaccataatgatacagaaaggcaattttaggaaccaaagaaagactgttaagtgtttcaattgtggcaaagaagggcacatagccaaaaattgcagggcccctaggaaaaagggctgttggaaatgtggaaaggaaggacaccaaatgaaagattgtactgagagacaggctaattttttagggaagatctggccttcccacaagggaaggccagggaattttcttcagagcagaccagagccaacagccccaccagaagagagcttcaggtttggggaagagacaacaactccctctcagaagcaggagccgatagacaaggaactgtatcctttagcttccctcagatcactctttggcagcgacccctcgtcacaataaagataggggggcaattaaaggaagctctattagatacaggagcagatgatacagtattagaagaaatgaatttgccaggaagatggaaaccaaaaatgatagggggaattggaggttttatcaaagtaagacagtatgatcagatactcatagaaatctgcggacataaagctataggtacagtattagtaggacctacacctgtcaacataattggaagaaatctgttgactcagattggctgcactttaaattttcccattagtcctattgagactgtaccagtaaaattaaagccaggaatggatggcccaaaagttaaacaatggccattgacagaagaaaaaataaaagcattagtagaaatttgtacagaaatggaaaaggaaggaaaaatttcaaaaattgggcctgaaaatccatacaatactccagtatttgccataaagaaaaaagacagtactaaatggagaaaattagtagatttcagagaacttaataagagaactcaagatttctgggaagttcaattaggaataccacatcctgcagggttaaaacagaaaaaatcagtaacagtactggatgtgggcgatgcatatttttcagttcccttagataaagacttcaggaagtatactgcatttaccatacctagtataaacaatgagacaccagggattagatatcagtacaatgtgcttccacagggatggaaaggatcaccagcaatattccagtgtagcatgacaaaaatcttagagccttttagaaaacaaaatccagacatagtcatctatcaatacatggatgatttgtatgtaggatctgacttagaaatagggcagcatagaacaaaaatagaggaactgagacaacatctgttgaggtggggatttaccacaccagacaaaaaacatcagaaagaacctccattcctttggatgggttatgaactccatcctgataaatggacagtacagcctatagtgctgccagaaaaggacagctggactgtcaatgacatacagaaattagtgggaaaattgaattgggcaagtcagatttatgcagggattaaagtaaggcaattatgtaaacttcttaggggaaccaaagcactaacagaagtagtaccactaacagaagaagcagagctagaactggcagaaaacagggagattctaaaagaaccggtacatggagtgtattatgacccatcaaaagacttaatagcagaaatacagaagcaggggcaaggccaatggacatatcaaatttatcaagagccatttaaaaatctgaaaacaggaaagtatgcaagaatgaagggtgcccacactaatgatgtgaaacaattaacagaggcagtacaaaaaatagccacagaaagcatagtaatatggggaaagactcctaaatttaaattacccatacaaaaggaaacatgggaagcatggtggacagagtattggcaagccacctggattcctgagtgggagtttgtcaatacccctcccttagtgaagttatggtaccagttagagaaagaacccataataggagcagaaactttctatgtagatggggcagccaatagggaaactaaattaggaaaagcaggatatgtaactgacagaggaagacaaaaagttgtccccctaacggacacaacaaatcagaagactgagttacaagcaattcatctagctttgcaggattcgggattagaagtaaacatagtgacagactcacaatatgcattgggaatcattcaagcacaaccagataagagtgaatcagagttagtcagtcaaataatagagcagttaataaaaaaggaaaaagtctacctggcatgggtaccagcacacaaaggaattggaggaaatgaacaagtagataaattggtcagtgctggaatcaggaaagtactatttttagatggaatagataaggcccaagaagaacatgagaaatatcacagtaattggagagcaatggctagtgattttaacctaccacctgtagtagcaaaagaaatagtagccagctgtgataaatgtcagctaaaaggggaagccatgcatggacaagtagactgtagcccaggaatatggcagctagattgtacacatttagaaggaaaagttatcttggtagcagttcatgtagccagtggatatatagaagcagaagtaattccagcagagacagggcaagaaacagcatacttcctcttaaaattagcaggaagatggccagtaaaaacagtacatacagacaatggcagcaatttcaccagtactacagttaaggccgcctgttggtgggcggggatcaagcaggaatttggcattccctacaatccccaaagtcaaggagtaatagaatctatgaataaagaattaaagaaaattataggacaggtaagagatcaggctgaacatcttaagacagcagtacaaatggcagtattcatccacaattttaaaagaaaaggggggattggggggtacagtgcaggggaaagaatagtagacataatagcaacagacatacaaactaaagaattacaaaaacaaattacaaaaattcaaaattttcgggtttattacagggacagcagagatccagtttggaaaggaccagcaaagctcctctggaaaggtgaaggggcagtagtaatacaagataatagtgacataaaagtagtgccaagaagaaaagcaaagatcatcagggattatggaaaacagatggcaggtgatgattgtgtggcaagtagacaggatgaggattaacacatggaattctgcaacaactgctgtttatccatttcagaattgggtgtcgacatagcagaataggcgttactcgacagaggagagcaagaaatggagccagtagatcctagactagagccctggaagcatccaggaagtcagcctaaaactgcttgtaccaattgctattgtaaaaagtgttgctttcattgccaagtttgtttcatgacaaaagccttaggcatctcctatggcaggaagaagcggagacagcgacgaagagctcatcagaacagtcagactcatcaagcttctctatcaaagcagtaagtagtacatgtaatgcaacctataatagtagcaatagtagcattagtagtagcaataataatagcaatagttgtgtggtccatagtaatcatagaatataggaaaatggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatccttggcacttatctgggacgatctgcggagcctgtgcctcttcagctaccaccgcttgagagacttactcttgattgtaacgaggattgtggaacttctgggacgcagggggtgggaagccctcaaatattggtggaatctcctacaatattggagtcaggagctaaagaatagtgctgttagcttgctcaatgccacagccatagcagtagctgaggggacagatagggttatagaagtagtacaaggagcttgtagagctattcgccacatacctagaagaataagacagggcttggaaaggattttgctataagctcgaaacaaccggtacctctagaactatagctagcagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaa

SEQ ID NO: 16499 - DNA, 9869 bp, synthetic construct
  source 1..9869: mol_type = other DNA
tggaagggctaattcactcccaaagaagacaagatatccttgatctgtggatctaccacacacaaggctacttccctgattagcagaactacacaccagggccaggggtcagatatccactgacctttggatggtgctacaagctagtaccagttgagccagataaggtagaagaggccaataaaggagagaacaccagcttgttacaccctgtgagcctgcatgggatggatgacccggagagagaagtgttagagtggaggtttgacagccgcctagcatttcatcacgtggcccgagagctgcatccggagtacttcaagaactgctgatatcgagcttgctacaagggactttccgctggggactttccagggaggcgtggcctgggcgggactggggagtggcgagccctcagatcctgcatataagcagctgctttttgcctgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcgcctttaaaagaaaaggggggattggggggtacagtgcaggggaaagaatagtagacataatagcaacagacatacaaactaaagaattacaaaaacaaattacaaaaattcaaaattttcgggtttattacagggacagcagagatccagtttatcgataagcttgggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgactctactagattaattaagttgtttaaacttaagcttggtaccgagctcggatccactagtccagtgtggtggaattctgcagatatcacaagtttgtacaaaaaagttggcatgagcgagctgatcaaggagaacatgcacatgaagctgtacatggagggcaccgtgaacaaccaccacttcaagtgcacatccgagggcgaaggcaagccctacgagggcacccagaccatgaagatcaaggtggtcgagggcggccctctccccttcgccttcgacatcctggctaccagcttcatgtacggcagcaaagccttcatcaaccacacccagggcatccccgacttctttaagcagtccttccctgagggcttcacatgggagagaatcaccacatacgaagacgggggcgtgctgaccgctacccaggacaccagcttccagaacggctgcatcatctacaacgtcaagatcaacggggtgaacttcccatccaacggccctgtgatgcagaagaaaacacgcggctgggaggccaacaccgagatgctgtaccccgctgacggcggcctgagaggccacagccagatggccctgaagctcgtgggcgggggctacctgcactgctccttcaagaccacatacagatccaagaaacccgctaagaacctcaagatgcccggcttccacttcgtggaccacagactggaaagaatcaaggaggccgacaaagagacctacgtcgagcagcacgagatggctgtggccaagtactgcgacctccctagcaaactggggcacagatgatacccaactttcttgtacaaagtggttgctagctaatgaaccgggcgcgccccgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtgcacatgctttacatgtgtttagtcgaggttaaaaaaacgtctaggccccccgaaccacggggacgtggttttcctttgaaaaacacgataataccatgcccaagaagaagagaaaggtggagagcgacgagagcggcctgcccgccatggagatcgagtgccgcatcaccggcaccctgaacggcgtggagttcgagctggtgggcggcggagagggcacccccgagcagggccgcatgaccaacaagatgaagagcaccaaaggcgccctgaccttcagcccctacctgctgagccacgtgatgggctacggcttctaccacttcggcacctaccccagcggctacgagaaccccttcctgcacgccatcaacaacggcggctacaccaacacccgcatcgagaagtacgaggacggcggcgtgctgcacgtgagcttcagctaccgctacgaggccggccgcgtgatcggcgacttcaaggtgatgggcaccggcttccccgaggacagcgtgatcttcaccgacaagatcatccgcagcaacgccaccgtggagcacctgcaccccatgggcgataacgatctggatggcagcttcacccgcaccttcagcctgcgcgacggcggctactacagctccgtggtggacagccacatgcacttcaagagcgccatccaccccagcatcctgcagaacgggggccccatgttcgccttccgccgcgtggaggaggatcacagcaacaccgagctgggcatcgtggagtaccagcacgccttcaagaccccggatgcagatgccggtgaagaaagatctcgagctcaagcttcgaattctgcagtcgagcagctgttgaattttgaccttcttaagcttgcgggagacgtcgagtccaaccctgggcccggtaccaggagggccaccatgaagaccttcaacatctctcagcaggatctggagctggtggaggtcgccactgagaagatcaccatgctctatgaggacaacaagcaccatgtcggggcggccatcaggaccaagactggggagatcatctctgctgtccacattgaggcctacattggcagggtcactgtctgtgctgaagccattgccattgggtctgctgtgagcaacgggcagaaggactttgacaccattgtggctgtcaggcacccctactctgatgaggtggacagatccatcagggtggtcagcccctgtggcatgtgcagagagctgatctctgactatgctcctgactgctttgtgctcattgagatgaatggcaagctggtcaaaaccaccattgaggaactcatccccctcaagtacaccaggaactaataataagttaaccaatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaagctgacgtcctttccatggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcctggaattaattctgcagtcgagacctagaaaaacatggagcaatcacaagtagcaatacagcagctaccaatgctgattgtgcctggctagaagcacaagaggaggaggaggtgggtttttccagtcacacctcaggtacctttaagaccaatgacttacaaggcagctgtagatcttagccactttttaaaagaaaagaggggactggaagggctaattcactcccaacgaagacaagatctgctttttgcttgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtagtagttcatgtcatcttattattcagtatttataacttgcaaagaaatgaatatcagagagtgagaggccttgacattgtttaaacccgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattaattctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcagcacgtgatgaaaaagcctgaactcaccgcgacgtcatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtcgacggatcgggagatcaacttgtttattgcagcttataatggttacaaataaagcaatagcatcacaaatttcacaaataaagcatttttttcactgcattctagttgtggtttgtccaaactcatcaatgtatcttatcatgtctggatcaactggataactcaagctaaccaaaatcatcccaaacttcccaccccataccctattaccactgccaattacctgtggtttcatttactctaaacctgtgattcctctgaattattttcattttaaagaaattgtatttgttaaatatgtactacaaacttagtagt

SEQ ID NO: 16500 - DNA, 4180 bp, synthetic construct
  source 1..4180: mol_type = other DNA
ggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgacatgattacgaattcgatgtacgggccagatatacgcgtatctgaggggactagggtgtgtttaggcgaaaagcggggcttcggttgtacgcggttaggagtcccctcaggatatagtagtttcgcttttgcatagggagggggaaatgtagtcttatgcaatactcttgtagtcttgcaacatggtaacgatgagttagcaacatgccttacaaggagagaaaaagcaccgtgcatgccgattggtggaagtaaggtggtacgatcgtgccttattaggaaggcaacagacgggtctgacatggattggacgaaccactgaattccgcattgcagagatattgtatttaagtgcctagctcgatacaataaacgccatttgaccattcaccacattggtgtgcacctccaagctcgagctcgtttagtgaaccgtcagatcgcctggagacgccatccacgctgttttgacctccatagaagacaccgggaccgatccagcctcccctcgaagctagtcgattaggcatctcctatggcaggaagaagcggagacagcgacgaagacctcctcaaggcagtcagactcatcaagtttctctatcaaagcaacccacctcccaatcccgaggggacccgacaggcccgaaggaatagaagaagaaggtggagagagagacagagacagatccattcgattagtgaacggatccttagcacttatctgggacgatctgcggagcctgtgcctcttcagctaccaccgcttgagagacttactcttgattgtaacgaggattgtggaacttctgggacgcagggggtgggaagccctcaaatattggtggaatctcctacaatattggagtcaggagctaaagaatagtgctgttagcttgctcaatgccacagctatagcagtagctgaggggacagatagggttatagaagtagtacaagaagcttggcactggccgtcgttttacaacgtcgtgatctgagcctgggagatctctggctaactagggaacccactgcttaagcctcaataaagcttgccttgagtgcttcaagtagtgtgtgcccgtctgttgtgtgactctggtaactagagatcaggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatacgtcaaagcaaccatagtacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgatttgggtgatggttcacgtagtgggccatcgccctgatagacggtttttcgccctttgacgttggagtccacgttctttaatagtggactcttgttccaaactggaacaacactcaaccctatctcgggctattcttttgatttataagggattttgccgatttcggcctattggttaaaaaatgagctgatttaacaaaaatttaacgcgaattttaacaaaatattaacgtttacaattttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagt

SEQ ID NO: 16501 - DNA, 8890 bp, synthetic construct
  source 1..8890: mol_type = other DNA
tcaacatggcggtaatgttggacatgagccaatataaatgtacatattatgatatggatacaacgtatgcaatgggccaagctcatggctgactaattttttttatttatgcagaggccgaggccggatcctctagcccatgggggccccctcaggggatccacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcagatctgcggccgcactagtgctagactgccatgtcgagggattccgggtcactgtgagtgggggaggcagggaagaagggctcacaggacagtcaaaccatgccccctgtttttccttcttcaagtagacctctataagacaacagagacaactaaggctgagtggccaggcgaggagaaaccatctcgccgtaaaacatggaaggaacacttcaggggaaaggtggtatctctaagcaagagaactgagtggagtcaaggctgagagatgcaggataagcaaatgggtagtgaaaagacattcatgaggacagctaaaacaataagtaatgtaaaatacagcatagcaaaactttaacctccaaatcaagcctctacttgaatccttttctgagggatgaataaggcataggcatcaggggctgttgccaatgtgcattagctgtttgcagcctcaccttctttcatggagtttaagatatagtgtattttcccaaggtttgaactagctcttcatttctttatgttttaaatgcactgacctcccacattccctttttagtaaaatattcagaaataatttaaatacatcattgcaatgaaaataaatgttttttattaggcagaatccagatgctcaaggcccttcataatatcccccagtttagtagttggacttagggaacaaaggaacctttaatagaaattggacagcaagaaagcgagcttagtgatacttgtgggccagggcattagccacaccagccaccactttctgataggcagcctgcactggtggggtgaattccgcggaagcttgtgtaattgttaatttctctgtcccactccatccaggtcgtgtgattccaaatctgttccagagatttattactccaactagcattccaaggcacagcagtggtgcaaatgagttttccagagcaaccccaaatccccaggagctgttgatcctttaggtatctttccacagccaggattcttgcctggagctgcttgatgccccagactgtgagttgcaacagatgctgttgcgcctcaatagccctcagcaaattgttctgctgctgcactataccagacaataattgtctggcctgtaccgtcagcgtcattgacgctgcgcccatagtgcttcctgctgctcccaagaacccaaggaacaaagctcctgcggccgctccggaattccatgtgttaatcctcatcctgtctacttgccacacaatcatcacctgccatctgttttccataatccctgatgatctttgcttttcttcttggcactacttttatgtcactattatcttgtattactactgccccttcacctttccagaggagctttgctggtcctttccaaactggatctctgctgtccctgtaataaacccgaaaattttgaatttttgtaatttgtttttgtaattctttagtttgtatgtctgttgctattatgtctactattctttcccctgcactgtaccccccaatccccccttttcttttaaaattgtggatgaatactgccatttgtactgctgtcttaagatgttcagcctgatctcttacctgtcctataattttctttaattctttattcatagattctattactccttgactttggggattgtagggaatgccaaattcctgcttgatccccgcccaccaacaggcggccttaactgtagtactggtgaaattgctgccattgtctgtatgtactgtttttactggccatcttcctgctaattttaagaggaagtatgctgtttcttgccctgtctctgctggaattacttctgcttctatatatccactggctacatgaactgctaccaagataacttttccttctaaatgtgtacaatctagctgccatattcctgggctacagtctacttgtccatgcatggcttccccttttagctgacatttatcacagctggctactatttcttttgctactacaggtggtaggttaaaatcactagccattgctctccaattactgtgatatttctcatgttcttcttgggccttatctattccatctaaaaatagtactttcctgattccagcactgaccaatttatctacttgttcatttcctccaattcctttgtgtgctggtacccatgccaggtagactttttccttttttattaactgctctattatttgactgactaactctgattcactcttatctggttgtgcttgaatgattcccaatgcatattgtgagtctgtcactatgtttacttctaatcccgaatcctgcaaagctagatgaattgcttgtaactcagtcttctgatttgttgtgtccgttagggggacaactttttgtcttcctctgtcagttacatatcctgcttttcctaatttagtttccctattggctgccccatctacatagaaagtttctgctcctattatgggttctttctctaactggtaccataacttcactaagggaggggtattgacaaactcccactcaggaatccaggtggcttgccaatactctgtccaccatgcttcccatgtttccttttgtatgggtaatttaaatttaggagtctttccccatattactatgctttctgtggctattttttgtactgcctctgttaattgtttcacatcattagtgtgggcacccttcattcttgcatactttcctgttttcagatttttaaatggctcttgataaatttgatatgtccattggccttgcccctgcttctgtatttctgctattaagtcttttgatgggtcataatacactccatgtaccggttcttttagaatctccctgttttctgccagttctagctctgcttcttctgttagtggtactacttctgttagtgctttggttcccctaagaagtttacataattgccttactttaatccctgcataaatctgacttgcccaattcaattttcccactaatttctgtatgtcattgacagtccagctgtccttttctggcagcactataggctgtactgtccatttatcaggatggagttcataacccatccaaaggaatggaggttctttctgatgttttttgtctggtgtggtaaatccccacctcaacagatgttgtctcagttcctctatttttgttctatgctgccctatttctaagtcagatcctacatacaaatcatccatgtattgatagatgactatgtctggattttgttttctaaaaggctctaagatttttgtcatgctacactggaatattgctggtgatcctttccatccctgtggaagcacattgtactgatatctaatccctggtgtctcattgtttatactaggtatggtaaatgcagtatacttcctgaagtctttatctaagggaactgaaaaatatgcatcgcccacatccagtactgttactgattttttctgttttaaccctgcaggatgtggtattcctaattgaacttcccagaaatcttgagttctcttattaagttctctgaaatctactaattttctccatttagtactgtcttttttctttatggcaaatactggagtattgtatggattttcaggcccaatttttgaaatttttccttccttttccatttctgtacaaatttctactaatgcttttattttttcttctgtcaatggccattgtttaacttttgggccatccattcctggctttaattttactggtacagtctcaataggactaatgggaaaatttaaagtgcagccaatctgagtcaacagatttcttccaattatgttgacaggtgtaggtcctactaatactgtacctatagctttatgtccgcagatttctatgagtatctgatcatactgtcttactttgataaaacctccaattccccctatcatttttggtttccatcttcctggcaaattcatttcttctaatactgtatcatctgctcctgtatctaatagagcttcctttaattgcccccctatctttattgtgacgaggggtcgctgccaaagagtgatctgagggaagctaaaggatacagttccttgtctatcggctcctgcttctgagagggagttgttgtctcttccccaaacctgaagctctcttctggtggggctgttggctctggtctgctctgaagaaaattccctggccttcccttgtgggaaggccagatcttccctaaaaaattagcctgtctctcagtacaatctttcatttggtgtccttcctttccacatttccaacagccctttttcctaggggccctgcaatttttggctatgtgcccttctttgccacaattgaaacacttaacagtctttctttggttcctaaaattgcctttctgtatcattatggtagctggatttgttacttggctcattgcttcagccaaaactcttgctttatggccgggtccccccactccctgacatgctgtcatcatttcttctagtgtcgctcctggtcccaatgcttttaaaatagtcttacaatctgggttcgcattttggaccaacaaggtttctgtcatccaattttttacctcttgtgaagcttgctcggctcttagagttttatagaatcggtctacatagtctctaaagggttcctttggtccttgtcttatgtccagaatgctggtagggctatacattcttactattttatttaatcccaggattatccatcttttatagatttctcctactgggataggtggattatgtgtcatccatcctatttgttcctgaagggtactagtagttcctgctatgtcacttccccttggttctctcatctggcctggtgcaataggccctgcatgcactggatgcactctatcccattctgcagcttcctcattgatggtctcttttaacatttgcatggctgcttgatgtccccccactgtgtttagcatggtgtttaaatcttgtggggtggctccttctgataatgctgaaaacatgggtatcacttctgggctgaaagccttctcttctactacttttacccatgcatttaaagttctaggtgatatggcctgatgtaccatttgcccctggatgttctgcactatagggtaattttggctgacctgattgctgtgtcctgtgtcagctgctgcttgctgtgcttttttcttacttttgttttgctcttcctctatcttgtctaaagcttccttggtgtcttttatctctatcctttgatgcacacaatagagggttgctactgtattatataatgatctaagttcttctgatcctgtctgaagggatggttgtagctgtcccagtatttgtctacagccttctgatgtttctaacaggccaggattaactgcgaatcgttctagctccctgcttgcccatactatatgttttaatttatattttttctttccccctggccttaaccgaattttttcccatcgatctaattctcccccgcttaatactgacgctctcgcacccatggcggcggcagatctcgaattcagatctcacgtgctttgccaaagtgatgggccagcacacagaccagcacgttgcccaggagctgtgggaggaagataagaggtatgaacatgattagcaaaagggcctagcttggactcagaataatccagccttatcccaaccataaaataaaagcagaatggtagctggattgtagctgctattagcaatatgaaacctcttacatcagttacaatttatatgcagaaatatttatatgcagaaatattgctattgccttaacccagaaattatcactgttattctttagaatggtgcaaagaggcatgatacattgtatcattattgccctgaaagaaagagattagggaaagtattagaaataagataaacaaaaaagtatattaaaagaagaaagcattttttaaaattacaaatgcaaaattaccctgatttggtcaatatgtgtaccctgttacttctccccttcctatgacatgaacttaaccatagaaaagaaggggaaagaaaacatcaagggtcccatagactcaccctgaagttctcaggatccgagctcggtaccacatgtaagcttcgaggggaggctggatcggtcccggtgtcttctatggaggtcaaaacagcgtggatggcgtctccaggcgatctgacggttcactaaacgagctctgcttatatagacctcccaccgtacacgcctaccgcccatttgcgtcaatggggcggagttgttacgacattttggaaagtcccgttgattttggtgccaaaacaaactcccattgacgtcaatggggtggagacttggaaatccccgtgagtcaaaccgctatccacgcccattgatgtactgccaaaaccgcatcaccatggtaatagcgatgactaatacgtagatgtactgccaagtaggaaagtcccataaggtcatgtactgggcataatgccaggcgggccatttaccgtcattgacgtcaatagggggcgtacttggcatatgatacacttgatgtactgccaagtgggcagtttaccgtaaatactccacccattgacgtcaatggaaagtccctattggcgttactatgggaacatacgtcattattgacgtcaatgggcgggggtcgttgggcggtcagccaggcgggccatttaccgtaagttatgtaacgcggaactccatatatgggctatgaactaatgaccccgtaattgattactattaataactagtcaataatcaatg

SEQ ID NO: 16502 - DNA, 9118 bp, synthetic construct
  source 1..9118: mol_type = other DNA
tgctctggaaaactcatttgcaccactgctgtgccgcggccgcaaaaaaggggctcgtccctgtttccggaggaatttgcaagcggggtcttgcatgacggggaggcaaacccccgttcggccgcagtccggccggcccgagactcgaaccgggggtcctgcgactcaacccttggaaaataaccctccggctacagggagcgagccacttaatgctttcgctttccagcctaaccgcttacgccgcgcgcgccagtggccaaaaaagctagcgcagcagccgccgcgcctggaaggaagccaaaaggagcgctcccccgttgtctgacgtcgcacacctgggttcgacacgcgggcggtaaccgcatggatcacggcggacggccggatccggggttcgaaccccggtcgtccgccatgatacccttgcgaatttatccaccagaccacggaagagtgcccgcggccgcttcgagcagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggagatgtgggaggttttttaaagcaagtaaaacctctacaaatgtggtaaaatcgataaggatccgggctggcgtaatagcgaagaggcccgcaccgatcgcccttcccaacagttgcgcagcctgaatggcgaatggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagagctttacggcacctcgaccgcaaaaaacttgatttgggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaatatttaacgcgaattttaacaaaatattaacgtttacaatttcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatggctcgacagatcttcaatattggccattagccatattattcattggttatatagcataaatcaatattggctattggccattgcatacgttgtatctatatcataatatgtacatttatattggctcatgtccaatatgaccgccatgttggcattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatggtgatgcggttttggcagtacaccaatgggcgtggatagcggtttgactcacggggatttccaagtctccaccccattgacgtcaatgggagtttgttttggcaccaaaatcaacgggactttccaaaatgtcgtaataaccccgccccgttgacgcaaatgggcggtaggcgtgtacggtgggaggtctatataagcagagctcgtttagtgaaccgtcagatcactagaagctttattgcggtagtttatcacagttaaattgctaacgcagtcagtgcttctgacacaacagtctcgaacttaagctgcagaagttggtcgtgaggcactgggcaggtaagtatcaaggttacaagacaggtttaaggagaccaatagaaactgggcttgtcgagacagagaagactcttgcgtttctgataggcacctattggtcttactgacatccactttgcctttctctccacaggtgtccactcccagttcaattacagctcttaaggctagagtacttaatacgactcactataggctagcctcgagaattcacgcgcacggcaagaggcgaggggcggcgactggtgagtacgccaggatccgcggatccatgggcgcccgcgccagcgtgctgtccggcggcgagctggataaatgggaaaaaattcggttaaggccagggggaaagaaacaatataaactaaaacatatagtatgggcaagcagggagctagaacgattcgcagttaatcctggccttttagagacatcagaaggctgtagacaaatactgggacagctacaaccatcccttcagacaggatcagaagaacttagatcattatataatacaatagcagtcctctattgtgtgcatcaaaggatagatgtaaaagacaccaaggaagccttagataagatagaggaagagcaaaacaaaagtaagaaaaaggcacagcaagcagcagctgacacaggaaacaacagccaggtcagccaaaattaccctatagtgcagaacctccaggggcaaatggtacatcaggccatatcacctagaactttaaatgcatgggtaaaagtagtagaagagaaggctttcagcccagaagtaatacccatgttttcagcattatcagaaggagccaccccacaagatttaaataccatgctaaacacagtggggggacatcaagcagccatgcaaatgttaaaagagaccatcaatgaggaagctgcagaatgggatagattgcatccagtgcatgcagggcctattgcaccaggccagatgagagaaccaaggggaagtgacatagcaggaactactagtacccttcaggaacaaataggatggatgacacataatccacctatcccagtaggagaaatctataaaagatggataatcctgggattaaataaaatagtaagaatgtatagccctaccagcattctggacataagacaaggaccaaaggaaccctttagagactatgtagaccgattctataaaactctaagagccgagcaagcttcacaagaggtaaaaaattggatgacagaaaccttgttggtccaaaatgcgaacccagattgtaagactattttaaaagcattgggaccaggagcgacactagaagaaatgatgacagcatgtcagggagtggggggacccggccataaagcaagagttttggctgaagcaatgagccaagtaacaaatccagctaccataatgatacagaaaggcaattttaggaaccaaagaaagactgttaagtgtttcaattgtggcaaagaagggcacatagccaaaaattgcagggcccctaggaaaaagggctgttggaaatgtggaaaggaaggacaccaaatgaaagattgtactgagagacaggctaattttttagggaagatctggccttcccacaagggaaggccagggaattttcttcagagcagaccagagccaacagccccaccagaagagagcttcaggtttggggaagagacaacaactccctctcagaagcaggagccgatagacaaggaactgtatcctttagcttccctcagatcactctttggcagcgacccctcgtcacaataaagataggggggcaattaaaggaagctctattagatacaggagcagatgatacagtattagaagaaatgaatttgccaggaagatggaaaccaaaaatgatagggggaattggaggttttatcaaagtaggacagtatgatcagatactcatagaaatctgcggacataaagctataggtacagtattagtaggacctacacctgtcaacataattggaagaaatctgttgactcagattggctgcactttaaattttcccattagtcctattgagactgtaccagtaaaattaaagccaggaatggatggcccaaaagttaaacaatggccattgacagaagaaaaaataaaagcattagtagaaatttgtacagaaatggaaaaggaaggaaaaatttcaaaaattgggcctgaaaatccatacaatactccagtatttgccataaagaaaaaagacagtactaaatggagaaaattagtagatttcagagaacttaataagagaactcaagatttctgggaagttcaattaggaataccacatcctgcagggttaaaacagaaaaaatcagtaacagtactggatgtgggcgatgcatatttttcagttcccttagataaagacttcaggaagtatactgcatttaccatacctagtataaacaatgagacaccagggattagatatcagtacaatgtgcttccacagggatggaaaggatcaccagcaatattccagtgtagcatgacaaaaatcttagagccttttagaaaacaaaatccagacatagtcatctatcaatacatggatgatttgtatgtaggatctgacttagaaatagggcagcatagaacaaaaatagaggaactgagacaacatctgttgaggtggggatttaccacaccagacaaaaaacatcagaaagaacctccattcctttggatgggttatgaactccatcctgataaatggacagtacagcctatagtgctgccagaaaaggacagctggactgtcaatgacatacagaaattagtgggaaaattgaattgggcaagtcagatttatgcagggattaaagtaaggcaattatgtaaacttcttaggggaaccaaagcactaacagaagtagtaccactaacagaagaagcagagctagaactggcagaaaacagggagattctaaaagaaccggtacatggagtgtattatgacccatcaaaagacttaatagcagaaatacagaagcaggggcaaggccaatggacatatcaaatttatcaagagccatttaaaaatctgaaaacaggaaaatatgcaagaatgaagggtgcccacactaatgatgtgaaacaattaacagaggcagtacaaaaaatagccacagaaagcatagtaatatggggaaagactcctaaatttaaattacccatacaaaaggaaacatgggaagcatggtggacagagtattggcaagccacctggattcctgagtgggagtttgtcaatacccctcccttagtgaagttatggtaccagttagagaaagaacccataataggagcagaaactttctatgtagatggggcagccaatagggaaactaaattaggaaaagcaggatatgtaactgacagaggaagacaaaaagttgtccccctaacggacacaacaaatcagaagactgagttacaagcaattcatctagctttgcaggattcgggattagaagtaaacatagtgacagactcacaatatgcattgggaatcattcaagcacaaccagataagagtgaatcagagttagtcagtcaaataatagagcagttaataaaaaaggaaaaagtctacctggcatgggtaccagcacacaaaggaattggaggaaatgaacaagtagataaattggtcagtgctggaatcaggaaagtactatttttagatggaatagataaggcccaagaagaacatgagaaatatcacagtaattggagagcaatggctagtgattttaacctaccacctgtagtagcaaaagaaatagtagccagctgtgataaatgtcagctaaaaggggaagccatgcatggacaagtagactgtagcccaggaatatggcagctagattgtacacatttagaaggaaaagttatcttggtagcagttcatgtagccagtggatatatagaagcagaagtaattccagcagagacagggcaagaaacagcatacttcctcttaaaattagcaggaagatggccagtaaaaacagtacatacagacaatggcagcaatttcaccagtactacagttaaggccgcctgttggtgggcggggatcaagcaggaatttggcattccctacaatccccaaagtcaaggagtaatagaatctatgaataaagaattaaagaaaattataggacaggtaagagatcaggctgaacatcttaagacagcagtacaaatggcagtattcatccacaattttaaaagaaaaggggggattggggggtacagtgcaggggaaagaatagtagacataatagcaacagacatacaaactaaagaattacaaaaacaaattacaaaaattcaaaattttcgggtttattacagggacagcagagatccagtttggaaaggaccagcaaagctcctctggaaaggtgaaggggcagtagtaatacaagataatagtgacataaaagtagtgccaagaagaaaagcaaagatcatcagggattatggaaaacagatggcaggtgatgattgtgtggcaagtagacaggatgaggattaacacccatagaatggccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctgatatagtgcagcagcagaacaatttgctgagggctattgaggcgcaacagcatctgttgcaactcacagtctggggcatcaaacagctccaggcaagaatcctggctgtggaaagatacctaaaggatcaacagctcctggggatttggggt

SEQ ID NO: 16503 - DNA, 7753 bp, synthetic construct
  source 1..7753: mol_type = other DNA
cgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtcgacggatcgggagatcaacttgtttattgcagcttataatggttacaaataaagcaatagcatcacaaatttcacaaataaagcatttttttcactgcattctagttgtggtttgtccaaactcatcaatgtatcttatcatgtctggatcaactggataactcaagctaaccaaaatcatcccaaacttcccaccccataccctattaccactgccaattaccctgtggcgcaattaaccctcactaaagggaacaaaagctggagctgcaagcttaatgtagtcttatgcaatactcttgtagtcttgcaacatggtaacgatgagttagcaacatgccttacaaggagagaaaaagcaccgtgcatgccgattggtggaagtaaggtggtacgatcgtgccttattaggaaggcaacagacgggtctgacatggattggacgaaccactgaattgccgcattgcagagatattgtatttaagtgcctagctcgatacataaacgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccggccgctgatcttcagacctggaggaggagatatgagggacaattaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcgcctttaaaagaaaaggggggattggggggtacagtgcaggggaaagaatagtagacataatagcaacagacatacaaactaaagaattacaaaaacaaattacaaaaattcaaaattttcgggtttattacagggacagcagagatccagtttatctaatacgactcactatagggagagagagagaattaccctcactaaagggaggagaagcatgaattcttgggggagtaattcatacaaaaggactcgcccctgccttggggaatcccagggaccgtcgttaaactcccactaacgtagaacccagagatcgctgcgttcccgccccctcacccgcccgctctcgtcatcactgaggtggagaagagcatgcgtgaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacgcccctggctgcagtacgtgattcttgatcccgagcttcgggttggaagtgggtgggagagttcgaggccttgcgcttaaggagccccttcgcctcgtgcttgagttgaggcctggcttgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgaactagaagctttattgcggtagtttatcacagttaaattgctaacgcagtcagtgcttctgacacaacagtctcggccgccaccatgactgccctgaccgaaggtgctaagctgtttgagaaggagattccgtacatcaccgagctggaaggggacgtcgaaggaatgaagttcatcatcaagggagaaggaaccggggacgctacgactggaaccattaaggccaagtatatctgtaccactggagatctgccagtgccttgggccacccttgtgtcaaccctctcgtatggagtgcagtgttttgctaagtaccctagccacattaaggacttcttcaaatccgccatgccggaaggttatacccaagagcgcaccatttcttttgagggagatggagtgtacaagacccgcgcgatggtcacctatgagaggggatctatctacaaccgggtgactctgactggagaaaactttaagaaggacgggcatattcttcggaagaatgtcgccttccagtgccctcccagcatcctttacattctccccgacactgtgaacaacggaatccgcgtggagttcaatcaagcctacgacatcgagggggtgacggagaagctggtgaccaagtgtagccagatgaatcggccactggccggttcagcggctgtccacattccgcgctaccatcatatcacttatcacactaagctctccaaagaccgcgatgagaggagagatcacatgtgcctggtggaagtggtcaaggccgtcgatctcgatacctatcagtaaacgcgtctggaacaatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaagctgacgtcctttccatggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcctggaattaattctgcagtcgagacctagaaaaacatggagcaatcacaagtagcaatacagcagctaccaatgctgattgtgcctggctagaagcacaagaggaggaggaggtgggttttccagtcacacctcaggacctttaagaccaatgacttacaaggcagctgtagatcttagccactttttaaaagaaaagaggggactggaagggctaattcactcccaacgaagacaagatctgctttttgcctgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtagtagttcatgtcatcttattattcagtatttataacttgcaaagaaatgaatatcagagagtgagaggctaacgttttaccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaa

SEQ ID NO: 16504 - DNA, 9241 bp, synthetic construct
  source 1..9241: mol_type = other DNA
tggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcgcctttaaaagaaaaggggggattggggggtacagtgcaggggaaagaatagtagacataatagcaacagacatacaaactaaagaattacaaaaacaaattacaaaaattcaaaattttcgggtttattacagggacagcagagatccagtttatctaatacgactcactatagggagagagagagaattaccctcactaaagggaggagaagcatgaattcttgggggagtaattcatacaaaaggactcgcccctgccttggggaatcccagggaccgtcgttaaactcccactaacgtagaacccagagatcgctgcgttcccgccccctcacccgcccgctctcgtcatcactgaggtggagaagagcatgcgtgaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacgcccctggctgcagtacgtgattcttgatcccgagcttcgggttggaagtgggtgggagagttcgaggccttgcgcttaaggagccccttcgcctcgtgcttgagttgaggcctggcttgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgaactagaagctttattgcggtagtttatcacagttaaattgctaacgcagtcagtgcttctgacacaacagtctcggccgccaccatggagacagacacactcctgctatgggtactgctgctctgggttccaggttccactggtgacgtgcagatcacgcagtccccaagctacttggccgcatcgccaggcgaaaccatcacaatcaactgccgcgcttcaaagagtatttccaaagacctcgcctggtatcaggagaagcccggcaagaccaataaactgctgatttatagtggatcaaccctgcaatccgggatacccagcagattctccggctcaggcagtggcactgacttcacattaaccataagtagcctcgagccggaagattttgccatgtattattgtcagcagcataataagtacccttatacatttgggggtggcactaagcttgaaattaaaggaggaggtggctccggaggtgggggctcatctggcggaggcagccaagtgcagctgcaacagcccggtgctgagctggtccggcctggcgcgtcggtcaaactctcctgtaaggcgtcaggttacacctttactagctactggatgaattgggtaaaacagaggccagaccagggactagagtggatcggacgaattgacccttacgacagcgaaacacactacaaccagaagttcaaagacaaggcaatcctgaccgtggataagtccagctctacggcctacatgcaactgtctagccttacctcagaggattccgccgtttactactgcgctagggggaactgggatgattattggggtcagggaacaacattgactgtgagctctgcatccagtgaacagaagctgattagtgaagaggacctcgaaagtaagtacggcccgccatgccccccttgcccaatgttctgggtgctcgtggtagtgggaggagtactggcctgttactctcttctcgttactgttgcgttcatcattttttgggtgcggtcaaagcgctcccgcggtgggcactcggattatatgaacatgactcccaggcggcctggcccaacaaggaagcactatcagccgtacgctcctccccgcgattttgccgcatacaggagcagagtgaagttttcgcggtcagcggacgctccagcctaccaacagggccaaaaccaactgtacaacgaactgaatctgggaagacgtgaagagtacgatgttttggacaaacgacgtggacgcgatccagagatgggtgggaaacccagacgaaaaaaccctcaggagggcctgtacaatgagttgcagaaagacaagatggcagaggcttattcagagatcggtatgaaaggagagagaaggaggggaaagggtcatgatggtctgtaccagggattgtccaccgccacaaaagacacatatgacgccctgcatatgcaggcactaccacctcggggcagcggcgcgaccaactttagcctgctgaaacaggcgggcgatgtggaagaaaacccaggaccgatgactgccctgaccgaaggtgctaagctgtttgagaaggagattccgtacatcaccgagctggaaggggacgtcgaaggaatgaagttcatcatcaagggagaaggaaccggggacgctacgactggaaccattaaggccaagtatatctgtaccactggagatctgccagtgccttgggccacccttgtgtcaaccctctcgtatggagtgcagtgttttgctaagtaccctagccacattaaggacttcttcaaatccgccatgccggaaggttatacccaagagcgcaccatttcttttgagggagatggagtgtacaagacccgcgcgatggtcacctatgagaggggatctatctacaaccgggtgactctgactggagaaaactttaagaaggacgggcatattcttcggaagaatgtcgccttccagtgccctcccagcatcctttacattctccccgacactgtgaacaacggaatccgcgtggagttcaatcaagcctacgacatcgagggggtgacggagaagctggtgaccaagtgtagccagatgaatcggccactggccggttcagcggctgtccacattccgcgctaccatcatatcacttatcacactaagctctccaaagaccgcgatgagaggagagatcacatgtgcctggtggaagtggtcaaggccgtcgatctcgatacctatcagtaaacgcgtctggaacaatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaagctgacgtcctttccatggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcctggaattaattctgcagtcgagacctagaaaaacatggagcaatcacaagtagcaatacagcagctaccaatgctgattgtgcctggctagaagcacaagaggaggaggaggtgggttttccagtcacacctcaggacctttaagaccaatgacttacaaggcagctgtagatcttagccactttttaaaagaaaagaggggactggaagggctaattcactcccaacgaagacaagatctgctttttgcctgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtagtagttcatgtcatcttattattcagtatttataacttgcaaagaaatgaatatcagagagtgagaggctaacgttttaccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggaagaaatgaatatcagagagtgagaggctaacgggttccgcgcacatttccccgaaaagtgccacctgacgtcgacggatcgggagatcaacttgtttattgcagcttataatggttacaaataaagcaatagcatcacaaatttcacaaataaagcatttttttcactgcattctagttgtggtttgtccaaactcatcaatgtatcttatcatgtctggatcaactggataactcaagctaaccaaaatcatcccaaacttcccaccccataccctattaccactgccaattaccctgtggcgcaattaaccctcactaaagggaacaaaagctggagctgcaagcttaatgtagtcttatgcaatactcttgtagtcttgcaacatggtaacgatgagttagcaacatgccttacaaggagagaaaaagcaccgtgcatgccgattggtggaagtaaggtggtacgatcgtgccttattaggaaggcaacagacgggtctgacatggattggacgaaccactgaattgccgcattgcagagatattgtatttaagtgcctagctcgatacataaacgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccggccgctgatcttcagacctggaggaggagatatgagggacaattaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagt

SEQ ID NO: 16505 - DNA, 9265 bp, synthetic construct
  source 1..9265: mol_type = other DNA
tggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcgcctttaaaagaaaaggggggattggggggtacagtgcaggggaaagaatagtagacataatagcaacagacatacaaactaaagaattacaaaaacaaattacaaaaattcaaaattttcgggtttattacagggacagcagagatccagtttatctaatacgactcactatagggagagagagagaattaccctcactaaagggaggagaagcatgaattcttgggggagtaattcatacaaaaggactcgcccctgccttggggaatcccagggaccgtcgttaaactcccactaacgtagaacccagagatcgctgcgttcccgccccctcacccgcccgctctcgtcatcactgaggtggagaagagcatgcgtgaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacgcccctggctgcagtacgtgattcttgatcccgagcttcgggttggaagtgggtgggagagttcgaggccttgcgcttaaggagccccttcgcctcgtgcttgagttgaggcctggcttgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgaactagaagctttattgcggtagtttatcacagttaaattgctaacgcagtcagtgcttctgacacaacagtctcggccgccaccatggagacagacacactcctgctatgggtactgctgctctgggttccaggttccactggtgacatcgtgcttacacagagtcccgctatactgtctgcctcccctggggaaaaagtgaccatgacgtgccgcgcctcttctagcgtcaattatatggactggtaccagaagaagcctggttcctctccaaaaccctggatttacgccactagtaacttagcaagcggggtccccgctcgattctctggaagcggcagcgggactagttatagcctcactatcagcagagtggaggctgaggacgcagctacgtattattgccagcagtggagcttcaatcccccgacattcggcggtggcaccaagcttgaaattaaaggctcaacgtctggcggcggctcgggcggcgggtctgggggcggaggaagctcagaagtgcaattacagcagtccggggcagaactcgtcaagccaggagcaagcgtaaagatgtcctgtaaagcgtccgggtataccttcacctcctacaatatgcactgggtcaagcagacccctggccaaggactagagtggataggggccatctaccccggtaacggggacaccagctataatcaaaaatttaagggcaaagctaccctcacagctgataagagcagtagtactgcgtacatgcagctgtccagcctgacatcagaggattctgccgattattactgtgcccggtcaaactattatgggtccagctactggttctttgacgtctggggcgccgggaccaccgttacagtgtcatcctccagtgaacagaagctgattagtgaagaggacctcgaaagtaagtacggcccgccatgccccccttgcccaatgttctgggtgctcgtggtagtgggaggagtactggcctgttactctcttctcgttactgttgcgttcatcattttttgggtgcggtcaaagcgctcccgcggtgggcactcggattatatgaacatgactcccaggcggcctggcccaacaaggaagcactatcagccgtacgctcctccccgcgattttgccgcatacaggagcagagtgaagttttcgcggtcagcggacgccccagcctaccaacagggccaaaaccaactgtacaacgaactgaatctgggaagacgtgaagagtacgatgttttggacaaacgacgtggacgcgatccagagatgggtgggaaacccagacgaaaaaaccctcaggagggcctgtacaatgagttgcagaaagacaagatggcagaggcttattcagagatcggtatgaaaggagagagaaggaggggaaagggtcatgatggtctgtaccagggattgtccaccgccacaaaagacacatatgacgccctgcatatgcaggcactaccacctcggggcagcggcgcgaccaactttagcctgctgaaacaggcgggcgatgtggaagaaaacccaggaccgatgactgccctgaccgaaggtgctaagctgtttgagaaggagattccgtacatcaccgagctggaaggggacgtcgaaggaatgaagttcatcatcaagggagaaggaaccggggacgctacgactggaaccattaaggccaagtatatctgtaccactggagatctgccagtgccttgggccacccttgtgtcaaccctctcgtatggagtgcagtgttttgctaagtaccctagccacattaaggacttcttcaaatccgccatgccggaaggttatacccaagagcgcaccatttcttttgagggagatggagtgtacaagacccgcgcgatggtcacctatgagaggggatctatctacaaccgggtgactctgactggagaaaactttaagaaggacgggcatattcttcggaagaatgtcgccttccagtgccctcccagcatcctttacattctccccgacactgtgaacaacggaatccgcgtggagttcaatcaagcctacgacatcgagggggtgacggagaagctggtgaccaagtgtagccagatgaatcggccactggccggttcagcggctgtccacattccgcgctaccatcatatcacttatcacactaagctctccaaagaccgcgatgagaggagagatcacatgtgcctggtggaagtggtcaaggccgtcgatctcgatacctatcagtaaacgcgtctggaacaatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaagctgacgtcctttccatggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcctggaattaattctgcagtcgagacctagaaaaacatggagcaatcacaagtagcaatacagcagctaccaatgctgattgtgcctggctagaagcacaagaggaggaggaggtgggttttccagtcacacctcaggacctttaagaccaatgacttacaaggcagctgtagatcttagccactttttaaaagaaaagaggggactggaagggctaattcactcccaacgaagacaagatctgctttttgcctgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtagtagttcatgtcatcttattattcagtatttataacttgcaaagaaatgaatatcagagagtgagaggctaacgttttaccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggaagaaatgaatatcagagagtgagaggctaacgggttccgcgcacatttccccgaaaagtgccacctgacgtcgacggatcgggagatcaacttgtttattgcagcttataatggttacaaataaagcaatagcatcacaaatttcacaaataaagcatttttttcactgcattctagttgtggtttgtccaaactcatcaatgtatcttatcatgtctggatcaactggataactcaagctaaccaaaatcatcccaaacttcccaccccataccctattaccactgccaattaccctgtggcgcaattaaccctcactaaagggaacaaaagctggagctgcaagcttaatgtagtcttatgcaatactcttgtagtcttgcaacatggtaacgatgagttagcaacatgccttacaaggagagaaaaagcaccgtgcatgccgattggtggaagtaaggtggtacgatcgtgccttattaggaaggcaacagacgggtctgacatggattggacgaaccactgaattgccgcattgcagagatattgtatttaagtgcctagctcgatacataaacgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccggccgctgatcttcagacctggaggaggagatatgagggacaattaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagt

SEQ ID NO: 16506 - DNA, 9355 bp, synthetic construct
  source 1..9355: mol_type = other DNA
cagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggaagaaatgaatatcagagagtgagaggctaacgggttccgcgcacatttccccgaaaagtgccacctgacgtcgacggatcgggagatcaacttgtttattgcagcttataatggttacaaataaagcaatagcatcacaaatttcacaaataaagcatttttttcactgcattctagttgtggtttgtccaaactcatcaatgtatcttatcatgtctggatcaactggataactcaagctaaccaaaatcatcccaaacttcccaccccataccctattaccactgccaattaccctgtggcgcaattaaccctcactaaagggaacaaaagctggagctgcaagcttaatgtagtcttatgcaatactcttgtagtcttgcaacatggtaacgatgagttagcaacatgccttacaaggagagaaaaagcaccgtgcatgccgattggtggaagtaaggtggtacgatcgtgccttattaggaaggcaacagacgggtctgacatggattggacgaaccactgaattgccgcattgcagagatattgtatttaagtgcctagctcgatacataaacgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccggccgctgatcttcagacctggaggaggagatatgagggacaattaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcgcctttaaaagaaaaggggggattggggggtacagtgcaggggaaagaatagtagacataatagcaacagacatacaaactaaagaattacaaaaacaaattacaaaaattcaaaattttcgggtttattacagggacagcagagatccagtttatctaatacgactcactatagggagagagagagaattaccctcactaaagggaggagaagcatgaattcttgggggagtaattcatacaaaaggactcgcccctgccttggggaatcccagggaccgtcgttaaactcccactaacgtagaacccagagatcgctgcgttcccgccccctcacccgcccgctctcgtcatcactgaggtggagaagagcatgcgtgaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacgcccctggctgcagtacgtgattcttgatcccgagcttcgggttggaagtgggtgggagagttcgaggccttgcgcttaaggagccccttcgcctcgtgcttgagttgaggcctggcttgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgaactagaagctttattgcggtagtttatcacagttaaattgctaacgcagtcagtgcttctgacacaacagtctcggccgccaccatggagacagacacactcctgctatgggtactgctgctctgggttccaggttccactggtgacgacatccagatgacccaaacaaccagctcactctcggcatcgttaggcgaccgtgtaactatcagctgtagggccagtcaggacattagcaaatatctgaattggtaccaacaaaagcccgacgggaccgttaaacttctcatatatcacacttctcgactgcacagcggggtaccatccagattttctggctcaggctcagggacagattacagcctcacaatcagcaatctggagcaggaggatattgccacatacttctgtcagcagggtaataccttgccttacacctttggtggcggaacgaaactagaaataaagggaggaggtggcagtggaggaggagggtctggtgggggagggagtggtggaggaggatcaggaggaggatcagaggtcaaattgcaggaatctggtcccgggctcgtggcaccatcccagtcccttagtgtcacctgcacggtgagtggggtgtccctgcccgactacggagtgtcctggattcggcagcctccgaggaagggactggaatggctgggtgtcatctggggctctgagaccacttactataacagtgctctgaagagccgcttgaccatcattaaggataactccaagtctcaagtgttcttaaagatgaactctctgcagactgatgacactgcgatctattattgcgctaaacattattactacggcggatcctatgccatggattactgggggcagggaacatcagttacagtgagctcatcctctgaacagaaacttatctctgaggaggatctcattgagttcatgtatccaccgccatacctggataatgaaaggagcaacggaactataattcacatcaaggagaagcacctgtgccatactcagtcgagccctaagctgttttgggcattggtggtggttgccggcgtgctgttctgttacgggttactagtcactgtagccctttgtgtgatatggacaaacagtagaagaaacagggggggacagagcgactacatgaacatgaccccacggagaccaggcctcacacgcaaaccctaccaaccttatgcacccgcgcgggatttcgccgcctacaggccacgcgccaaatttagccgctctgcggagacagccgctaacttacaggatcctaaccagctctataacgagctcaatctgggccgacgagaagagtatgacgtgctggaaaagaagcgggctagagaccccgagatgggcggcaaacaacagcgcagaagaaatccccaggagggcgtgtataatgcgcttcaaaaggataagatggcagaggcttactccgaaatcggtacaaagggtgaacggcgtagggggaaagggcacgacggactgtatcagggtctgagcactgctaccaaagatacgtacgacgccttacatatgcaaacacttgcccctcgtggcagcggcgcgaccaactttagcctgctgaaacaggcgggcgatgtggaagaaaacccaggaccgatgactgccctgaccgaaggtgctaagctgtttgagaaggagattccgtacatcaccgagctggaaggggacgtcgaaggaatgaagttcatcatcaagggagaaggaaccggggacgctacgactggaaccattaaggccaagtatatctgtaccactggagatctgccagtgccttgggccacccttgtgtcaaccctctcgtatggagtgcagtgttttgctaagtaccctagccacattaaggacttcttcaaatccgccatgccggaaggttatacccaagagcgcaccatttcttttgagggagatggagtgtacaagacccgcgcgatggtcacctatgagaggggatctatctacaaccgggtgactctgactggagaaaactttaagaaggacgggcatattcttcggaagaatgtcgccttccagtgccctcccagcatcctttacattctccccgacactgtgaacaacggaatccgcgtggagttcaatcaagcctacgacatcgagggggtgacggagaagctggtgaccaagtgtagccagatgaatcggccactggccggttcagcggctgtccacattccgcgctaccatcatatcacttatcacactaagctctccaaagaccgcgatgagaggagagatcacatgtgcctggtggaagtggtcaaggccgtcgatctcgatacctatcagtaaacgcgtctggaacaatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaagctgacgtcctttccatggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcctggaattaattctgcagtcgagacctagaaaaacatggagcaatcacaagtagcaatacagcagctaccaatgctgattgtgcctggctagaagcacaagaggaggaggaggtgggttttccagtcacacctcaggacctttaagaccaatgacttacaaggcagctgtagatcttagccactttttaaaagaaaagaggggactggaagggctaattcactcccaacgaagacaagatctgctttttgcctgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtagtagttcatgtcatcttattattcagtatttataacttgcaaagaaatgaatatcagagagtgagaggctaacgttttaccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctga

SEQ ID NO: 16507 - DNA, 9277 bp, synthetic construct
  source 1..9277: mol_type = other DNA
tggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcgcctttaaaagaaaaggggggattggggggtacagtgcaggggaaagaatagtagacataatagcaacagacatacaaactaaagaattacaaaaacaaattacaaaaattcaaaattttcgggtttattacagggacagcagagatccagtttatctaatacgactcactatagggagagagagagaattaccctcactaaagggaggagaagcatgaattcttgggggagtaattcatacaaaaggactcgcccctgccttggggaatcccagggaccgtcgttaaactcccactaacgtagaacccagagatcgctgcgttcccgccccctcacccgcccgctctcgtcatcactgaggtggagaagagcatgcgtgaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacgcccctggctgcagtacgtgattcttgatcccgagcttcgggttggaagtgggtgggagagttcgaggccttgcgcttaaggagccccttcgcctcgtgcttgagttgaggcctggcttgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgaactagaagctttattgcggtagtttatcacagttaaattgctaacgcagtcagtgcttctgacacaacagtctcggccgccaccatggagacagacacactcctgctatgggtactgctgctctgggttccaggttccactggttcctcagagctgacgcaggaccccgcagtgagcgtcgcattaggacaaaccgtcagaatcacctgccaaggggactccctgaggagttattacgccagctggtatcagcagaagccaggccaggcaccagtgttggtaatttacgggaagaataaccgtccaagcggtattcctgatcggttctcgggatcatctagtggaaataccgcctcccttacaatcactggtgctcaggccgaggacgaagctgattactactgcaactctcgggactccagcgggaaccctcccgtcgtttttgggggtgggactaagcttactgttctggggtcccgcggaggaggtggctccggaggtgggggctcaggcggcggagggtccctggaaatggcacaggtgcagctcgtcgagagcgggggtggcctagtgcacccgggagggagcctgaggctcagttgtgccgcctcaggctttacattcagatcacatagcatgaactgggttcggcaggcacccggcaaaggcctggagtgggtaagtagtatatccagcgatagcacctacacctattacgccgactccgtgaagggccgcttcacaatcagccgagataacgccaaaaatagtctctatctccagatgaattcactgagagctgaagacactgcggtgtactattgtgctaggtccgggggacaatggaaatactatgattactggggacagggaaccctcgttacagttagcagttccagtgaacagaagctgattagtgaagaggacctcgaaagtaagtacggcccgccatgccccccttgcccaatgttctgggtgctcgtggtagtgggaggagtactggcctgttactctcttctcgttactgttgcgttcatcattttttgggtgcggtcaaagcgctcccgcggtgggcactcggattatatgaacatgactcccaggcggcctggcccaacaaggaagcactatcagccgtacgctcctccccgcgattttgccgcatacaggagcagagtgaagttttcgcggtcagcggacgccccagcctaccaacagggccaaaaccaactgtacaacgaactgaatctgggaagacgtgaagagtacgatgttttggacaaacgacgtggacgcgatccagagatgggtgggaaacccagacgaaaaaaccctcaggagggcctgtacaatgagttgcagaaagacaagatggcagaggcttattcagagatcggtatgaaaggagagagaaggaggggaaagggtcatgatggtctgtaccagggattgtccaccgccacaaaagacacatatgacgccctgcatatgcaggcactaccacctcggggcagcggcgcgaccaactttagcctgctgaaacaggcgggcgatgtggaagaaaacccaggaccgatgactgccctgaccgaaggtgctaagctgtttgagaaggagattccgtacatcaccgagctggaaggggacgtcgaaggaatgaagttcatcatcaagggagaaggaaccggggacgctacgactggaaccattaaggccaagtatatctgtaccactggagatctgccagtgccttgggccacccttgtgtcaaccctctcgtatggagtgcagtgttttgctaagtaccctagccacattaaggacttcttcaaatccgccatgccggaaggttatacccaagagcgcaccatttcttttgagggagatggagtgtacaagacccgcgcgatggtcacctatgagaggggatctatctacaaccgggtgactctgactggagaaaactttaagaaggacgggcatattcttcggaagaatgtcgccttccagtgccctcccagcatcctttacattctccccgacactgtgaacaacggaatccgcgtggagttcaatcaagcctacgacatcgagggggtgacggagaagctggtgaccaagtgtagccagatgaatcggccactggccggttcagcggctgtccacattccgcgctaccatcatatcacttatcacactaagctctccaaagaccgcgatgagaggagagatcacatgtgcctggtggaagtggtcaaggccgtcgatctcgatacctatcagtaaacgcgtctggaacaatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaagctgacgtcctttccatggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcctggaattaattctgcagtcgagacctagaaaaacatggagcaatcacaagtagcaatacagcagctaccaatgctgattgtgcctggctagaagcacaagaggaggaggaggtgggttttccagtcacacctcaggacctttaagaccaatgacttacaaggcagctgtagatcttagccactttttaaaagaaaagaggggactggaagggctaattcactcccaacgaagacaagatctgctttttgcctgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtagtagttcatgtcatcttattattcagtatttataacttgcaaagaaatgaatatcagagagtgagaggctaacgttttaccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggaagaaatgaatatcagagagtgagaggctaacgggttccgcgcacatttccccgaaaagtgccacctgacgtcgacggatcgggagatcaacttgtttattgcagcttataatggttacaaataaagcaatagcatcacaaatttcacaaataaagcatttttttcactgcattctagttgtggtttgtccaaactcatcaatgtatcttatcatgtctggatcaactggataactcaagctaaccaaaatcatcccaaacttcccaccccataccctattaccactgccaattaccctgtggcgcaattaaccctcactaaagggaacaaaagctggagctgcaagcttaatgtagtcttatgcaatactcttgtagtcttgcaacatggtaacgatgagttagcaacatgccttacaaggagagaaaaagcaccgtgcatgccgattggtggaagtaaggtggtacgatcgtgccttattaggaaggcaacagacgggtctgacatggattggacgaaccactgaattgccgcattgcagagatattgtatttaagtgcctagctcgatacataaacgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccggccgctgatcttcagacctggaggaggagatatgagggacaattaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagt

SEQ ID NO: 16508 - DNA, 9277 bp, synthetic construct
  source 1..9277: mol_type = other DNA
tggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcgcctttaaaagaaaaggggggattggggggtacagtgcaggggaaagaatagtagacataatagcaacagacatacaaactaaagaattacaaaaacaaattacaaaaattcaaaattttcgggtttattacagggacagcagagatccagtttatctaatacgactcactatagggagagagagagaattaccctcactaaagggaggagaagcatgaattcttgggggagtaattcatacaaaaggactcgcccctgccttggggaatcccagggaccgtcgttaaactcccactaacgtagaacccagagatcgctgcgttcccgccccctcacccgcccgctctcgtcatcactgaggtggagaagagcatgcgtgaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacgcccctggctgcagtacgtgattcttgatcccgagcttcgggttggaagtgggtgggagagttcgaggccttgcgcttaaggagccccttcgcctcgtgcttgagttgaggcctggcttgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgaactagaagctttattgcggtagtttatcacagttaaattgctaacgcagtcagtgcttctgacacaacagtctcggccgccaccatggagacagacacactcctgctatgggtactgctgctctgggttccaggttccactggtcaatcggtagtgacgcaaccccctagtatgagtgctgcaccaggacagcaggttactatttcttgctccggtggtaattcaaatatagaaaggaactatgtgagctggtacctccagctaccgggcaccgctcctaaactggtcatcttcgataacgacagacggccctccggaatcccagaccgcttttcgggatccaaaagcggcacaagcgccaccctcggaatcaccggcttgcaaactggggatgaggccgactactactgcggtacctgggacagctccctgcgaggctgggtgttcggcggtgggacaaagctgactgttctggggtcccgcggaggaggtggctccggaggtgggggctcaggcggcggagggtccctggaaatggcagaggtgcagctcgttgaatccggcgggggactgatccagccaggaggatctctgcggttgtcctgtgcagccagtgggtttacattcagcaattacgctatgaactgggtaaggcaggcccccggaaaaggccttgagtgggtcagcaccataaacggacgcggatcttccaccatctatgcggactcagtgaaggggcggtttactatttctcgcgacaacagtaagaatacactatacctgcagatgaacagcttaagggcagaagataccgccacgtactattgtgccagatatatttctcgaggtctgggcgatagctggggacagggaaccctcgttacagttagcagttccagtgaacagaagctgattagtgaagaggacctcgaaagtaagtacggcccgccatgccccccttgcccaatgttctgggtgctcgtggtagtgggaggagtactggcctgttactctcttctcgttactgttgcgttcatcattttttgggtgcggtcaaagcgctcccgcggtgggcactcggattatatgaacatgactcccaggcggcctggcccaacaaggaagcactatcagccgtacgctcctccccgcgattttgccgcatacaggagcagagtgaagttttcgcggtcagcggacgccccagcctaccaacagggccaaaaccaactgtacaacgaactgaatctgggaagacgtgaagagtacgatgttttggacaaacgacgtggacgcgatccagagatgggtgggaaacccagacgaaaaaaccctcaggagggcctgtacaatgagttgcagaaagacaagatggcagaggcttattcagagatcggtatgaaaggagagagaaggaggggaaagggtcatgatggtctgtaccagggattgtccaccgccacaaaagacacatatgacgccctgcatatgcaggcactaccacctcggggcagcggcgcgaccaactttagcctgctgaaacaggcgggcgatgtggaagaaaacccaggaccgatgactgccctgaccgaaggtgctaagctgtttgagaaggagattccgtacatcaccgagctggaaggggacgtcgaaggaatgaagttcatcatcaagggagaaggaaccggggacgctacgactggaaccattaaggccaagtatatctgtaccactggagatctgccagtgccttgggccacccttgtgtcaaccctctcgtatggagtgcagtgttttgctaagtaccctagccacattaaggacttcttcaaatccgccatgccggaaggttatacccaagagcgcaccatttcttttgagggagatggagtgtacaagacccgcgcgatggtcacctatgagaggggatctatctacaaccgggtgactctgactggagaaaactttaagaaggacgggcatattcttcggaagaatgtcgccttccagtgccctcccagcatcctttacattctccccgacactgtgaacaacggaatccgcgtggagttcaatcaagcctacgacatcgagggggtgacggagaagctggtgaccaagtgtagccagatgaatcggccactggccggttcagcggctgtccacattccgcgctaccatcatatcacttatcacactaagctctccaaagaccgcgatgagaggagagatcacatgtgcctggtggaagtggtcaaggccgtcgatctcgatacctatcagtaaacgcgtctggaacaatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaagctgacgtcctttccatggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcctggaattaattctgcagtcgagacctagaaaaacatggagcaatcacaagtagcaatacagcagctaccaatgctgattgtgcctggctagaagcacaagaggaggaggaggtgggttttccagtcacacctcaggacctttaagaccaatgacttacaaggcagctgtagatcttagccactttttaaaagaaaagaggggactggaagggctaattcactcccaacgaagacaagatctgctttttgcctgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtagtagttcatgtcatcttattattcagtatttataacttgcaaagaaatgaatatcagagagtgagaggctaacgttttaccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggaagaaatgaatatcagagagtgagaggctaacgggttccgcgcacatttccccgaaaagtgccacctgacgtcgacggatcgggagatcaacttgtttattgcagcttataatggttacaaataaagcaatagcatcacaaatttcacaaataaagcatttttttcactgcattctagttgtggtttgtccaaactcatcaatgtatcttatcatgtctggatcaactggataactcaagctaaccaaaatcatcccaaacttcccaccccataccctattaccactgccaattaccctgtggcgcaattaaccctcactaaagggaacaaaagctggagctgcaagcttaatgtagtcttatgcaatactcttgtagtcttgcaacatggtaacgatgagttagcaacatgccttacaaggagagaaaaagcaccgtgcatgccgattggtggaagtaaggtggtacgatcgtgccttattaggaaggcaacagacgggtctgacatggattggacgaaccactgaattgccgcattgcagagatattgtatttaagtgcctagctcgatacataaacgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccggccgctgatcttcagacctggaggaggagatatgagggacaattaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagt

SEQ ID NO: 16509 - DNA, 9265 bp, synthetic construct
  source 1..9265: mol_type = other DNA
tggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcgcctttaaaagaaaaggggggattggggggtacagtgcaggggaaagaatagtagacataatagcaacagacatacaaactaaagaattacaaaaacaaattacaaaaattcaaaattttcgggtttattacagggacagcagagatccagtttatctaatacgactcactatagggagagagagagaattaccctcactaaagggaggagaagcatgaattcttgggggagtaattcatacaaaaggactcgcccctgccttggggaatcccagggaccgtcgttaaactcccactaacgtagaacccagagatcgctgcgttcccgccccctcacccgcccgctctcgtcatcactgaggtggagaagagcatgcgtgaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacgcccctggctgcagtacgtgattcttgatcccgagcttcgggttggaagtgggtgggagagttcgaggccttgcgcttaaggagccccttcgcctcgtgcttgagttgaggcctggcttgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgaactagaagctttattgcggtagtttatcacagttaaattgctaacgcagtcagtgcttctgacacaacagtctcggccgccaccatggagacagacacactcctgctatgggtactgctgctctgggttccaggttccactggtcaaagcgtgctgacacagcctgcctctgtctccgggtcgcccggccagtcactaaccatcagctgcacggggacaagtaacgacgtaggcgcatataagtatgtgtcttggtatcaacaatacccggggaaggcgcctaagctgattttgtacgatgtattcaaaagaccaagcggggtgagcaataggttttccggtagcaaatcggacaacacagccagcctgacgatctcaggtcttcaggccgaggacgaagccgattactactgcttcagcctgactagttcaaacacgtacgtctttggaactggcaccaaggtgactgttctggggtcccgcggaggaggtggctccggaggtgggggctcaggcggcggagggtccctggaaatggcacagatgcagttagtgcagtcaggcgctgaagtcaagaaaccaggagctagcgtcaaagtgagttgtaaggcttccggttatactttcaatcggtacgcgataacttgggtgcgacaagcacccgggcagggcctcgagtggatgggctggatcagcgcttataacgggaattcccactacgcccagaaattgcagggccgcgtgacaatgaccacagatacctctaccggcaccgcctacatggagcttcgtcggctcaggtctgacgataccgccgtctactattgtgctagaatggcatatgacagttggggacagggaaccctcgttacagttagcagttccagtgaacagaagctgattagtgaagaggacctcgaaagtaagtacggcccgccatgccccccttgcccaatgttctgggtgctcgtggtagtgggaggagtactggcctgttactctcttctcgttactgttgcgttcatcattttttgggtgcggtcaaagcgctcccgcggtgggcactcggattatatgaacatgactcccaggcggcctggcccaacaaggaagcactatcagccgtacgctcctccccgcgattttgccgcatacaggagcagagtgaagttttcgcggtcagcggacgccccagcctaccaacagggccaaaaccaactgtacaacgaactgaatctgggaagacgtgaagagtacgatgttttggacaaacgacgtggacgcgatccagagatgggtgggaaacccagacgaaaaaaccctcaggagggcctgtacaatgagttgcagaaagacaagatggcagaggcttattcagagatcggtatgaaaggagagagaaggaggggaaagggtcatgatggtctgtaccagggattgtccaccgccacaaaagacacatatgacgccctgcatatgcaggcactaccacctcggggcagcggcgcgaccaactttagcctgctgaaacaggcgggcgatgtggaagaaaacccaggaccgatgactgccctgaccgaaggtgctaagctgtttgagaaggagattccgtacatcaccgagctggaaggggacgtcgaaggaatgaagttcatcatcaagggagaaggaaccggggacgctacgactggaaccattaaggccaagtatatctgtaccactggagatctgccagtgccttgggccacccttgtgtcaaccctctcgtatggagtgcagtgttttgctaagtaccctagccacattaaggacttcttcaaatccgccatgccggaaggttatacccaagagcgcaccatttcttttgagggagatggagtgtacaagacccgcgcgatggtcacctatgagaggggatctatctacaaccgggtgactctgactggagaaaactttaagaaggacgggcatattcttcggaagaatgtcgccttccagtgccctcccagcatcctttacattctccccgacactgtgaacaacggaatccgcgtggagttcaatcaagcctacgacatcgagggggtgacggagaagctggtgaccaagtgtagccagatgaatcggccactggccggttcagcggctgtccacattccgcgctaccatcatatcacttatcacactaagctctccaaagaccgcgatgagaggagagatcacatgtgcctggtggaagtggtcaaggccgtcgatctcgatacctatcagtaaacgcgtctggaacaatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaagctgacgtcctttccatggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcctggaattaattctgcagtcgagacctagaaaaacatggagcaatcacaagtagcaatacagcagctaccaatgctgattgtgcctggctagaagcacaagaggaggaggaggtgggttttccagtcacacctcaggacctttaagaccaatgacttacaaggcagctgtagatcttagccactttttaaaagaaaagaggggactggaagggctaattcactcccaacgaagacaagatctgctttttgcctgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtagtagttcatgtcatcttattattcagtatttataacttgcaaagaaatgaatatcagagagtgagaggctaacgttttaccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggaagaaatgaatatcagagagtgagaggctaacgggttccgcgcacatttccccgaaaagtgccacctgacgtcgacggatcgggagatcaacttgtttattgcagcttataatggttacaaataaagcaatagcatcacaaatttcacaaataaagcatttttttcactgcattctagttgtggtttgtccaaactcatcaatgtatcttatcatgtctggatcaactggataactcaagctaaccaaaatcatcccaaacttcccaccccataccctattaccactgccaattaccctgtggcgcaattaaccctcactaaagggaacaaaagctggagctgcaagcttaatgtagtcttatgcaatactcttgtagtcttgcaacatggtaacgatgagttagcaacatgccttacaaggagagaaaaagcaccgtgcatgccgattggtggaagtaaggtggtacgatcgtgccttattaggaaggcaacagacgggtctgacatggattggacgaaccactgaattgccgcattgcagagatattgtatttaagtgcctagctcgatacataaacgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccggccgctgatcttcagacctggaggaggagatatgagggacaattaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagt

SEQ ID NO: 16510 - DNA, 10020 bp, synthetic construct
  source 1..10020: mol_type = other DNA
tgccctggcccacaagtatcactaagctcgctttcttgctgtccaatttctattaaaggttcctttgttccctaagtccaactactaaactgggggatattatgaagggccttgagcatctggattctgcctaataaaaaacatttattttcattgcaatgatgtatttaaattatttctgaatattttactaaaaagggaatgtgggaggtcagtgcatttaaaacataaagaaatgaagagctagttcaaaccttgggaaaatacactatatcttaaactccatgaaagaaggtgaggctgcaaacagctaatgcacattggcaacagcccctgatgcctatgccttattcatccctcagaaaaggattcaagtagaggcttgatttggaggttaaagttttgctatgctgtattttacattacttattgttttagctgtcctcatgaatgtcttttcactacccatttgcttatcctgcatctctcagccttgactccactcagttctcttgcttagagataccacctttcccctgaagtgttccttccatgttttacggcgagatggtttctcctcgcctggccactcagccttagttgtctctgttgtcttatagaggtctacttgaagaaggaaaaacagggggcatggtttgactgtcctgtgagcccttcttccctgcctcccccactcacagtgacccggaatccctcgacatggcagtctagcactagtgcggccgcagatctgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgggatcccctgagggggcccccatgggctagaggatccggcctcggcctctgcataaataaaaaaaattagtcagccatgagcttggcccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctcccctcgaagcttacatgtggtaccgagctcggatcctgagaacttcagggtgagtctatgggacccttgatgttttctttccccttcttttctatggttaagttcatgtcataggaaggggagaagtaacagggtacacatattgaccaaatcagggtaattttgcatttgtaattttaaaaaatgctttcttcttttaatatacttttttgtttatcttatttctaatactttccctaatctctttctttcagggcaataatgatacaatgtatcatgcctctttgcaccattctaaagaataacagtgataatttctgggttaaggcaatagcaatatttctgcatataaatatttctgcatataaattgtaactgatgtaagaggtttcatattgctaatagcagctacaatccagctaccattctgcttttattttatggttgggataaggctggattattctgagtccaagctaggcccttttgctaatcatgttcatacctcttatcttcctcccacagctcctgggcaacgtgctggtctgtgtgctggcccatcactttggcaaagcacgtgagatctgaattcgagatctgccgccgccatgggtgcgagagcgtcagtattaagcgggggagaattagatcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaaaaaagcacagcaagcagcagctgacacaggacacagcaatcaggtcagccaaaattaccctatagtgcagaacatccaggggcaaatggtacatcaggccatatcacctagaactttaaatgcatgggtaaaagtagtagaagagaaggctttcagcccagaagtgatacccatgttttcagcattatcagaaggagccaccccacaagatttaaacaccatgctaaacacagtggggggacatcaagcagccatgcaaatgttaaaagagaccatcaatgaggaagctgcagaatgggatagagtgcatccagtgcatgcagggcctattgcaccaggccagatgagagaaccaaggggaagtgacatagcaggaactactagtacccttcaggaacaaataggatggatgacacataatccacctatcccagtaggagaaatctataaaagatggataatcctgggattaaataaaatagtaagaatgtatagccctaccagcattctggacataagacaaggaccaaaggaaccctttagagactatgtagaccgattctataaaactctaagagccgagcaagcttcacaagaggtaaaaaattggatgacagaaaccttgttggtccaaaatgcgaacccagattgtaagactattttaaaagcattgggaccaggagcgacactagaagaaatgatgacagcatgtcagggagtggggggacccggccataaagcaagagttttggctgaagcaatgagccaagtaacaaatccagctaccataatgatacagaaaggcaattttaggaaccaaagaaagactgttaagtgtttcaattgtggcaaagaagggcacatagccaaaaattgcagggcccctaggaaaaagggctgttggaaatgtggaaaggaaggacaccaaatgaaagattgtactgagagacaggctaattttttagggaagatctggccttcccacaagggaaggccagggaattttcttcagagcagaccagagccaacagccccaccagaagagagcttcaggtttggggaagagacaacaactccctctcagaagcaggagccgatagacaaggaactgtatcctttagcttccctcagatcactctttggcagcgacccctcgtcacaaaactttagcggaggtagccttcagttgcccccgcttgagcgactcacacttggatcacttcaactgcccccgttggagcgacttacactgggtagtcttcaattgcctcctttggaaagactcactcttagccagaactatccgattgtgcagaccggtatggacaagaagtacagcatcggcctggacatcggcaccaactctgtgggctgggccgtgatcaccgacgagtacaaggtgcccagcaagaaattcaaggtgctgggcaacaccgaccggcacagcatcaagaagaacctgatcggcgccctgctgttcgacagcggagaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggcaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacatcgatggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgccagcgcccagagcttcatcgagcggatgaccaacttcgataagaacctgcccaacgagaaggtgctgcccaagcacagcctgctgtacgagtacttcaccgtgtacaacgagctgaccaaagtgaaatacgtgaccgagggaatgagaaagcccgccttcctgagcggcgagcagaaaaaagccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggaccatatcgtgcctcagagctttctgaaggacgactccatcgataacaaagtgctgactcggagcgacaagaaccggggcaagagcgacaacgtgccctccgaagaggtcgtgaagaagatgaagaactactggcgccagctgctgaatgccaagctgattacccagaggaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaacgacaaactgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaacaggcgagatcgtgtgggataagggccgggactttgccaccgtgcggaaagtgctgtctatgccccaagtgaatatcgtgaaaaagaccgaggtgcagacaggcggcttcagcaaagagtctatcctgcccaagaggaacagcgacaagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaaacactacctggacgagatcatcgagcagatcagcgagttctccaagagagtgatcctggccgacgctaatctggacaaggtgctgagcgcctacaacaagcacagagacaagcctatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggcgacgccgactataaggaccacgacggagactacaaggatcatgatattgattacaaagacgatgacgataagagcctgggcagcggctcccccaagaaaaaacgcaaggtggaagatcctaagaaaaagcggaaagtgtaa

SEQ ID NO: 16511 - DNA, 6589 bp, synthetic construct
  source 1..6589: mol_type = other DNA
gggtgagatctaagaggtcgcgcctattacactcggattacatgaaccgggttaggcaagggtacagctgagctagcttgactgactgagatacagcgtaccttcagctcacagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtattggcccatctctatcggtatcgtagcataaccccttggggcctctaaacgggtcttgaggggttttttgtgcccctcgggccggattgctatctaccggcattggcgcagaaaaaaatgcctgatgcgacgctgcgcgtcttatactcccacatatgccagattcagcaacggatacggcttccccaacttgcccacttccatacgtgtcctccttaccagaaatttatccttaaggtcgtcagctatcctgcaggcgatctctcgatttcgatcaagacattcctttaatggtcttttctggacaccactaggggtcagaagtagttcatcaaactttcttccctccctaatctcattggttaccttgggctatcgaaacttaattaaccagtcaagtcagctacttggcgagatcgacttgtctgggtttcgactacgctcagaattgcgtcagtcaagttcgatctggtccttgctattgcacccgttctccgattacgagtttcatttaaatcatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcatttaaatttccgaactctccaaggccctcgtcggaaaatcttcaaacctttcgtccgatccatcttgcaggctacctctcgaacgaactatcgcaagtctcttggccggccttgcgccttggctattgcttggcagcgcctatcgccaggtattactccaatcccgaatatccgagatcgggatcacccgagagaagttcaacctacatcctcaatcccgatctatccgagatccgaggaatatcgaaatcggggcgcgcctggtgtaccgagaacgatcctctcagtgcgagtctcgacgatccatatcgttgcttggcagtcagccagtcggaatccagcttgggacccaggaagtccaatcgtcagatattgtactcaagcctggtcacggcagcgtaccgatctgtttaaacctagatattgatagtctgatcggtcaacgtataatcgagtcctagcttttgcaaacatctatcaagagacaggatcagcaggaggctttcgcatgagtattcaacatttccgtgtcgcccttattcccttttttgcggcattttgccttcctgtttttgctcacccagaaacgctggtgaaagtaaaagatgctgaagatcagttgggtgcgcgagtgggttacatcgaactggatctcaacagcggtaagatccttgagagttttcgccccgaagaacgctttccaatgatgagcacttttaaagttctgctatgtggcgcggtattatcccgtattgacgccgggcaagagcaactcggtcgccgcatacactattctcagaatgacttggttgagtattcaccagtcacagaaaagcatcttacggatggcatgacagtaagagaattatgcagtgctgccataaccatgagtgataacactgcggccaacttacttctgacaacgattggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaaccttgcgtaaactattaactggcgaactacttactctagcttcccggcaacagttgatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaaccgattctaggtgcattggcgcagaaaaaaatgcctgatgcgacgctgcgcgtcttatactcccacatatgccagattcagcaacggatacggcttccccaacttgcccacttccatacgtgtcctccttaccagaaatttatccttaagatcccgaatcgtttaaactcgactctggctctatcgaatctccgtcgtttcgagcttacgcgaacagccgtggcgctcatttgctcgtcgggcatcgaatctcgtcagctatcgtcagcttacctttttggcagcgatcgcggctcccgacatcttggaccattagctccacaggtatcttcttccctctagtggtcataacagcagcttcagctacctctcaattcaaaaaacccctcaagacccgtttagaggccccaaggggttatgctatcaatcgttgcgttacacacacaaaaaaccaacacacatccatcttcgatggatagcgattttattatctaactgctgatcgagtgtagccagatctagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatgctgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctggtttagtgaaccgtcagatcgcctggagacgccatccacgctgttttgacctccatagaagacaccgggaccgatccagcctcccctcgaagcttacatgtggtaccgagctcggatcctgagaacttcagggtgagtctatgggacccttgatgttttctttccccttcttttctatggttaagttcatgtcataggaaggggagaagtaacagggtacacatattgaccaaatcagggtaattttgcatttgtaattttaaaaaatgctttcttcttttaatatacttttttgtttatcttatttctaatactttccctaatctctttctttcagggcaataatgatacaatgtatcatgcctctttgcaccattctaaagaataacagtgataatttctgggttaaggcaatagcaatatttctgcatataaatatttctgcatataaattgtaactgatgtaagaggtttcatattgctaatagcagctacaatccagctaccattctgcttttattttatggttgggataaggctggattattctgagtccaagctaggcccttttgctaatcatgttcatacctcttatcttcctcccacagctcctgggcaacgtgctggtctgtgtgctggcccatcactttggcaaaggcggccgcgccgccaccatggagacagacacactcctgctatgggtactgctgctctgggttccaggttccactggtgacgacatccagatgactcaatctccttcgtctttgagcgcgtccgtgggggaccgagtgaccattacatgtagagcatcccaacgcggcctccggaacgtcgcagtggcttggtaccagcaaaaaccaggcaaggctcctaagctcctgatctatagcgcgagctcactgtacagtggcgtgccctccaggttcagtgggtcaagaagcggcactgactttacacttactataagcagcttacagccagaggattttgccacatattactgccagcaatgggcagtccacagcctcattacgttcggacagggaaccaaggtggagattaaacgtggaggcggtgggtccggcggagggggttcaggcgggggtggcagcgaagtgcagctagtagaaagcgggggaggcctggtccagcccggaggctctttgagactgtcctgtgcagccagtgggtttaacatctccgtctatatgatgcattgggtgaggcaggcccccggaaagggtctggaatgggtggcctccatatacccgtactcggggtacacttactacgccgatagtgtcaagggtcgcttcacgatctcagctgacacaagtaaaaataccgcctaccttcagatgaatagcctgagggctgaggacaccgctgtatattattgcgcccggtacgtttatcacgccctcgattattggggacagggcaccctggttaccgtttcaagcgaacccaagtcatgcgacaagacgcacacctgccccccctgccctgcacctgaactgttggggggtccttctgtgttcctttttccacccaagccaaaagacaccttaatgattagccggacgcctgaagtcacatgtgtggtggtcgacgtgtcccatgaggacccagaggtgaagttcaattggtacgtggacggggtcgaggtgcacaatgccaaaaccaaaccccgcgaagagcagtacaacagcacttatagggttgtatccgtacttactgtcctgcatcaagactggctgaatggaaaagagtataagtgtaaagtgagcaacaaggccctcccagcccccatcgaaaagactatcagtaaggctaagggccagccccgtgagcctcaggtgtacaccttgccgccttccagagacgaactcacaaaaaatcaagttagtctaacatgtctggtcaagggattctacccgtccgacatcgcggtcgaatgggagtcaaatggacagccagaaaacaactataaaacaactccaccggttctggattccgatggtagctttttcctgtatagtaaactcacagttgataagtctcgatggcagcagggcaacgtgttcagctgcagcgtcatgcacgaggctctccataaccactatacccagaaatctctcagtctgtcccctggaaaaagcggggggtcttccagaggtgagcagaaactgattagtgaggaggatctgatcgaggtcatgtaccccccaccttatctcgataatgaaaagtcaaatggcactataatccacgttaagggcaagcatctttgcccatcacctttgttcccaggaccctcaaaaccattttgggtgctggtggtagtgggcggcgtattggcctgttattctctgcttgtgaccgtggcatttattatatttt

SEQ ID NO: 16512 - DNA, 6610 bp, synthetic construct
  source 1..6610: mol_type = other DNA
gggtgagatctaagaggtcgcgcctattacactcggattacatgaaccgggttaggcaagggtacagctgagctagcttgactgactgagatacagcgtaccttcagctcacagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtattggcccatctctatcggtatcgtagcataaccccttggggcctctaaacgggtcttgaggggttttttgtgcccctcgggccggattgctatctaccggcattggcgcagaaaaaaatgcctgatgcgacgctgcgcgtcttatactcccacatatgccagattcagcaacggatacggcttccccaacttgcccacttccatacgtgtcctccttaccagaaatttatccttaaggtcgtcagctatcctgcaggcgatctctcgatttcgatcaagacattcctttaatggtcttttctggacaccactaggggtcagaagtagttcatcaaactttcttccctccctaatctcattggttaccttgggctatcgaaacttaattaaccagtcaagtcagctacttggcgagatcgacttgtctgggtttcgactacgctcagaattgcgtcagtcaagttcgatctggtccttgctattgcacccgttctccgattacgagtttcatttaaatcatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcatttaaatttccgaactctccaaggccctcgtcggaaaatcttcaaacctttcgtccgatccatcttgcaggctacctctcgaacgaactatcgcaagtctcttggccggccttgcgccttggctattgcttggcagcgcctatcgccaggtattactccaatcccgaatatccgagatcgggatcacccgagagaagttcaacctacatcctcaatcccgatctatccgagatccgaggaatatcgaaatcggggcgcgcctggtgtaccgagaacgatcctctcagtgcgagtctcgacgatccatatcgttgcttggcagtcagccagtcggaatccagcttgggacccaggaagtccaatcgtcagatattgtactcaagcctggtcacggcagcgtaccgatctgtttaaacctagatattgatagtctgatcggtcaacgtataatcgagtcctagcttttgcaaacatctatcaagagacaggatcagcaggaggctttcgcatgagtattcaacatttccgtgtcgcccttattcccttttttgcggcattttgccttcctgtttttgctcacccagaaacgctggtgaaagtaaaagatgctgaagatcagttgggtgcgcgagtgggttacatcgaactggatctcaacagcggtaagatccttgagagttttcgccccgaagaacgctttccaatgatgagcacttttaaagttctgctatgtggcgcggtattatcccgtattgacgccgggcaagagcaactcggtcgccgcatacactattctcagaatgacttggttgagtattcaccagtcacagaaaagcatcttacggatggcatgacagtaagagaattatgcagtgctgccataaccatgagtgataacactgcggccaacttacttctgacaacgattggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaaccttgcgtaaactattaactggcgaactacttactctagcttcccggcaacagttgatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaaccgattctaggtgcattggcgcagaaaaaaatgcctgatgcgacgctgcgcgtcttatactcccacatatgccagattcagcaacggatacggcttccccaacttgcccacttccatacgtgtcctccttaccagaaatttatccttaagatcccgaatcgtttaaactcgactctggctctatcgaatctccgtcgtttcgagcttacgcgaacagccgtggcgctcatttgctcgtcgggcatcgaatctcgtcagctatcgtcagcttacctttttggcagcgatcgcggctcccgacatcttggaccattagctccacaggtatcttcttccctctagtggtcataacagcagcttcagctacctctcaattcaaaaaacccctcaagacccgtttagaggccccaaggggttatgctatcaatcgttgcgttacacacacaaaaaaccaacacacatccatcttcgatggatagcgattttattatctaactgctgatcgagtgtagccagatctagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatgctgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctggtttagtgaaccgtcagatcgcctggagacgccatccacgctgttttgacctccatagaagacaccgggaccgatccagcctcccctcgaagcttacatgtggtaccgagctcggatcctgagaacttcagggtgagtctatgggacccttgatgttttctttccccttcttttctatggttaagttcatgtcataggaaggggagaagtaacagggtacacatattgaccaaatcagggtaattttgcatttgtaattttaaaaaatgctttcttcttttaatatacttttttgtttatcttatttctaatactttccctaatctctttctttcagggcaataatgatacaatgtatcatgcctctttgcaccattctaaagaataacagtgataatttctgggttaaggcaatagcaatatttctgcatataaatatttctgcatataaattgtaactgatgtaagaggtttcatattgctaatagcagctacaatccagctaccattctgcttttattttatggttgggataaggctggattattctgagtccaagctaggcccttttgctaatcatgttcatacctcttatcttcctcccacagctcctgggcaacgtgctggtctgtgtgctggcccatcactttggcaaaggcggccgcgccgccaccatggagacagacacactcctgctatgggtactgctgctctgggttccaggttccactggtatcgatgcaatgggcaacatccaactcgtgcagagtgggcctgaactgaagaaacccggtgagacggttaaaatcagttgcaaagcgtccggctacacctttacaaactacggtatgaactgggtgaaacaggcaccaggcaagggcctccggtggatgggctggattaatactcacactggagaacccacatacgctgatgactttaaagggagattcgccttttccctggagacctctgctagcacagcctatctgcaaataaataatctgaagaacgaagataccgccacttatttctgtactaggaggggatacgactggtacttcgacgtatggggcgcgggaactacggtgaccgtgtcaagcggagggggtggatccggagggggtgggagcgggggcggcggttctgacataaagatgacccagtctccttcatccatgtatgcctctctgggagagagagtcacaattacatgtaaggccagccaggatattaacagctatctatcgtggtttcatcacaagccgggaaagtcaccaaaaaccctcatttaccgggctaatcgccttgtcgatggcgtcccctcacgattctccggcagcgggagcgggcaggactacagcttgaccatcagtagtctggactacgaggatatggggatctactattgccagcagtatgacgagtctccttggaccttcggcggtggaacaaagttagaaatgaagggctccggcgacccagcagaacccaagtcatgcgacaagacgcacacctgccccccctgccctgcacctgaactgttggggggtccttctgtgttcctttttccacccaagccaaaagacaccttaatgattagccggacgcctgaagtcacatgtgtggtggtcgacgtgtcccatgaggacccagaggtgaagttcaattggtacgtggacggggtcgaggtgcacaatgccaaaaccaaaccccgcgaagagcagtacaacagcacttatagggttgtatccgtacttactgtcctgcatcaagactggctgaatggaaaagagtataagtgtaaagtgagcaacaaggccctcccagcccccatcgaaaagactatcagtaaggctaagggccagccccgtgagcctcaggtgtacaccttgccgccttccagagacgaactcacaaaaaatcaagttagtctaacatgtctggtcaagggattctacccgtccgacatcgcggtcgaatgggagtcaaatggacagccagaaaacaactataaaacaactccaccggttctggattccgatggtagctttttcctgtatagtaaactcacagttgataagtctcgatggcagcagggcaacgtgttcagctgcagcgtcatgcacgaggctctccataaccactatacccagaaatctctcagtctgtcccctggaaaaagcggggggtcttccagaggtgagcagaaactgattagtgaggaggatctgatcgaggtcatgtaccccccaccttatctcgataatgaaaagtcaaatggcactataatccacgttaagggcaagcatctttgcccatcacctttgttcccaggaccctcaaaaccattttgggtgctggtggtagtgggcggcgtattggcctgttattctctgcttgtgaccgtggcatttattatatttt

SEQ ID NO: 16513 - DNA, 6589 bp, synthetic construct
  source 1..6589: mol_type = other DNA
gggtgagatctaagaggtcgcgcctattacactcggattacatgaaccgggttaggcaagggtacagctgagctagcttgactgactgagatacagcgtaccttcagctcacagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtattggcccatctctatcggtatcgtagcataaccccttggggcctctaaacgggtcttgaggggttttttgtgcccctcgggccggattgctatctaccggcattggcgcagaaaaaaatgcctgatgcgacgctgcgcgtcttatactcccacatatgccagattcagcaacggatacggcttccccaacttgcccacttccatacgtgtcctccttaccagaaatttatccttaaggtcgtcagctatcctgcaggcgatctctcgatttcgatcaagacattcctttaatggtcttttctggacaccactaggggtcagaagtagttcatcaaactttcttccctccctaatctcattggttaccttgggctatcgaaacttaattaaccagtcaagtcagctacttggcgagatcgacttgtctgggtttcgactacgctcagaattgcgtcagtcaagttcgatctggtccttgctattgcacccgttctccgattacgagtttcatttaaatcatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcatttaaatttccgaactctccaaggccctcgtcggaaaatcttcaaacctttcgtccgatccatcttgcaggctacctctcgaacgaactatcgcaagtctcttggccggccttgcgccttggctattgcttggcagcgcctatcgccaggtattactccaatcccgaatatccgagatcgggatcacccgagagaagttcaacctacatcctcaatcccgatctatccgagatccgaggaatatcgaaatcggggcgcgcctggtgtaccgagaacgatcctctcagtgcgagtctcgacgatccatatcgttgcttggcagtcagccagtcggaatccagcttgggacccaggaagtccaatcgtcagatattgtactcaagcctggtcacggcagcgtaccgatctgtttaaacctagatattgatagtctgatcggtcaacgtataatcgagtcctagcttttgcaaacatctatcaagagacaggatcagcaggaggctttcgcatgagtattcaacatttccgtgtcgcccttattcccttttttgcggcattttgccttcctgtttttgctcacccagaaacgctggtgaaagtaaaagatgctgaagatcagttgggtgcgcgagtgggttacatcgaactggatctcaacagcggtaagatccttgagagttttcgccccgaagaacgctttccaatgatgagcacttttaaagttctgctatgtggcgcggtattatcccgtattgacgccgggcaagagcaactcggtcgccgcatacactattctcagaatgacttggttgagtattcaccagtcacagaaaagcatcttacggatggcatgacagtaagagaattatgcagtgctgccataaccatgagtgataacactgcggccaacttacttctgacaacgattggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaaccttgcgtaaactattaactggcgaactacttactctagcttcccggcaacagttgatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaaccgattctaggtgcattggcgcagaaaaaaatgcctgatgcgacgctgcgcgtcttatactcccacatatgccagattcagcaacggatacggcttccccaacttgcccacttccatacgtgtcctccttaccagaaatttatccttaagatcccgaatcgtttaaactcgactctggctctatcgaatctccgtcgtttcgagcttacgcgaacagccgtggcgctcatttgctcgtcgggcatcgaatctcgtcagctatcgtcagcttacctttttggcagcgatcgcggctcccgacatcttggaccattagctccacaggtatcttcttccctctagtggtcataacagcagcttcagctacctctcaattcaaaaaacccctcaagacccgtttagaggccccaaggggttatgctatcaatcgttgcgttacacacacaaaaaaccaacacacatccatcttcgatggatagcgattttattatctaactgctgatcgagtgtagccagatctagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatgctgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctggtttagtgaaccgtcagatcgcctggagacgccatccacgctgttttgacctccatagaagacaccgggaccgatccagcctcccctcgaagcttacatgtggtaccgagctcggatcctgagaacttcagggtgagtctatgggacccttgatgttttctttccccttcttttctatggttaagttcatgtcataggaaggggagaagtaacagggtacacatattgaccaaatcagggtaattttgcatttgtaattttaaaaaatgctttcttcttttaatatacttttttgtttatcttatttctaatactttccctaatctctttctttcagggcaataatgatacaatgtatcatgcctctttgcaccattctaaagaataacagtgataatttctgggttaaggcaatagcaatatttctgcatataaatatttctgcatataaattgtaactgatgtaagaggtttcatattgctaatagcagctacaatccagctaccattctgcttttattttatggttgggataaggctggattattctgagtccaagctaggcccttttgctaatcatgttcatacctcttatcttcctcccacagctcctgggcaacgtgctggtctgtgtgctggcccatcactttggcaaaggcggccgcgccgccaccatggagacagacacactcctgctatgggtactgctgctctgggttccaggttccactggtgaggtgcagttagttgaatccggcggtggcctcgtgaagccaggagggtcactgaagctaagctgtgccgcttctggattgaccttcagcagttatgccatgagttgggtcaggcagacacctgagaaacgtctcgagtgggtggcttccatctcttccggagggttcacctactaccctgatagcgttaaggggaggtttactatcagccgagacaacgccaggaatatcctgtatcttcagatgtcctcactcagatcagaggacacggctatgtattattgcgcacgcgacgaagtgagaggctacttggatgtatggggcgcaggaactacagtcaccgtgagctctggaggaggtggctccggaggtgggggctcaggcggcggagggtccgcggcctacaaagacatacagatgacccagaccactagtagtttgtccgcgtccctgggcgaccgcgtcaccattagctgttctgcaagccagggtatatccaactatctcaactggtatcaacagaaaccggacggtacggtgaagctgcttatctattacactagctcactgcacagtggggtaccctcccggttttcaggatctggttcggggaccgattactcactaacaatttctaatctggaacccgaagatattgccacatactactgccaacaatactcgaaactgccatacacattcggtggagggacaaagctggagatcaagcgggaacccaagtcatgcgacaagacgcacacctgccccccctgccctgcacctgaactgttggggggtccttctgtgttcctttttccacccaagccaaaagacaccttaatgattagccggacgcctgaagtcacatgtgtggtggtcgacgtgtcccatgaggacccagaggtgaagttcaattggtacgtggacggggtcgaggtgcacaatgccaaaaccaaaccccgcgaagagcagtacaacagcacttatagggttgtatccgtacttactgtcctgcatcaagactggctgaatggaaaagagtataagtgtaaagtgagcaacaaggccctcccagcccccatcgaaaagactatcagtaaggctaagggccagccccgtgagcctcaggtgtacaccttgccgccttccagagacgaactcacaaaaaatcaagttagtctaacatgtctggtcaagggattctacccgtccgacatcgcggtcgaatgggagtcaaatggacagccagaaaacaactataaaacaactccaccggttctggattccgatggtagctttttcctgtatagtaaactcacagttgataagtctcgatggcagcagggcaacgtgttcagctgcagcgtcatgcacgaggctctccataaccactatacccagaaatctctcagtctgtcccctggaaaaagcggggggtcttccagaggtgagcagaaactgattagtgaggaggatctgatcgaggtcatgtaccccccaccttatctcgataatgaaaagtcaaatggcactataatccacgttaagggcaagcatctttgcccatcacctttgttcccaggaccctcaaaaccattttgggtgctggtggtagtgggcggcgtattggcctgttattctctgcttgtgaccgtggcatttattatatttt

SEQ ID NO: 16514 - DNA, 6595 bp, synthetic construct
  source 1..6595: mol_type = other DNA
gggtgagatctaagaggtcgcgcctattacactcggattacatgaaccgggttaggcaagggtacagctgagctagcttgactgactgagatacagcgtaccttcagctcacagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtattggcccatctctatcggtatcgtagcataaccccttggggcctctaaacgggtcttgaggggttttttgtgcccctcgggccggattgctatctaccggcattggcgcagaaaaaaatgcctgatgcgacgctgcgcgtcttatactcccacatatgccagattcagcaacggatacggcttccccaacttgcccacttccatacgtgtcctccttaccagaaatttatccttaaggtcgtcagctatcctgcaggcgatctctcgatttcgatcaagacattcctttaatggtcttttctggacaccactaggggtcagaagtagttcatcaaactttcttccctccctaatctcattggttaccttgggctatcgaaacttaattaaccagtcaagtcagctacttggcgagatcgacttgtctgggtttcgactacgctcagaattgcgtcagtcaagttcgatctggtccttgctattgcacccgttctccgattacgagtttcatttaaatcatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcatttaaatttccgaactctccaaggccctcgtcggaaaatcttcaaacctttcgtccgatccatcttgcaggctacctctcgaacgaactatcgcaagtctcttggccggccttgcgccttggctattgcttggcagcgcctatcgccaggtattactccaatcccgaatatccgagatcgggatcacccgagagaagttcaacctacatcctcaatcccgatctatccgagatccgaggaatatcgaaatcggggcgcgcctggtgtaccgagaacgatcctctcagtgcgagtctcgacgatccatatcgttgcttggcagtcagccagtcggaatccagcttgggacccaggaagtccaatcgtcagatattgtactcaagcctggtcacggcagcgtaccgatctgtttaaacctagatattgatagtctgatcggtcaacgtataatcgagtcctagcttttgcaaacatctatcaagagacaggatcagcaggaggctttcgcatgagtattcaacatttccgtgtcgcccttattcccttttttgcggcattttgccttcctgtttttgctcacccagaaacgctggtgaaagtaaaagatgctgaagatcagttgggtgcgcgagtgggttacatcgaactggatctcaacagcggtaagatccttgagagttttcgccccgaagaacgctttccaatgatgagcacttttaaagttctgctatgtggcgcggtattatcccgtattgacgccgggcaagagcaactcggtcgccgcatacactattctcagaatgacttggttgagtattcaccagtcacagaaaagcatcttacggatggcatgacagtaagagaattatgcagtgctgccataaccatgagtgataacactgcggccaacttacttctgacaacgattggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaaccttgcgtaaactattaactggcgaactacttactctagcttcccggcaacagttgatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaaccgattctaggtgcattggcgcagaaaaaaatgcctgatgcgacgctgcgcgtcttatactcccacatatgccagattcagcaacggatacggcttccccaacttgcccacttccatacgtgtcctccttaccagaaatttatccttaagatcccgaatcgtttaaactcgactctggctctatcgaatctccgtcgtttcgagcttacgcgaacagccgtggcgctcatttgctcgtcgggcatcgaatctcgtcagctatcgtcagcttacctttttggcagcgatcgcggctcccgacatcttggaccattagctccacaggtatcttcttccctctagtggtcataacagcagcttcagctacctctcaattcaaaaaacccctcaagacccgtttagaggccccaaggggttatgctatcaatcgttgcgttacacacacaaaaaaccaacacacatccatcttcgatggatagcgattttattatctaactgctgatcgagtgtagccagatctagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatgctgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctggtttagtgaaccgtcagatcgcctggagacgccatccacgctgttttgacctccatagaagacaccgggaccgatccagcctcccctcgaagcttacatgtggtaccgagctcggatcctgagaacttcagggtgagtctatgggacccttgatgttttctttccccttcttttctatggttaagttcatgtcataggaaggggagaagtaacagggtacacatattgaccaaatcagggtaattttgcatttgtaattttaaaaaatgctttcttcttttaatatacttttttgtttatcttatttctaatactttccctaatctctttctttcagggcaataatgatacaatgtatcatgcctctttgcaccattctaaagaataacagtgataatttctgggttaaggcaatagcaatatttctgcatataaatatttctgcatataaattgtaactgatgtaagaggtttcatattgctaatagcagctacaatccagctaccattctgcttttattttatggttgggataaggctggattattctgagtccaagctaggcccttttgctaatcatgttcatacctcttatcttcctcccacagctcctgggcaacgtgctggtctgtgtgctggcccatcactttggcaaaggcggccgcgccgccaccatggagacagacacactcctgctatgggtactgctgctctgggttccaggttccactggtcaggtgcaattacaggagtctggtgccgaactggtgaaaccgggtgcttccgtgaaactcagctgtaaggccagcggatacacattcacatcctactggatgcactgggtgaagcagagaccagggcagggcctggagtggatcgggaaaatcaaccccagtaatgggagaaccaactataatgaaaagttcaaaagtaaggctacactcactgtcgataagtcttcatcaaccgcatatatgcagctatcaagtctgacctctgaagattccgcagtgtactactgtgctcgaggcggtgtgtattatgacctttattactacgcgctggattattgggggcaagggactactgttacagtaagcagcggaggaggtggctccggaggtgggggctcaggcggcggagggtccgacatcgagctgactcaatccccagccacactcagcgttacccctggagactccgtctccctcagttgccgcgccagccagtcaattagcaacaatctgcattggtaccaacagaaaagccacgagtcccccaggttgttgattaagtctgcatctcagagtatatcaggcattcctagcaggttctcaggatccgggagtggaacggacttcaccctgtcgataaactccgtcgaaaccgaggactttggtatgtacttttgccagcagtctaattcgtggccctacacgtttggcggcggcaccaagcttgagatcaaacgggaacccaagtcatgcgacaagacgcacacctgccccccctgccctgcacctgaactgttggggggtccttctgtgttcctttttccacccaagccaaaagacaccttaatgattagccggacgcctgaagtcacatgtgtggtggtcgacgtgtcccatgaggacccagaggtgaagttcaattggtacgtggacggggtcgaggtgcacaatgccaaaaccaaaccccgcgaagagcagtacaacagcacttatagggttgtatccgtacttactgtcctgcatcaagactggctgaatggaaaagagtataagtgtaaagtgagcaacaaggccctcccagcccccatcgaaaagactatcagtaaggctaagggccagccccgtgagcctcaggtgtacaccttgccgccttccagagacgaactcacaaaaaatcaagttagtctaacatgtctggtcaagggattctacccgtccgacatcgcggtcgaatgggagtcaaatggacagccagaaaacaactataaaacaactccaccggttctggattccgatggtagctttttcctgtatagtaaactcacagttgataagtctcgatggcagcagggcaacgtgttcagctgcagcgtcatgcacgaggctctccataaccactatacccagaaatctctcagtctgtcccctggaaaaagcggggggtcttccagaggtgagcagaaactgattagtgaggaggatctgatcgaggtcatgtaccccccaccttatctcgataatgaaaagtcaaatggcactataatccacgttaagggcaagcatctttgcccatcacctttgttcccaggaccctcaaaaccattttgggtgctggtggtagtgggcggcgtattggcctgttattctctgcttgtgaccgtggcatttattatatttt

SEQ ID NO: 16515 - DNA, 6595 bp, synthetic construct
  source 1..6595: mol_type = other DNA
gggtgagatctaagaggtcgcgcctattacactcggattacatgaaccgggttaggcaagggtacagctgagctagcttgactgactgagatacagcgtaccttcagctcacagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtattggcccatctctatcggtatcgtagcataaccccttggggcctctaaacgggtcttgaggggttttttgtgcccctcgggccggattgctatctaccggcattggcgcagaaaaaaatgcctgatgcgacgctgcgcgtcttatactcccacatatgccagattcagcaacggatacggcttccccaacttgcccacttccatacgtgtcctccttaccagaaatttatccttaaggtcgtcagctatcctgcaggcgatctctcgatttcgatcaagacattcctttaatggtcttttctggacaccactaggggtcagaagtagttcatcaaactttcttccctccctaatctcattggttaccttgggctatcgaaacttaattaaccagtcaagtcagctacttggcgagatcgacttgtctgggtttcgactacgctcagaattgcgtcagtcaagttcgatctggtccttgctattgcacccgttctccgattacgagtttcatttaaatcatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcatttaaatttccgaactctccaaggccctcgtcggaaaatcttcaaacctttcgtccgatccatcttgcaggctacctctcgaacgaactatcgcaagtctcttggccggccttgcgccttggctattgcttggcagcgcctatcgccaggtattactccaatcccgaatatccgagatcgggatcacccgagagaagttcaacctacatcctcaatcccgatctatccgagatccgaggaatatcgaaatcggggcgcgcctggtgtaccgagaacgatcctctcagtgcgagtctcgacgatccatatcgttgcttggcagtcagccagtcggaatccagcttgggacccaggaagtccaatcgtcagatattgtactcaagcctggtcacggcagcgtaccgatctgtttaaacctagatattgatagtctgatcggtcaacgtataatcgagtcctagcttttgcaaacatctatcaagagacaggatcagcaggaggctttcgcatgagtattcaacatttccgtgtcgcccttattcccttttttgcggcattttgccttcctgtttttgctcacccagaaacgctggtgaaagtaaaagatgctgaagatcagttgggtgcgcgagtgggttacatcgaactggatctcaacagcggtaagatccttgagagttttcgccccgaagaacgctttccaatgatgagcacttttaaagttctgctatgtggcgcggtattatcccgtattgacgccgggcaagagcaactcggtcgccgcatacactattctcagaatgacttggttgagtattcaccagtcacagaaaagcatcttacggatggcatgacagtaagagaattatgcagtgctgccataaccatgagtgataacactgcggccaacttacttctgacaacgattggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaaccttgcgtaaactattaactggcgaactacttactctagcttcccggcaacagttgatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaaccgattctaggtgcattggcgcagaaaaaaatgcctgatgcgacgctgcgcgtcttatactcccacatatgccagattcagcaacggatacggcttccccaacttgcccacttccatacgtgtcctccttaccagaaatttatccttaagatcccgaatcgtttaaactcgactctggctctatcgaatctccgtcgtttcgagcttacgcgaacagccgtggcgctcatttgctcgtcgggcatcgaatctcgtcagctatcgtcagcttacctttttggcagcgatcgcggctcccgacatcttggaccattagctccacaggtatcttcttccctctagtggtcataacagcagcttcagctacctctcaattcaaaaaacccctcaagacccgtttagaggccccaaggggttatgctatcaatcgttgcgttacacacacaaaaaaccaacacacatccatcttcgatggatagcgattttattatctaactgctgatcgagtgtagccagatctagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatgctgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctggtttagtgaaccgtcagatcgcctggagacgccatccacgctgttttgacctccatagaagacaccgggaccgatccagcctcccctcgaagcttacatgtggtaccgagctcggatcctgagaacttcagggtgagtctatgggacccttgatgttttctttccccttcttttctatggttaagttcatgtcataggaaggggagaagtaacagggtacacatattgaccaaatcagggtaattttgcatttgtaattttaaaaaatgctttcttcttttaatatacttttttgtttatcttatttctaatactttccctaatctctttctttcagggcaataatgatacaatgtatcatgcctctttgcaccattctaaagaataacagtgataatttctgggttaaggcaatagcaatatttctgcatataaatatttctgcatataaattgtaactgatgtaagaggtttcatattgctaatagcagctacaatccagctaccattctgcttttattttatggttgggataaggctggattattctgagtccaagctaggcccttttgctaatcatgttcatacctcttatcttcctcccacagctcctgggcaacgtgctggtctgtgtgctggcccatcactttggcaaaggcggccgcgccgccaccatggagacagacacactcctgctatgggtactgctgctctgggttccaggttccactggtgacgttcagctcgtcgagagcgggggcgggctggttcaacctggtggctctcggaagctctcatgcgccgcatctggattcacattttcttcattcgggatgcattgggtgaggcaggcccctgaaaagggcctggagtgggtcgcatatattagctccgggtcaagcacactccactatgccgacactgtgaagggcaggtttaccattagccgcgacaaccccaaaaacactttattcctacagatgacatccctgagaagcgaggatacggccatgtattactgtgcccgatggggaaattatccccactacgcaatggattattggggacaggggacctctgtaaccgtgtcctcaggaggaggtggctccggaggtgggggctcaggcggcggagggtccgatatcgtcatgactcagtccccggcttcgttggctgtaagcctcgggcagcgtgcgaccatcagttgtagagcaagcaagtcggtgagtgcttccggatatagttacatgcactggtaccagcagaaacccggccaacccccaaagctgctgatataccttgcgagtaatcttgagtcaggcgtgcctgctcggttttctgggtccggtagtggcacggacttcacactgaacatccatccagtggaagaggaagacgccgtgacctactactgccaacacagccgcgaattgccatacactttcggcggcggaaccaaactggagatcaaagaacccaagtcatgcgacaagacgcacacctgccccccctgccctgcacctgaactgttggggggtccttctgtgttcctttttccacccaagccaaaagacaccttaatgattagccggacgcctgaagtcacatgtgtggtggtcgacgtgtcccatgaggacccagaggtgaagttcaattggtacgtggacggggtcgaggtgcacaatgccaaaaccaaaccccgcgaagagcagtacaacagcacttatagggttgtatccgtacttactgtcctgcatcaagactggctgaatggaaaagagtataagtgtaaagtgagcaacaaggccctcccagcccccatcgaaaagactatcagtaaggctaagggccagccccgtgagcctcaggtgtacaccttgccgccttccagagacgaactcacaaaaaatcaagttagtctaacatgtctggtcaagggattctacccgtccgacatcgcggtcgaatgggagtcaaatggacagccagaaaacaactataaaacaactccaccggttctggattccgatggtagctttttcctgtatagtaaactcacagttgataagtctcgatggcagcagggcaacgtgttcagctgcagcgtcatgcacgaggctctccataaccactatacccagaaatctctcagtctgtcccctggaaaaagcggggggtcttccagaggtgagcagaaactgattagtgaggaggatctgatcgaggtcatgtaccccccaccttatctcgataatgaaaagtcaaatggcactataatccacgttaagggcaagcatctttgcccatcacctttgttcccaggaccctcaaaaccattttgggtgctggtggtagtgggcggcgtattggcctgttattctctgcttgtgaccgtggcatttattatatttt

SEQ ID NO: 16516 - protein, 249 aa, synthetic construct
QSVLTQPPSASGTPGQRVTISCSGSRSNVGGNYVFWYQQVPGATPKLLIYRSNQRPSGVPDRFAGSKSGSSASLAISGLRSEDEADYYCATWDDSLSGFVFGTGTKVTVLGSRGGGGSGGGGSGGGGSLEMAEVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARGYGKAYDQWGQGTLVTVSS

SEQ ID NO: 16517 - protein, 248 aa, synthetic construct
QSVVTQPPSMSAAPGQQVTISCSGGNSNIERNYVSWYLQLPGTAPKLVIFDNDRRPSGIPDRFSGSKSGTSATLGITGLQTGDEADYYCGTWDSSLRGWVFGGGTKLTVLGSRGGGGSGGGGSGGGGSLEMAEVQLVESGGGLIQPGGSLRLSCAASGFTFSNYAMNWVRQAPGKGLEWVSTINGRGSSTIYADSVKGRFTISRDNSKNTLYLQMNSLRAEDTATYYCARYISRGLGDSWGQGTLVTV

SEQ ID NO: 16518 - protein, 246 aa, synthetic construct
QSVLTQPASVSGSPGQSLTISCTGTSNDVGAYKYVSWYQQYPGKAPKLILYDVFKRPSGVSNRFSGSKSDNTASLTISGLQAEDEADYYCFSLTSSNTYVFGTGTKVTVLGSRGGGGSGGGGSGGGGSLEMAQMQLVQSGAEVKKPGASVKVSCKASGYTFNRYAITWVRQAPGQGLEWMGWISAYNGNSHYAQKLQGRVTMTTDTSTGTAYMELRRLRSDDTAVYYCARMAYDSWGQGTLVTVSS

SEQ ID NO: 16519 - protein, 250 aa, synthetic construct
SSELTQDPAVSVALGQTVRITCQGDSLRSYYASWYQQKPGQAPVLVIYGKNNRPSGIPDRFSGSSSGNTASLTITGAQAEDEADYYCNSRDSSGNPPVVFGGGTKLTVLGSRGGGGSGGGGSGGGGSLEMAQVQLVESGGGLVHPGGSLRLSCAASGFTFRSHSMNWVRQAPGKGLEWVSSISSDSTYTYYADSVKGRFTISRDNAKNSLYLQMNSLRAEDTAVYYCARSGGQWKYYDYWGQGTLVTVSS

SEQ ID NO: 16520 - RNA, 100 nt, synthetic construct
  source 1..100: mol_type = other RNA
  modified_base 1: mod_base = OTHER; note = 2'-O-methyl modified nucleotide with phosphorothioate linkage
  modified_base 2: mod_base = OTHER; note = 2'-O-methyl modified nucleotide with phosphorothioate linkage
  modified_base 3: mod_base = OTHER; note = 2'-O-methyl modified nucleotide with phosphorothioate linkage
  modified_base 97: mod_base = OTHER; note = 2'-O-methyl modified nucleotide with phosphorothioate linkage
  modified_base 98: mod_base = OTHER; note = 2'-O-methyl modified nucleotide with phosphorothioate linkage
  modified_base 99: mod_base = OTHER; note = 2'-O-methyl modified nucleotide with phosphorothioate linkage
ctaacagttgcttttatcacgttttagagctagaaatagcaagttaaaataaggctagtccgttatcaacttgaaaaagtggcaccgagtcggtgctttt

SEQ ID NO: 16521 - DNA, 6322 bp, synthetic construct
  source 1..6322: mol_type = other DNA
tttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcatttaaatttccgaactctccaaggccctcgtcggaaaatcttcaaacctttcgtccgatccatcttgcaggctacctctcgaacgaactatcgcaagtctcttggccggccttgcgccttggctattgcttggcagcgcctatcgccaggtattactccaatcccgaatatccgagatcgggatcacccgagagaagttcaacctacatcctcaatcccgatctatccgagatccgaggaatatcgaaatcggggcgcgcctggtgtaccgagaacgatcctctcagtgcgagtctcgacgatccatatcgttgcttggcagtcagccagtcggaatccagcttgggacccaggaagtccaatcgtcagatattgtactcaagcctggtcacggcagcgtaccgatctgtttaaacctagatattgatagtctgatcggtcaacgtataatcgagtcctagcttttgcaaacatctatcaagagacaggatcagcaggaggctttcgcatgagtattcaacatttccgtgtcgcccttattcccttttttgcggcattttgccttcctgtttttgctcacccagaaacgctggtgaaagtaaaagatgctgaagatcagttgggtgcgcgagtgggttacatcgaactggatctcaacagcggtaagatccttgagagttttcgccccgaagaacgctttccaatgatgagcacttttaaagttctgctatgtggcgcggtattatcccgtattgacgccgggcaagagcaactcggtcgccgcatacactattctcagaatgacttggttgagtattcaccagtcacagaaaagcatcttacggatggcatgacagtaagagaattatgcagtgctgccataaccatgagtgataacactgcggccaacttacttctgacaacgattggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaaccttgcgtaaactattaactggcgaactacttactctagcttcccggcaacagttgatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaaccgattctaggtgcattggcgcagaaaaaaatgcctgatgcgacgctgcgcgtcttatactcccacatatgccagattcagcaacggatacggcttccccaacttgcccacttccatacgtgtcctccttaccagaaatttatccttaagatcccgaatcgtttaaactcgactctggctctatcgaatctccgtcgtttcgagcttacgcgaacagccgtggcgctcatttgctcgtcgggcatcgaatctcgtcagctatcgtcagcttacctttttggcagcgatcgcggctcccgacatcttggaccattagctccacaggtatcttcttccctctagtggtcataacagcagcttcagctacctctcaattcaaaaaacccctcaagacccgtttagaggccccaaggggttatgctatcaatcgttgcgttacacacacaaaaaaccaacacacatccatcttcgatggatagcgattttattatctaactgctgatcgagtgtagccagatctagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatgctgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctggtttagtgaaccgtcagatcgcctggagacgccatccacgctgttttgacctccatagaagacaccgggaccgatccagcctcccctcgaagcttacatgtggtaccgagctcggatcctgagaacttcagggtgagtctatgggacccttgatgttttctttccccttcttttctatggttaagttcatgtcataggaaggggagaagtaacagggtacacatattgaccaaatcagggtaattttgcatttgtaattttaaaaaatgctttcttcttttaatatacttttttgtttatcttatttctaatactttccctaatctctttctttcagggcaataatgatacaatgtatcatgcctctttgcaccattctaaagaataacagtgataatttctgggttaaggcaatagcaatatttctgcatataaatatttctgcatataaattgtaactgatgtaagaggtttcatattgctaatagcagctacaatccagctaccattctgcttttattttatggttgggataaggctggattattctgagtccaagctaggcccttttgctaatcatgttcatacctcttatcttcctcccacagctcctgggcaacgtgctggtctgtgtgctggcccatcactttggcaaaggcggccgcgccgccaccatgaagtgcttgctctacctggccttcctcttcattggcgttaactgcaaatttacaatcgtgttccctcataaccagaagggaaattggaagaacgtgccatccaactaccattactgtccctcatcatcagatctgaattggcacaatgatttggtcggcacggcattgcaggtcaaaatgcctaagagtcataaggctatacaggcggacggatggatgtgtcacgcctctaagtgggtaacaacctgtgactttcgctggtatgggcccaagtatataacacattccatccgtagctttaccccctcagttgaacagtgtaaggagagcatcgagcaaacgaaacaaggaacttggcttaacccgggcttcccacctcaaagttgcgggtacgccactgtgaccgacgctgaggcggccattgtgcaagtaacaccccaccacgtgctggtcgacgaatacactggggagtgggtggacagtcaattcattaacggcaagtgctcaaacgatatctgtcctactgttcataatagcaccacatggcactctgattacaaagtgaaaggtctgtgtgacagcaatcttatatccatggacattacgttctttagcgaagacggcgaactcagtagcctaggtaaaaagggaaccgggttcagaagcaactatttcgcatacgaaaccggggacaaagcatgcaaaatgcagtactgtaagcattggggtgtgcggctgcccagcggcgtctggttcgagatggccgataaagacttatttgctgctgcccgattcccagagtgcccagagggctcttcaatatccgccccttcccagacctctgtcgatgtcagcctgatccaggatgtcgaacggatcctcgactattctctttgccaggaaacctggtctaagatccgcgcaggcctgcccatctcaccggtagacctctcctaccttgcccccaagaatccaggaacaggcccagtattcactatcattaacggaacgctgaaatattttgagaccaggtacatcagagtggatattgcagcccccattctatcgaggatggtggggatgatctctggaactacaacagaaagagtgttatgggatgactgggccccctacgaggatgttgagatcggtccaaacggcgttctgcgaactagtagcgggtataaatttcctctgtatatgatcgggcatggcatgctcgactccgacctacacctctcttcgaaagcacaggtgttcgagcaccctcacatccaggatgcggcttcccagctccctgatggggaaaccctgttttttggagacaccggtctttctaagaatccgattgaatttgtggagggctggttttccagctggaagtccagtattgctagtttctttttcactatcggcctgattattgggttgttcctggtgttaagggttggaatatatttgtgcattaagctgaagcacacaaaaaaacgccagatatataccgatatcgagatgaatcggctgggtaagtgagctagcttgactgactgagatacagcgtaccttcagctcacagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtattggcccatctctatcggtatcgtagcataaccccttggggcctctaaacgggtcttgaggggttttttgtgcccctcgggccggattgctatctaccggcattggcgcagaaaaaaatgcctgatgcgacgctgcgcgtcttatactcccacatatgccagattcagcaacggatacggcttccccaacttgcccacttccatacgtgtcctccttaccagaaatttatccttaaggtcgtcagctatcctgcaggcgatctctcgatttcgatcaagacattcctttaatggtcttttctggacaccactaggggtcagaagtagttcatcaaactttcttccctccctaatctcattggttaccttgggctatcgaaacttaattaaccagtcaagtcagctacttggcgagatcgacttgtctgggtttcgactacgctcagaattgcgtcagtcaagttcgatctggtccttgctattgcacccgttctccgattacgagtttcatttaaatcatgtgagcaaaaggccagcaaaaggccaggaaccgtaaaaaggccgcgttgctggcgtt

SEQ ID NO: 16522 - DNA, 6376 bp, synthetic construct
  source 1..6376: mol_type = other DNA
agtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtattggcccatctctatcggtatcgtagcataaccccttggggcctctaaacgggtcttgaggggttttttgtgcccctcgggccggattgctatctaccggcattggcgcagaaaaaaatgcctgatgcgacgctgcgcgtcttatactcccacatatgccagattcagcaacggatacggcttccccaacttgcccacttccatacgtgtcctccttaccagaaatttatccttaaggtcgtcagctatcctgcaggcgatctctcgatttcgatcaagacattcctttaatggtcttttctggacaccactaggggtcagaagtagttcatcaaactttcttccctccctaatctcattggttaccttgggctatcgaaacttaattaaccagtcaagtcagctacttggcgagatcgacttgtctgggtttcgactacgctcagaattgcgtcagtcaagttcgatctggtccttgctattgcacccgttctccgattacgagtttcatttaaatcatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcatttaaatttccgaactctccaaggccctcgtcggaaaatcttcaaacctttcgtccgatccatcttgcaggctacctctcgaacgaactatcgcaagtctcttggccggccttgcgccttggctattgcttggcagcgcctatcgccaggtattactccaatcccgaatatccgagatcgggatcacccgagagaagttcaacctacatcctcaatcccgatctatccgagatccgaggaatatcgaaatcggggcgcgcctggtgtaccgagaacgatcctctcagtgcgagtctcgacgatccatatcgttgcttggcagtcagccagtcggaatccagcttgggacccaggaagtccaatcgtcagatattgtactcaagcctggtcacggcagcgtaccgatctgtttaaacctagatattgatagtctgatcggtcaacgtataatcgagtcctagcttttgcaaacatctatcaagagacaggatcagcaggaggctttcgcatgagtattcaacatttccgtgtcgcccttattcccttttttgcggcattttgccttcctgtttttgctcacccagaaacgctggtgaaagtaaaagatgctgaagatcagttgggtgcgcgagtgggttacatcgaactggatctcaacagcggtaagatccttgagagttttcgccccgaagaacgctttccaatgatgagcacttttaaagttctgctatgtggcgcggtattatcccgtattgacgccgggcaagagcaactcggtcgccgcatacactattctcagaatgacttggttgagtattcaccagtcacagaaaagcatcttacggatggcatgacagtaagagaattatgcagtgctgccataaccatgagtgataacactgcggccaacttacttctgacaacgattggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaaccttgcgtaaactattaactggcgaactacttactctagcttcccggcaacagttgatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaaccgattctaggtgcattggcgcagaaaaaaatgcctgatgcgacgctgcgcgtcttatactcccacatatgccagattcagcaacggatacggcttccccaacttgcccacttccatacgtgtcctccttaccagaaatttatccttaagatcccgaatcgtttaaactcgactctggctctatcgaatctccgtcgtttcgagcttacgcgaacagccgtggcgctcatttgctcgtcgggcatcgaatctcgtcagctatcgtcagcttacctttttggcagcgatcgcggctcccgacatcttggaccattagctccacaggtatcttcttccctctagtggtcataacagcagcttcagctacctctcaattcaaaaaacccctcaagacccgtttagaggccccaaggggttatgctatcaatcgttgcgttacacacacaaaaaaccaacacacatccatcttcgatggatagcgattttattatctaactgctgatcgagtgtagccagatctagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatgctgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctggtttagtgaaccgtcagatcgcctggagacgccatccacgctgttttgacctccatagaagacaccgggaccgatccagcctcccctcgaagcttacatgtggtaccgagctcggatcctgagaacttcagggtgagtctatgggacccttgatgttttctttccccttcttttctatggttaagttcatgtcataggaaggggagaagtaacagggtacacatattgaccaaatcagggtaattttgcatttgtaattttaaaaaatgctttcttcttttaatatacttttttgtttatcttatttctaatactttccctaatctctttctttcagggcaataatgatacaatgtatcatgcctctttgcaccattctaaagaataacagtgataatttctgggttaaggcaatagcaatatttctgcatataaatatttctgcatataaattgtaactgatgtaagaggtttcatattgctaatagcagctacaatccagctaccattctgcttttattttatggttgggataaggctggattattctgagtccaagctaggcccttttgctaatcatgttcatacctcttatcttcctcccacagctcctgggcaacgtgctggtctgtgtgctggcccatcactttggcaaaggcggccgcgccgccaccatggacctgtttccaattttggttgtggtcctgatgaccgatacagtattaggcaaattccagattgtatttcctgaccaaaacgagctagaatggaggccggtcgttggcgatagccgccactgtcctcagtcaagcgagatgcagtttgatggtagcagatcccaaaccatcttgacaggcaaggcacctgtgggcattacaccaagcaagtccgatggttttatctgccatgcagccaaatgggtaaccacatgcgatttccggtggtacggaccaaagtacatcactcacagcattcatcatctgcgcccgactaccagtgactgcgagacagcgctgcagaggtataaagacggtagtttaataaacctcggatttccccccgagtcctgtggatacgctaccgtgaccgactctgaggccatgctagtgcaggtcaccccccaccatgttggagtcgatgactatagaggccattggatcgaccctctcttccctggaggggaatgcagtacaaatttttgtgacaccgtgcacaacagctcagtgtggataccgaagtcgcagaaaacagacatttgcgctcagtccttcaagaatatcaaaatgacggctagttatccttccgagggtgcacttgtgtctgatagattcgcgttccactcggcctaccaccccaatatgccagggtccaccgtgtgtataatggacttttgtgaacaaaaggggctccgttttacaaacggcgagtggatgggccttaacgtcgagcagtcaattcgagaaaagaaaatctccgcaatcttcccaaattgtgtcgccggcaccgaaatccgagcaactcttgaaagcgagggggctcggacactgacttgggagacccagagaatgcttgattacagcctgtgccagaacacctgggataaagtgtcacgcaaagagcccctctcccccctggacctgagttacctcagcccacgcgcccccggcaaggggatggcatatactgtgatcaacgggactctgcacagcgctcacgcaaaatacatccggacgtggattgattacggcgaaatgaaggagattaaaggggggaggggcgagtattctaaggccccagaactgctgtggtctcaatggttcgattttggtccattcaagattggacctaacggattactacacacagggaagactttcaagtttcccttgtacctgattggggctggtataattgatgaagatctgcatgaactcgacgaagccgctcctatcgaccacccacagatgcccgacgccaaatctgtactgcccgaggacgaggagatcttcttcggcgacacgggcgtgagtaagaaccctatcgaactcatccagggatggttttctaattggcgcgagtcagtgatggccatagtcggaatcgtgttgctgatagttgttacgttcttggcgatcaaaactgtgcgagtcctcaattgcctttggcggccgaggaagaagcggattgtgagacaagaagtcgatgtggaatcaaggctgaatcatttcgagatgcgtggatttcccgagtatgttaagaggtgagctagcttgactgactgagatacagcgtaccttcagctcacagacatgataagatacattgatg

SEQ ID NO: 16523 - DNA, 6370 bp, synthetic construct; identical to SEQ ID NO: 8125
  source 1..6370: mol_type = other DNA

SEQ ID NO: 16524 - DNA, 6307 bp, synthetic construct; identical to SEQ ID NO: 8123
  source 1..6307: mol_type = other DNA

SEQ ID NO: 16525 - DNA, 6325 bp, synthetic construct; identical to SEQ ID NO: 8122
  source 1..6325: mol_type = other DNA

SEQ ID NO: 16526 - DNA, 6343 bp, synthetic construct
  source 1..6343: mol_type = other DNA
tttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcatttaaatttccgaactctccaaggccctcgtcggaaaatcttcaaacctttcgtccgatccatcttgcaggctacctctcgaacgaactatcgcaagtctcttggccggccttgcgccttggctattgcttggcagcgcctatcgccaggtattactccaatcccgaatatccgagatcgggatcacccgagagaagttcaacctacatcctcaatcccgatctatccgagatccgaggaatatcgaaatcggggcgcgcctggtgtaccgagaacgatcctctcagtgcgagtctcgacgatccatatcgttgcttggcagtcagccagtcggaatccagcttgggacccaggaagtccaatcgtcagatattgtactcaagcctggtcacggcagcgtaccgatctgtttaaacctagatattgatagtctgatcggtcaacgtataatcgagtcctagcttttgcaaacatctatcaagagacaggatcagcaggaggctttcgcatgagtattcaacatttccgtgtcgcccttattcccttttttgcggcattttgccttcctgtttttgctcacccagaaacgctggtgaaagtaaaagatgctgaagatcagttgggtgcgcgagtgggttacatcgaactggatctcaacagcggtaagatccttgagagttttcgccccgaagaacgctttccaatgatgagcacttttaaagttctgctatgtggcgcggtattatcccgtattgacgccgggcaagagcaactcggtcgccgcatacactattctcagaatgacttggttgagtattcaccagtcacagaaaagcatcttacggatggcatgacagtaagagaattatgcagtgctgccataaccatgagtgataacactgcggccaacttacttctgacaacgattggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaaccttgcgtaaactattaactggcgaactacttactctagcttcccggcaacagttgatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaaccgattctaggtgcattggcgcagaaaaaaatgcctgatgcgacgctgcgcgtcttatactcccacatatgccagattcagcaacggatacggcttccccaacttgcccacttccatacgtgtcctccttaccagaaatttatccttaagatcccgaatcgtttaaactcgactctggctctatcgaatctccgtcgtttcgagcttacgcgaacagccgtggcgctcatttgctcgtcgggcatcgaatctcgtcagctatcgtcagcttacctttttggcagcgatcgcggctcccgacatcttggaccattagctccacaggtatcttcttccctctagtggtcataacagcagcttcagctacctctcaattcaaaaaacccctcaagacccgtttagaggccccaaggggttatgctatcaatcgttgcgttacacacacaaaaaaccaacacacatccatcttcgatggatagcgattttattatctaactgctgatcgagtgtagccagatctagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatgctgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctggtttagtgaaccgtcagatcgcctggagacgccatccacgctgttttgacctccatagaagacaccgggaccgatccagcctcccctcgaagcttacatgtggtaccgagctcggatcctgagaacttcagggtgagtctatgggacccttgatgttttctttccccttcttttctatggttaagttcatgtcataggaaggggagaagtaacagggtacacatattgaccaaatcagggtaattttgcatttgtaattttaaaaaatgctttcttcttttaatatacttttttgtttatcttatttctaatactttccctaatctctttctttcagggcaataatgatacaatgtatcatgcctctttgcaccattctaaagaataacagtgataatttctgggttaaggcaatagcaatatttctgcatataaatatttctgcatataaattgtaactgatgtaagaggtttcatattgctaatagcagctacaatccagctaccattctgcttttattttatggttgggataaggctggattattctgagtccaagctaggcccttttgctaatcatgttcatacctcttatcttcctcccacagctcctgggcaacgtgctggtctgtgtgctggcccatcactttggcaaaggcggccgcgccgccaccatgaagtgcttgctctacctggccttcctcttcattggcgttaactgcgatttgccgattgttttccctgatcaaaaggagttgctatggaatccagtgctcaagacaaacagatactgtccccagacccgcgaaatcgctcccctggataaacccaagacattgaagattacaactggcgtcccagtccgctcgcccaaggagaaaatagagggctatctttgccactcaggcaagtgggtgacgacctgtgactataggtggtatggggcaaagtatgtgacccacagtattcatcacctgaagccaacggaccagatgtgcagagacgccataagtcaatacaacgggggaacactgctgaatcccgggttcccccccgaggtctgcgggtatgccagtgttacagacagcgagttgattattaccctcataacaccccacaccgtgggtgtagatgactaccggggtctatggattgacccatcctttcccaatggcgagtgcaactccatcgtgtgcgaaacaatacacaactctaccaagtgggtctctaaaggcgagatgcctactgacatttgccagcagacatttactaccatcaaaatggatgtgtcctacccgtctgataccacatcccagggctcgctgctatcttttcatagcccttaccacccacacatcagcggtaaagacatttgcaagatgtcctattgtggaagcaatggcttgcggctgccgaacggtgaatggttcagtattatcaatacgagcaagattggcaataagaaccttatcgactttttctccccctgtaaggcaggagtggaggtgaggagcacgctccagtccgaagggagccagaccatcgcctgggaaactcagaggatgctggattatgccttatgccaaaatacctgggacaagttcgagcgaggcgagccactgtcacccctggatctgaattaccttgctcctcgcgtgccagggaaaggaatggcgtatactatcatcaacaacacactgcactcaagccacgctgtataccgaagagtgtggattgaggggcctattatcggagaaatgaagggcaaaatcgaaagtgccaccggcgtcgccaaagaaatctgggctcaatggtttgagttcggtcagaacaaaatcggaccaaacggtgtaatcaagactaacgacggaataaagtttccactctacgcgattggaactggcctcatcgaccaggatatccatgaactcagtgaggtctcacctatggaccaccctcacttagttcatgccaagaaatacgtgtccgaagacgacgagatttacttcggagatacgggagtttctcataatcctgtggaaatcttcagcgggtggttcaccaactggaaagaggggctgatgaagtttagcatccttgtattatcaatcctgatattctatgtcgtgattcgtctcgttatgtgtataccactcaagtgtaaaaaagaacgaaaacctcggctggagtttgaactgcagccgagggagtgggagtactcacgggcatgagctagcttgactgactgagatacagcgtaccttcagctcacagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtattggcccatctctatcggtatcgtagcataaccccttggggcctctaaacgggtcttgaggggttttttgtgcccctcgggccggattgctatctaccggcattggcgcagaaaaaaatgcctgatgcgacgctgcgcgtcttatactcccacatatgccagattcagcaacggatacggcttccccaacttgcccacttccatacgtgtcctccttaccagaaatttatccttaaggtcgtcagctatcctgcaggcgatctctcgatttcgatcaagacattcctttaatggtcttttctggacaccactaggggtcagaagtagttcatcaaactttcttccctccctaatctcattggttaccttgggctatcgaaacttaattaaccagtcaagtcagctacttggcgagatcgacttgtctgggtttcgactacgctcagaattgcgtcagtcaagttcgatctggtccttgctattgcacccgttctccgattacgagtttcatttaaatcatgtgagcaaaaggccagcaaaaggccaggaaccgtaaaaaggccgcgttgctggcgtt

SEQ ID NO: 16527 - DNA, 6451 bp, synthetic construct
  source 1..6451: mol_type = other DNA
tttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcatttaaatttccgaactctccaaggccctcgtcggaaaatcttcaaacctttcgtccgatccatcttgcaggctacctctcgaacgaactatcgcaagtctcttggccggccttgcgccttggctattgcttggcagcgcctatcgccaggtattactccaatcccgaatatccgagatcgggatcacccgagagaagttcaacctacatcctcaatcccgatctatccgagatccgaggaatatcgaaatcggggcgcgcctggtgtaccgagaacgatcctctcagtgcgagtctcgacgatccatatcgttgcttggcagtcagccagtcggaatccagcttgggacccaggaagtccaatcgtcagatattgtactcaagcctggtcacggcagcgtaccgatctgtttaaacctagatattgatagtctgatcggtcaacgtataatcgagtcctagcttttgcaaacatctatcaagagacaggatcagcaggaggctttcgcatgagtattcaacatttccgtgtcgcccttattcccttttttgcggcattttgccttcctgtttttgctcacccagaaacgctggtgaaagtaaaagatgctgaagatcagttgggtgcgcgagtgggttacatcgaactggatctcaacagcggtaagatccttgagagttttcgccccgaagaacgctttccaatgatgagcacttttaaagttctgctatgtggcgcggtattatcccgtattgacgccgggcaagagcaactcggtcgccgcatacactattctcagaatgacttggttgagtattcaccagtcacagaaaagcatcttacggatggcatgacagtaagagaattatgcagtgctgccataaccatgagtgataacactgcggccaacttacttctgacaacgattggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaaccttgcgtaaactattaactggcgaactacttactctagcttcccggcaacagttgatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaaccgattctaggtgcattggcgcagaaaaaaatgcctgatgcgacgctgcgcgtcttatactcccacatatgccagattcagcaacggatacggcttccccaacttgcccacttccatacgtgtcctccttaccagaaatttatccttaagatcccgaatcgtttaaactcgactctggctctatcgaatctccgtcgtttcgagcttacgcgaacagccgtggcgctcatttgctcgtcgggcatcgaatctcgtcagctatcgtcagcttacctttttggcagcgatcgcggctcccgacatcttggaccattagctccacaggtatcttcttccctctagtggtcataacagcagcttcagctacctctcaattcaaaaaacccctcaagacccgtttagaggccccaaggggttatgctatcaatcgttgcgttacacacacaaaaaaccaacacacatccatcttcgatggatagcgattttattatctaactgctgatcgagtgtagccagatctagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatgctgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctggtttagtgaaccgtcagatcgcctggagacgccatccacgctgttttgacctccatagaagacaccgggaccgatccagcctcccctcgaagcttacatgtggtaccgagctcggatcctgagaacttcagggtgagtctatgggacccttgatgttttctttccccttcttttctatggttaagttcatgtcataggaaggggagaagtaacagggtacacatattgaccaaatcagggtaattttgcatttgtaattttaaaaaatgctttcttcttttaatatacttttttgtttatcttatttctaatactttccctaatctctttctttcagggcaataatgatacaatgtatcatgcctctttgcaccattctaaagaataacagtgataatttctgggttaaggcaatagcaatatttctgcatataaatatttctgcatataaattgtaactgatgtaagaggtttcatattgctaatagcagctacaatccagctaccattctgcttttattttatggttgggataaggctggattattctgagtccaagctaggcccttttgctaatcatgttcatacctcttatcttcctcccacagctcctgggcaacgtgctggtctgtgtgctggcccatcactttggcaaaggcggccgcgccgccaccatgaagtgcttgctctacctggccttcctcttcattggcgttaactgcgagatgatgatcccctttcccgatgtgacgactaccacttggaagcctgtgctgaagggcgaacaccactgtccaagcagcagcgacgtggacatactgagccgaatgtcaactctgaaacttcaagttcgcatcccgacaggctctgtggcaagtaagagcgatggactgttatgtcacggggcaaaatgggtcaccacctgtgactttcggtggtacggcagcaaatacataacacactcactacacagcataagaccaaccctgagtcaatgcactgaagccgcaaaagcgtataaggagggacggctgatggcacctggatttcccccagaatcttgcggttggaatagcgtcacggacagcgaactcctctccatcttagtgaccccccaccatacaggcgttgacgactacagagggatttggattgattcaatgttcccggggggcgagtgcaaagaaatggtctgtgataccgtccaggggcataccatttggatgtctacttccaacttgactacagcgtgtggagttgcgttcaaacagatccagggacagttctactatctgaactcagggcatcagcctaacaaggagggaaccttttttcattcccctaatcatcctaactcccctctcagcacggcctgcagaaagaaatattgcaaccaggaaggcatcgtcatacacacgggggagtggattggggtgccgtggaacacacggatccgtgatgttcaactagacagttacactgacctatgcgctgaatccacagagataaagtcaaccattggctccgccccgattcgggtcatcgcttgggagatggagcgagtaatggattttgccctgtgtcagactgtctgggacaaggtcaaccgtggagatccactcagccccttggatctctcctatctgtcctcgcgagccccagggaaaggtctggcttatacaatcatcaatgagacccttcacgtggctcatgtgaggtacatcaggacctacatcaaagcccctattatggaggagataaagggcagtcgcggcgacagaagtgctgccgagtccgtgttatggacacagtggttcccatacggcgatggagagattggtcccaatgggcttctcaagaccaatgggtctttcaagttccccttttatctggtaggtatgggtgccatagatgacgatcttatcgaactcagcaacgccgatcctatcgaccacccacagaaagctatcgcttccgtacacctcaatacagacgaggaactgttcttcggcaatacaggcagcgactccaaccccgtggaggctgtagaaggctggttcgccagttggaagtcggcaggaatcaatatggcactgattgtgctctgcgtcctgctggtgcttatttttctgaggtcattgccagccctgattaagttgattcatcggtacagggtgagtcggagccgccagactgacgtggagttgaactctatcaatgaaacagcaagaaccggtagtgttggaccagatattatccccggagcctggagggtgcacgactcaggcgttcgccagtctcaattcttcagaaacaatccccgcaggctgggtccttgagctagcttgactgactgagatacagcgtaccttcagctcacagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtattggcccatctctatcggtatcgtagcataaccccttggggcctctaaacgggtcttgaggggttttttgtgcccctcgggccggattgctatctaccggcattggcgcagaaaaaaatgcctgatgcgacgctgcgcgtcttatactcccacatatgccagattcagcaacggatacggcttccccaacttgcccacttccatacgtgtcctccttaccagaaatttatccttaaggtcgtcagctatcctgcaggcgatctctcgatttcgatcaagacattcctttaatggtcttttctggacaccactaggggtcagaagtagttcatcaaactttcttccctccctaatctcattggttaccttgggctatcgaaacttaattaaccagtcaagtcagctacttggcgagatcgacttgtctgggtttcgactacgctcagaattgcgtcagtcaagttcgatctggtccttgctattgcacccgttctccgattacgagtttcatttaaatcatgtgagcaaaaggccagcaaaaggccaggaaccgtaaaaaggccgcgttgctggcgtt

SEQ ID NO: 16528 - DNA, 6352 bp, synthetic construct
  source 1..6352: mol_type = other DNA
tttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcatttaaatttccgaactctccaaggccctcgtcggaaaatcttcaaacctttcgtccgatccatcttgcaggctacctctcgaacgaactatcgcaagtctcttggccggccttgcgccttggctattgcttggcagcgcctatcgccaggtattactccaatcccgaatatccgagatcgggatcacccgagagaagttcaacctacatcctcaatcccgatctatccgagatccgaggaatatcgaaatcggggcgcgcctggtgtaccgagaacgatcctctcagtgcgagtctcgacgatccatatcgttgcttggcagtcagccagtcggaatccagcttgggacccaggaagtccaatcgtcagatattgtactcaagcctggtcacggcagcgtaccgatctgtttaaacctagatattgatagtctgatcggtcaacgtataatcgagtcctagcttttgcaaacatctatcaagagacaggatcagcaggaggctttcgcatgagtattcaacatttccgtgtcgcccttattcccttttttgcggcattttgccttcctgtttttgctcacccagaaacgctggtgaaagtaaaagatgctgaagatcagttgggtgcgcgagtgggttacatcgaactggatctcaacagcggtaagatccttgagagttttcgccccgaagaacgctttccaatgatgagcacttttaaagttctgctatgtggcgcggtattatcccgtattgacgccgggcaagagcaactcggtcgccgcatacactattctcagaatgacttggttgagtattcaccagtcacagaaaagcatcttacggatggcatgacagtaagagaattatgcagtgctgccataaccatgagtgataacactgcggccaacttacttctgacaacgattggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaaccttgcgtaaactattaactggcgaactacttactctagcttcccggcaacagttgatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaaccgattctaggtgcattggcgcagaaaaaaatgcctgatgcgacgctgcgcgtcttatactcccacatatgccagattcagcaacggatacggcttccccaacttgcccacttccatacgtgtcctccttaccagaaatttatccttaagatcccgaatcgtttaaactcgactctggctctatcgaatctccgtcgtttcgagcttacgcgaacagccgtggcgctcatttgctcgtcgggcatcgaatctcgtcagctatcgtcagcttacctttttggcagcgatcgcggctcccgacatcttggaccattagctccacaggtatcttcttccctctagtggtcataacagcagcttcagctacctctcaattcaaaaaacccctcaagacccgtttagaggccccaaggggttatgctatcaatcgttgcgttacacacacaaaaaaccaacacacatccatcttcgatggatagcgattttattatctaactgctgatcgagtgtagccagatctagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatgctgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctggtttagtgaaccgtcagatcgcctggagacgccatccacgctgttttgacctccatagaagacaccgggaccgatccagcctcccctcgaagcttacatgtggtaccgagctcggatcctgagaacttcagggtgagtctatgggacccttgatgttttctttccccttcttttctatggttaagttcatgtcataggaaggggagaagtaacagggtacacatattgaccaaatcagggtaattttgcatttgtaattttaaaaaatgctttcttcttttaatatacttttttgtttatcttatttctaatactttccctaatctctttctttcagggcaataatgatacaatgtatcatgcctctttgcaccattctaaagaataacagtgataatttctgggttaaggcaatagcaatatttctgcatataaatatttctgcatataaattgtaactgatgtaagaggtttcatattgctaatagcagctacaatccagctaccattctgcttttattttatggttgggataaggctggattattctgagtccaagctaggcccttttgctaatcatgttcatacctcttatcttcctcccacagctcctgggcaacgtgctggtctgtgtgctggcccatcactttggcaaaggcggccgcgccgccaccatgaagtgcttgctctacctggccttcctcttcattggcgttaactgcatcaatgtcatccagttcctggaactgatactgtgcgcacaggcagccaaaataatcttgccagttcatttagagtcagagtgggtgcccgtgcatttcggggagaggatttgtcaaagcaacagagagaaaattcccgacggtatctacagcagcttgcggattgagggaaaggtgcccgtgcgacagagaagcgaaggagcagatggctactactgccacaagaccgtgtacagtgtgctgtgcgatttcaagtggtacggagtgaagaagctgcgacatagcgtaaaacgggacgttccctcctacggcgattgtctcaaagcaatcgatgacatggagaccgggctcaacgagtacatcggctttccgccaccctcttgcaactaccttgtggaaacgaggagtcagaacactgaggtcattctgtccaagcaccaagtcaagattgacgattacaagcaatcctggatggactctacctttgtagacggaggctgtcgcaaagccccttgcctgacaacaatcccggggactctgtggattccttcaagcaatctgacagccgcttgcgacataagtttcaagacacaggagtttaccgtgtactatccaaagatcaaaccccagactctctccagcgaccacatctttattacaagcccctatcaccccgttagttcgttatcaaaaagttgcgaaatcactctttgcaacaaaaagggtatccgcctcccaggcggttcttggactgagatgggctcacatacctcgttccacggaatcaaggtggatacccttttacctaagtgtcagtcatccgtagagatttatgccactcctccagacctgaaaaatctgcgtatgatctgggacctcgaaaaggtgattgagaacacgctttgtcaggcgacatgggacaagattgaaacacggcagaaaataacgccccttgatttgaactacctgtccccaagcgaacctggccctggttggggcttcctccctcgtaatggaagtatgtataaagcccagattctatacattagggcggaagtggagggggataccgtcgccctacaccaaagatacaataaagaaaaggaggacttctactttgaatggaacgactgggagatgctagatggcatcaggataggaccaaacgggattattactaatgggacccatgtcaaggtcccgtattatagcgttggaatcgggaaattggatgaagagatgatgattccacagcaaatagaaatcattcaccacatcgatcatctgaagcagagaatccctgcccagtcaaatctcgaccgcacctggatacacgagggcgaaaatggtgatatcatcacctctgttagccattggtggcacgacatactgatgcactcctgggaactcttcgcttccctgggaggcctgtgtgtgttgttttgtatgtgctcctgttgcctgaaccgcaggcgggggagaaaaacacggcatcaggaggctatgtcttttgtctgagctagcttgactgactgagatacagcgtaccttcagctcacagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtattggcccatctctatcggtatcgtagcataaccccttggggcctctaaacgggtcttgaggggttttttgtgcccctcgggccggattgctatctaccggcattggcgcagaaaaaaatgcctgatgcgacgctgcgcgtcttatactcccacatatgccagattcagcaacggatacggcttccccaacttgcccacttccatacgtgtcctccttaccagaaatttatccttaaggtcgtcagctatcctgcaggcgatctctcgatttcgatcaagacattcctttaatggtcttttctggacaccactaggggtcagaagtagttcatcaaactttcttccctccctaatctcattggttaccttgggctatcgaaacttaattaaccagtcaagtcagctacttggcgagatcgacttgtctgggtttcgactacgctcagaattgcgtcagtcaagttcgatctggtccttgctattgcacccgttctccgattacgagtttcatttaaatcatgtgagcaaaaggccagcaaaaggccaggaaccgtaaaaaggccgcgttgctggcgtt

SEQ ID NO: 16529 - DNA, 6349 bp, synthetic construct
  source 1..6349: mol_type = other DNA
tttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcatttaaatttccgaactctccaaggccctcgtcggaaaatcttcaaacctttcgtccgatccatcttgcaggctacctctcgaacgaactatcgcaagtctcttggccggccttgcgccttggctattgcttggcagcgcctatcgccaggtattactccaatcccgaatatccgagatcgggatcacccgagagaagttcaacctacatcctcaatcccgatctatccgagatccgaggaatatcgaaatcggggcgcgcctggtgtaccgagaacgatcctctcagtgcgagtctcgacgatccatatcgttgcttggcagtcagccagtcggaatccagcttgggacccaggaagtccaatcgtcagatattgtactcaagcctggtcacggcagcgtaccgatctgtttaaacctagatattgatagtctgatcggtcaacgtataatcgagtcctagcttttgcaaacatctatcaagagacaggatcagcaggaggctttcgcatgagtattcaacatttccgtgtcgcccttattcccttttttgcggcattttgccttcctgtttttgctcacccagaaacgctggtgaaagtaaaagatgctgaagatcagttgggtgcgcgagtgggttacatcgaactggatctcaacagcggtaagatccttgagagttttcgccccgaagaacgctttccaatgatgagcacttttaaagttctgctatgtggcgcggtattatcccgtattgacgccgggcaagagcaactcggtcgccgcatacactattctcagaatgacttggttgagtattcaccagtcacagaaaagcatcttacggatggcatgacagtaagagaattatgcagtgctgccataaccatgagtgataacactgcggccaacttacttctgacaacgattggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaaccttgcgtaaactattaactggcgaactacttactctagcttcccggcaacagttgatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaaccgattctaggtgcattggcgcagaaaaaaatgcctgatgcgacgctgcgcgtcttatactcccacatatgccagattcagcaacggatacggcttccccaacttgcccacttccatacgtgtcctccttaccagaaatttatccttaagatcccgaatcgtttaaactcgactctggctctatcgaatctccgtcgtttcgagcttacgcgaacagccgtggcgctcatttgctcgtcgggcatcgaatctcgtcagctatcgtcagcttacctttttggcagcgatcgcggctcccgacatcttggaccattagctccacaggtatcttcttccctctagtggtcataacagcagcttcagctacctctcaattcaaaaaacccctcaagacccgtttagaggccccaaggggttatgctatcaatcgttgcgttacacacacaaaaaaccaacacacatccatcttcgatggatagcgattttattatctaactgctgatcgagtgtagccagatctagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatgctgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctggtttagtgaaccgtcagatcgcctggagacgccatccacgctgttttgacctccatagaagacaccgggaccgatccagcctcccctcgaagcttacatgtggtaccgagctcggatcctgagaacttcagggtgagtctatgggacccttgatgttttctttccccttcttttctatggttaagttcatgtcataggaaggggagaagtaacagggtacacatattgaccaaatcagggtaattttgcatttgtaattttaaaaaatgctttcttcttttaatatacttttttgtttatcttatttctaatactttccctaatctctttctttcagggcaataatgatacaatgtatcatgcctctttgcaccattctaaagaataacagtgataatttctgggttaaggcaatagcaatatttctgcatataaatatttctgcatataaattgtaactgatgtaagaggtttcatattgctaatagcagctacaatccagctaccattctgcttttattttatggttgggataaggctggattattctgagtccaagctaggcccttttgctaatcatgttcatacctcttatcttcctcccacagctcctgggcaacgtgctggtctgtgtgctggcccatcactttggcaaaggcggccgcgccgccaccatgaagtgcttgctctacctggccttcctcttcattggcgttaactgcgccatcccaatcttctttccatccgagccccagttagaatggaaacctgtcctccctggctctcggtactgccctcagtctaatgagatgtcactggaccctgacctcaagaagtctaccatcagcgtgaaagtgccaataggcgttactccaagcaaatcggacgggtatctgtgtcacggagcaaagtgggtaagcacttgtgattttagatggtatggaccaaagtatatcacccatagcatccacaacctacggcccaccaccaatgactgcgaggacgccatcaaaaaatacgaggcgggcaccctgataaacccaggtttcccgccagattcctgtgcttacgccactgtaaccgatagcgagcacttagtgattctgattactcctcatcatgtgggggttgatgactatcggggcgcttgggttgacgactcctttcccagcggagtctgtgagacgaaccaatgcgatactacacacaactcctcaatctggatacctaagactaaaactcgccacaacatctgctcacagacattcgcaaatttgtccgtgacaataagttaccgagagggtggagcaatgaaaggagccgatatggttttccattcaaaataccatccccatatggtgggtggacacatctgcaagatgaacttttgcaacaagcagggcttgcgactacaaaacgaggaatggatagaaatcccctctgggaccaaggtgggcaatcaggacctaatgaacctgttcagtgattgtaaaagcgggctggaagtgcgaagcacactgaggagtgaaggagccaacacattgacgtgggaaacacaacgcctgcttgactacgccctctgtcagaacacgtgggataagtttgacaatcagggcgctgtatccgctctggacttgtcctatctcgcagccagagcaccgggcaagggtgtcgcctataccatgataaacgggaccctccactctgccccaacacgctacgtaagaatgtggattgaaagtccatcaatggaggagttgaaagccaaaaaagaaagcagcagcggcgtggaaacgagtatttggaatcagtggttcccgttcaaggggggcgagattggccccaatgggctgattaaggcaggaaataagtacaagtttcctctctacctcgtgggcatgggcatgcttgatgacgaaatcaatgctctggagttaggtggtcccattgatcaccctcagagggcacacgcccaggctgtgctgggcgatgaggagaccctgttctttggggacacaggggtgggaaaaaaccctgtggaacttatcaccggatggttcagcggatggaaggaaacaatcatggcggtcgtggcgattttcctgcttgtcattgtcctgtatggggtccttcgttgctgtcccactatttgcgttctctgcaaacgcaagtccagacataggaccaaggatatggagatgcaatacatccccaacaaccagaggcactggcggtgagctagcttgactgactgagatacagcgtaccttcagctcacagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtattggcccatctctatcggtatcgtagcataaccccttggggcctctaaacgggtcttgaggggttttttgtgcccctcgggccggattgctatctaccggcattggcgcagaaaaaaatgcctgatgcgacgctgcgcgtcttatactcccacatatgccagattcagcaacggatacggcttccccaacttgcccacttccatacgtgtcctccttaccagaaatttatccttaaggtcgtcagctatcctgcaggcgatctctcgatttcgatcaagacattcctttaatggtcttttctggacaccactaggggtcagaagtagttcatcaaactttcttccctccctaatctcattggttaccttgggctatcgaaacttaattaaccagtcaagtcagctacttggcgagatcgacttgtctgggtttcgactacgctcagaattgcgtcagtcaagttcgatctggtccttgctattgcacccgttctccgattacgagtttcatttaaatcatgtgagcaaaaggccagcaaaaggccaggaaccgtaaaaaggccgcgttgctggcgtt

SEQ ID NO: 16530 - DNA, 6325 bp, synthetic construct
  source 1..6325: mol_type = other DNA
tttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcatttaaatttccgaactctccaaggccctcgtcggaaaatcttcaaacctttcgtccgatccatcttgcaggctacctctcgaacgaactatcgcaagtctcttggccggccttgcgccttggctattgcttggcagcgcctatcgccaggtattactccaatcccgaatatccgagatcgggatcacccgagagaagttcaacctacatcctcaatcccgatctatccgagatccgaggaatatcgaaatcggggcgcgcctggtgtaccgagaacgatcctctcagtgcgagtctcgacgatccatatcgttgcttggcagtcagccagtcggaatccagcttgggacccaggaagtccaatcgtcagatattgtactcaagcctggtcacggcagcgtaccgatctgtttaaacctagatattgatagtctgatcggtcaacgtataatcgagtcctagcttttgcaaacatctatcaagagacaggatcagcaggaggctttcgcatgagtattcaacatttccgtgtcgcccttattcccttttttgcggcattttgccttcctgtttttgctcacccagaaacgctggtgaaagtaaaagatgctgaagatcagttgggtgcgcgagtgggttacatcgaactggatctcaacagcggtaagatccttgagagttttcgccccgaagaacgctttccaatgatgagcacttttaaagttctgctatgtggcgcggtattatcccgtattgacgccgggcaagagcaactcggtcgccgcatacactattctcagaatgacttggttgagtattcaccagtcacagaaaagcatcttacggatggcatgacagtaagagaattatgcagtgctgccataaccatgagtgataacactgcggccaacttacttctgacaacgattggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaaccttgcgtaaactattaactggcgaactacttactctagcttcccggcaacagttgatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaaccgattctaggtgcattggcgcagaaaaaaatgcctgatgcgacgctgcgcgtcttatactcccacatatgccagattcagcaacggatacggcttccccaacttgcccacttccatacgtgtcctccttaccagaaatttatccttaagatcccgaatcgtttaaactcgactctggctctatcgaatctccgtcgtttcgagcttacgcgaacagccgtggcgctcatttgctcgtcgggcatcgaatctcgtcagctatcgtcagcttacctttttggcagcgatcgcggctcccgacatcttggaccattagctccacaggtatcttcttccctctagtggtcataacagcagcttcagctacctctcaattcaaaaaacccctcaagacccgtttagaggccccaaggggttatgctatcaatcgttgcgttacacacacaaaaaaccaacacacatccatcttcgatggatagcgattttattatctaactgctgatcgagtgtagccagatctagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatgctgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctggtttagtgaaccgtcagatcgcctggagacgccatccacgctgttttgacctccatagaagacaccgggaccgatccagcctcccctcgaagcttacatgtggtaccgagctcggatcctgagaacttcagggtgagtctatgggacccttgatgttttctttccccttcttttctatggttaagttcatgtcataggaaggggagaagtaacagggtacacatattgaccaaatcagggtaattttgcatttgtaattttaaaaaatgctttcttcttttaatatacttttttgtttatcttatttctaatactttccctaatctctttctttcagggcaataatgatacaatgtatcatgcctctttgcaccattctaaagaataacagtgataatttctgggttaaggcaatagcaatatttctgcatataaatatttctgcatataaattgtaactgatgtaagaggtttcatattgctaatagcagctacaatccagctaccattctgcttttattttatggttgggataaggctggattattctgagtccaagctaggcccttttgctaatcatgttcatacctcttatcttcctcccacagctcctgggcaacgtgctggtctgtgtgctggcccatcactttggcaaaggcggccgcgccgccaccatgaagtgcttgctctacctggccttcctcttcattggcgttaactgcaagtttacaatcgtgttcccccataaccagaagggcaactggaaaaatgttcctgctaactaccagtactgcccatcctcatcggatctgaactggcataatgggctgataggaacgtccctccaggtgaagatgccaaaatcacacaaagccattcaagcagacggctggatgtgtcatgcggcgaagtgggtgacaacgtgcgactttcggtggtatggtcctaagtatgtcacacactcaataaagtccatgattccaactgtagaccagtgcaaagagagtatcgcccagactaagcaaggcacctggctgaaccctggctttccgccccagtcttgcggctatgccagcgtcactgacgctgaggcagtcattgtaaaagccacccctcatcaagtgctggtggacgagtatactggtgaatgggtggacagccagttccccactgggaaatgtaacaaggacatctgtcccactgtgcacaatagcacaacctggcatagtgactacaaagtcacaggcttatgtgatgccaatctaatctctatggacataactttctttagtgaggacggcaagcttacttcactcgggaaagagggaacaggatttcggagtaactactttgcttacgaaaatggtgacaaggcttgccggatgcagtattgtaagcactggggcgttcgcctcccaagtggagtttggtttgagatggctgataaggacatctacaacgatgctaaattccctgattgcccagaaggctcaagcattgccgcaccctcccagacatccgttgatgtcagcctcatccaggatgtggagaggattctggactattccctgtgccaggaaacctggtcaaaaatcagagcacacctgcccattagccccgttgacctatcttatctgagtccaaaaaaccctggaacaggaccagcattcaccatcataaatgggaccctgaaatatttcgagacgaggtacatccgagtggacattgcgggaccgattataccccaaatgcgaggggtaatcagcggaaccaccaccgagagagaactttggaccgattggtacccctacgaagatgtagagattggtcccaacggggtcctgaagaccgccactggctataagttcccactgtacatgatcggacacggcatgttggactccgatttacacatctcttccaaggcccaggtgttcgaacacccacacatccaggatgctgccagccaacttcctgacgatgagacgctcttctttggtgacacaggtttgtctaagaatccgattgagttggtggaagggtggttcagcgggtggaaatctaccatagcctcgtttttctttatcattggactggtgattggcctctacctcgtccttcgcatcgggattgccctgtgcataaaatgtagggtccaggaaaagcgccctaagatctacaccgatgtggagatgaatagattagaccgttgagctagcttgactgactgagatacagcgtaccttcagctcacagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtattggcccatctctatcggtatcgtagcataaccccttggggcctctaaacgggtcttgaggggttttttgtgcccctcgggccggattgctatctaccggcattggcgcagaaaaaaatgcctgatgcgacgctgcgcgtcttatactcccacatatgccagattcagcaacggatacggcttccccaacttgcccacttccatacgtgtcctccttaccagaaatttatccttaaggtcgtcagctatcctgcaggcgatctctcgatttcgatcaagacattcctttaatggtcttttctggacaccactaggggtcagaagtagttcatcaaactttcttccctccctaatctcattggttaccttgggctatcgaaacttaattaaccagtcaagtcagctacttggcgagatcgacttgtctgggtttcgactacgctcagaattgcgtcagtcaagttcgatctggtccttgctattgcacccgttctccgattacgagtttcatttaaatcatgtgagcaaaaggccagcaaaaggccaggaaccgtaaaaaggccgcgttgctggcgtt

SEQ ID NO: 16531 - DNA, 8889 bp, synthetic construct
  source 1..8889: mol_type = other DNA
cagcaaagctcctctggaaaggtgaaggggcagtagtaatacaagataatagtgacataaaagtagtgccaagaagaaaagcaaagatcatcagggattatggaaaacagatggcaggtgatgattgtgtggcaagtagacaggatgaggattaacacatggaattccggagcggccgcaggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttccgcggaattcaccccaccagtgcaggctgcctatcagaaagtggtggctggtgtggctaatgccctggcccacaagtatcactaagctcgctttcttgctgtccaatttctattaaaggttcctttgttccctaagtccaactactaaactgggggatattatgaagggccttgagcatctggattctgcctaataaaaaacatttattttcattgcaatgatgtatttaaattatttctgaatattttactaaaaagggaatgtgggaggtcagtgcatttaaaacataaagaaatgaagagctagttcaaaccttgggaaaatacactatatcttaaactccatgaaagaaggtgaggctgcaaacagctaatgcacattggcaacagcccctgatgcctatgccttattcatccctcagaaaaggattcaagtagaggcttgatttggaggttaaagttttgctatgctgtattttacattacttattgttttagctgtcctcatgaatgtcttttcactacccatttgcttatcctgcatctctcagccttgactccactcagttctcttgcttagagataccacctttcccctgaagtgttccttccatgttttacggcgagatggtttctcctcgcctggccactcagccttagttgtctctgttgtcttatagaggtctacttgaagaaggaaaaacagggggcatggtttgactgtcctgtgagcccttcttccctgcctcccccactcacagtgacccggaatccctcgacatggcagtctagcactagtgcggccgcagatctgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgggatcccctgagggggcccccatgggctagaggatccggcctcggcctctgcataaataaaaaaaattagtcagccatgagcttggcccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctcccctcgaagcttacatgtggtaccgagctcggatcctgagaacttcagggtgagtctatgggacccttgatgttttctttccccttcttttctatggttaagttcatgtcataggaaggggagaagtaacagggtacacatattgaccaaatcagggtaattttgcatttgtaattttaaaaaatgctttcttcttttaatatacttttttgtttatcttatttctaatactttccctaatctctttctttcagggcaataatgatacaatgtatcatgcctctttgcaccattctaaagaataacagtgataatttctgggttaaggcaatagcaatatttctgcatataaatatttctgcatataaattgtaactgatgtaagaggtttcatattgctaatagcagctacaatccagctaccattctgcttttattttatggttgggataaggctggattattctgagtccaagctaggcccttttgctaatcatgttcatacctcttatcttcctcccacagctcctgggcaacgtgctggtctgtgtgctggcccatcactttggcaaagcacgtgagatctgaattcgagatctgccgccgccatgggtgcgagagcgtcagtattaagcgggggagaattagatcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaaaaaagcacagcaagcagcagctgacacaggacacagcaatcaggtcagccaaaattaccctatagtgcagaacatccaggggcaaatggtacatcaggccatatcacctagaactttaaatgcatgggtaaaagtagtagaagagaaggctttcagcccagaagtgatacccatgttttcagcattatcagaaggagccaccccacaagatttaaacaccatgctaaacacagtggggggacatcaagcagccatgcaaatgttaaaagagaccatcaatgaggaagctgcagaatgggatagagtgcatccagtgcatgcagggcctattgcaccaggccagatgagagaaccaaggggaagtgacatagcaggaactactagtacccttcaggaacaaataggatggatgacacataatccacctatcccagtaggagaaatctataaaagatggataatcctgggattaaataaaatagtaagaatgtatagccctaccagcattctggacataagacaaggaccaaaggaaccctttagagactatgtagaccgattctataaaactctaagagccgagcaagcttcacaagaggtaaaaaattggatgacagaaaccttgttggtccaaaatgcgaacccagattgtaagactattttaaaagcattgggaccaggagcgacactagaagaaatgatgacagcatgtcagggagtggggggacccggccataaagcaagagttttggctgaagcaatgagccaagtaacaaatccagctaccataatgatacagaaaggcaattttaggaaccaaagaaagactgttaagtgtttcaattgtggcaaagaagggcacatagccaaaaattgcagggcccctaggaaaaagggctgttggaaatgtggaaaggaaggacaccaaatgaaagattgtactgagagacaggctaattttttagggaagatctggccttcccacaagggaaggccagggaattttcttcagagcagaccagagccaacagccccaccagaagagagcttcaggtttggggaagagacaacaactccctctcagaagcaggagccgatagacaaggaactgtatcctttagcttccctcagatcactctttggcagcgacccctcgtcacaataaagataggggggcaattaaaggaagctctattagatacaggagcagatgatacagtattagaagaaatgaatttgccaggaagatggaaaccaaaaatgatagggggaattggaggttttatcaaagtaagacagtatgatcagatactcatagaaatctgcggacataaagctataggtacagtattagtaggacctacacctgtcaacataattggaagaaatctgttgactcagattggctgcactttaaattttcccattagtcctattgagactgtaccagtaaaattaaagccaggaatggatggcccaaaagttaaacaatggccattgacagaagaaaaaataaaagcattagtagaaatttgtacagaaatggaaaaggaaggaaaaatttcaaaaattgggcctgaaaatccatacaatactccagtatttgccataaagaaaaaagacagtactaaatggagaaaattagtagatttcagagaacttaataagagaactcaagatttctgggaagttcaattaggaataccacatcctgcagggttaaaacagaaaaaatcagtaacagtactggatgtgggcgatgcatatttttcagttcccttagataaagacttcaggaagtatactgcatttaccatacctagtataaacaatgagacaccagggattagatatcagtacaatgtgcttccacagggatggaaaggatcaccagcaatattccagtgtagcatgacaaaaatcttagagccttttagaaaacaaaatccagacatagtcatctatcaatacatggatgatttgtatgtaggatctgacttagaaatagggcagcatagaacaaaaatagaggaactgagacaacatctgttgaggtggggatttaccacaccagacaaaaaacatcagaaagaacctccattcctttggatgggttatgaactccatcctgataaatggacagtacagcctatagtgctgccagaaaaggacagctggactgtcaatgacatacagaaattagtgggaaaattgaattgggcaagtcagatttatgcagggattaaagtaaggcaattatgtaaacttcttaggggaaccaaagcactaacagaagtagtaccactaacagaagaagcagagctagaactggcagaaaacagggagattctaaaagaaccggtacatggagtgtattatgacccatcaaaagacttaatagcagaaatacagaagcaggggcaaggccaatggacatatcaaatttatcaagagccatttaaaaatctgaaaacaggaaagtatgcaagaatgaagggtgcccacactaatgatgtgaaacaattaacagaggcagtacaaaaaatagccacagaaagcatagtaatatggggaaagactcctaaatttaaattacccatacaaaaggaaacatgggaagcatggtggacagagtattggcaagccacctggattcctgagtgggagtttgtcaatacccctcccttagtgaagttatggtaccagttagagaaagaacccataataggagcagaaactttctatgtagatggggcagccaatagggaaactaaattaggaaaagcaggatatgtaactgacagaggaagacaaaaagttgtccccctaacggacacaacaaatcagaagactgagttacaagcaattcatctagctttgcaggattcgggattagaagtaaacatagtgacagactcacaatatgcattgggaatcattcaagcacaaccagataagagtgaatcagagttagtcagtcaaataatagagcagttaataaaaaaggaaaaagtctacctggcatgggtaccagcacacaaaggaattggaggaaatgaacaagtagataaattggtcagtgctggaatcaggaaagtactatttttagatggaatagataaggcccaagaagaacatgagaaatatcacagtaattggagagcaatggctagtgattttaacctaccacctgtagtagcaaaagaaatagtagccagctgtgataaatgtcagctaaaaggggaagccatgcatggacaagtagactgtagcccaggaatatggcagctagattgtacacatttagaaggaaaagttatcttggtagcagttcatgtagccagtggatatatagaagcagaagtaattccagcagagacagggcaagaaacagcatacttcctcttaaaattagcaggaagatggccagtaaaaacagtacatacagacaatggcagcaatttcaccagtactacagttaaggccgcctgttggtgggcggggatcaagcaggaatttggcattccctacaatccccaaagtcaaggagtaatagaatctatgaataaagaattaaagaaaattataggacaggtaagagatcaggctgaacatcttaagacagcagtacaaatggcagtattcatccacaattttaaaagaaaaggggggattggggggtacagtgcaggggaaagaatagtagacataatagcaacagacatacaaactaaagaattacaaaaacaaattacaaaaattcaaaattttcgggtttattacagggacagcagagatccagtttggaaaggac

SEQ ID NO: 16532 - DNA, 9897 bp, synthetic construct
  source 1..9897: mol_type = other DNA
tgccctggcccacaagtatcactaagctcgctttcttgctgtccaatttctattaaaggttcctttgttccctaagtccaactactaaactgggggatattatgaagggccttgagcatctggattctgcctaataaaaaacatttattttcattgcaatgatgtatttaaattatttctgaatattttactaaaaagggaatgtgggaggtcagtgcatttaaaacataaagaaatgaagagctagttcaaaccttgggaaaatacactatatcttaaactccatgaaagaaggtgaggctgcaaacagctaatgcacattggcaacagcccctgatgcctatgccttattcatccctcagaaaaggattcaagtagaggcttgatttggaggttaaagttttgctatgctgtattttacattacttattgttttagctgtcctcatgaatgtcttttcactacccatttgcttatcctgcatctctcagccttgactccactcagttctcttgcttagagataccacctttcccctgaagtgttccttccatgttttacggcgagatggtttctcctcgcctggccactcagccttagttgtctctgttgtcttatagaggtctacttgaagaaggaaaaacagggggcatggtttgactgtcctgtgagcccttcttccctgcctcccccactcacagtgacccggaatccctcgacatggcagtctagcactagtgcggccgcagatctgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgggatcccctgagggggcccccatgggctagaggatccggcctcggcctctgcataaataaaaaaaattagtcagccatgagcttggcccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctcccctcgaagcttacatgtggtaccgagctcggatcctgagaacttcagggtgagtctatgggacccttgatgttttctttccccttcttttctatggttaagttcatgtcataggaaggggagaagtaacagggtacacatattgaccaaatcagggtaattttgcatttgtaattttaaaaaatgctttcttcttttaatatacttttttgtttatcttatttctaatactttccctaatctctttctttcagggcaataatgatacaatgtatcatgcctctttgcaccattctaaagaataacagtgataatttctgggttaaggcaatagcaatatttctgcatataaatatttctgcatataaattgtaactgatgtaagaggtttcatattgctaatagcagctacaatccagctaccattctgcttttattttatggttgggataaggctggattattctgagtccaagctaggcccttttgctaatcatgttcatacctcttatcttcctcccacagctcctgggcaacgtgctggtctgtgtgctggcccatcactttggcaaagcacgtgagatctgaattcgagatctgccgccgccatgggtgcgagagcgtcagtattaagcgggggagaattagatcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaaaaaagcacagcaagcagcagctgacacaggacacagcaatcaggtcagccaaaattaccctatagtgcagaacatccaggggcaaatggtacatcaggccatatcacctagaactttaaatgcatgggtaaaagtagtagaagagaaggctttcagcccagaagtgatacccatgttttcagcattatcagaaggagccaccccacaagatttaaacaccatgctaaacacagtggggggacatcaagcagccatgcaaatgttaaaagagaccatcaatgaggaagctgcagaatgggatagagtgcatccagtgcatgcagggcctattgcaccaggccagatgagagaaccaaggggaagtgacatagcaggaactactagtacccttcaggaacaaataggatggatgacacataatccacctatcccagtaggagaaatctataaaagatggataatcctgggattaaataaaatagtaagaatgtatagccctaccagcattctggacataagacaaggaccaaaggaaccctttagagactatgtagaccgattctataaaactctaagagccgagcaagcttcacaagaggtaaaaaattggatgacagaaaccttgttggtccaaaatgcgaacccagattgtaagactattttaaaagcattgggaccaggagcgacactagaagaaatgatgacagcatgtcagggagtggggggacccggccataaagcaagagttttggctgaagcaatgagccaagtaacaaatccagctaccataatgatacagaaaggcaattttaggaaccaaagaaagactgttaagtgtttcaattgtggcaaagaagggcacatagccaaaaattgcagggcccctaggaaaaagggctgttggaaatgtggaaaggaaggacaccaaatgaaagattgtactgagagacaggctaattttttagggaagatctggccttcccacaagggaaggccagggaattttcttcagagcagaccagagccaacagccccaccagaagagagcttcaggtttggggaagagacaacaactccctctcagaagcaggagccgatagacaaggaactgtatcctttagcttccctcagatcactctttggcagcgacccctcgtcacaaaactttagccagaactatccgattgtgcagaccggtatggacaagaagtacagcatcggcctggacatcggcaccaactctgtgggctgggccgtgatcaccgacgagtacaaggtgcccagcaagaaattcaaggtgctgggcaacaccgaccggcacagcatcaagaagaacctgatcggcgccctgctgttcgacagcggagaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggcaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacatcgatggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgccagcgcccagagcttcatcgagcggatgaccaacttcgataagaacctgcccaacgagaaggtgctgcccaagcacagcctgctgtacgagtacttcaccgtgtacaacgagctgaccaaagtgaaatacgtgaccgagggaatgagaaagcccgccttcctgagcggcgagcagaaaaaagccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggaccatatcgtgcctcagagctttctgaaggacgactccatcgataacaaagtgctgactcggagcgacaagaaccggggcaagagcgacaacgtgccctccgaagaggtcgtgaagaagatgaagaactactggcgccagctgctgaatgccaagctgattacccagaggaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaacgacaaactgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaacaggcgagatcgtgtgggataagggccgggactttgccaccgtgcggaaagtgctgtctatgccccaagtgaatatcgtgaaaaagaccgaggtgcagacaggcggcttcagcaaagagtctatcctgcccaagaggaacagcgacaagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaaacactacctggacgagatcatcgagcagatcagcgagttctccaagagagtgatcctggccgacgctaatctggacaaggtgctgagcgcctacaacaagcacagagacaagcctatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggcgacgccgactataaggaccacgacggagactacaaggatcatgatattgattacaaagacgatgacgataagagcctgggcagcggctcccccaagaaaaaacgcaaggtggaagatcctaagaaaaagcggaaagtgtaa

SEQ ID NO: 16533 - DNA, 10020 bp, synthetic construct
  source 1..10020: mol_type = other DNA
ggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgggatcccctgagggggcccccatgggctagaggatccggcctcggcctctgcataaataaaaaaaattagtcagccatgagcttggcccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctcccctcgaagcttacatgtggtaccgagctcggatcctgagaacttcagggtgagtctatgggacccttgatgttttctttccccttcttttctatggttaagttcatgtcataggaaggggagaagtaacagggtacacatattgaccaaatcagggtaattttgcatttgtaattttaaaaaatgctttcttcttttaatatacttttttgtttatcttatttctaatactttccctaatctctttctttcagggcaataatgatacaatgtatcatgcctctttgcaccattctaaagaataacagtgataatttctgggttaaggcaatagcaatatttctgcatataaatatttctgcatataaattgtaactgatgtaagaggtttcatattgctaatagcagctacaatccagctaccattctgcttttattttatggttgggataaggctggattattctgagtccaagctaggcccttttgctaatcatgttcatacctcttatcttcctcccacagctcctgggcaacgtgctggtctgtgtgctggcccatcactttggcaaagcacgtgagatctgaattcgagatctgccgccgccatgggtgcgagagcgtcagtattaagcgggggagaattagatcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaaaaaagcacagcaagcagcagctgacacaggacacagcaatcaggtcagccaaaattaccctatagtgcagaacatccaggggcaaatggtacatcaggccatatcacctagaactttaaatgcatgggtaaaagtagtagaagagaaggctttcagcccagaagtgatacccatgttttcagcattatcagaaggagccaccccacaagatttaaacaccatgctaaacacagtggggggacatcaagcagccatgcaaatgttaaaagagaccatcaatgaggaagctgcagaatgggatagagtgcatccagtgcatgcagggcctattgcaccaggccagatgagagaaccaaggggaagtgacatagcaggaactactagtacccttcaggaacaaataggatggatgacacataatccacctatcccagtaggagaaatctataaaagatggataatcctgggattaaataaaatagtaagaatgtatagccctaccagcattctggacataagacaaggaccaaaggaaccctttagagactatgtagaccgattctataaaactctaagagccgagcaagcttcacaagaggtaaaaaattggatgacagaaaccttgttggtccaaaatgcgaacccagattgtaagactattttaaaagcattgggaccaggagcgacactagaagaaatgatgacagcatgtcagggagtggggggacccggccataaagcaagagttttggctgaagcaatgagccaagtaacaaatccagctaccataatgatacagaaaggcaattttaggaaccaaagaaagactgttaagtgtttcaattgtggcaaagaagggcacatagccaaaaattgcagggcccctaggaaaaagggctgttggaaatgtggaaaggaaggacaccaaatgaaagattgtactgagagacaggctaattttttagggaagatctggccttcccacaagggaaggccagggaattttcttcagagcagaccagagccaacagccccaccagaagagagcttcaggtttggggaagagacaacaactccctctcagaagcaggagccgatagacaaggaactgtatcctttagcttccctcagatcactctttggcagcgacccctcgtcacaaaactttagcggaggtagccttcagttgcccccgcttgagcgactcacacttggatcacttcaactgcccccgttggagcgacttacactgggtagtcttcaattgcctcctttggaaagactcactcttagccagaactatccgattgtgcagaccggtatggacaagaagtacagcatcggcctggacatcggcaccaactctgtgggctgggccgtgatcaccgacgagtacaaggtgcccagcaagaaattcaaggtgctgggcaacaccgaccggcacagcatcaagaagaacctgatcggcgccctgctgttcgacagcggagaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggcaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacatcgatggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgccagcgcccagagcttcatcgagcggatgaccaacttcgataagaacctgcccaacgagaaggtgctgcccaagcacagcctgctgtacgagtacttcaccgtgtacaacgagctgaccaaagtgaaatacgtgaccgagggaatgagaaagcccgccttcctgagcggcgagcagaaaaaagccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggaccatatcgtgcctcagagctttctgaaggacgactccatcgataacaaagtgctgactcggagcgacaagaaccggggcaagagcgacaacgtgccctccgaagaggtcgtgaagaagatgaagaactactggcgccagctgctgaatgccaagctgattacccagaggaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaacgacaaactgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaacaggcgagatcgtgtgggataagggccgggactttgccaccgtgcggaaagtgctgtctatgccccaagtgaatatcgtgaaaaagaccgaggtgcagacaggcggcttcagcaaagagtctatcctgcccaagaggaacagcgacaagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaaacactacctggacgagatcatcgagcagatcagcgagttctccaagagagtgatcctggccgacgctaatctggacaaggtgctgagcgcctacaacaagcacagagacaagcctatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggcgacgccgactataaggaccacgacggagactacaaggatcatgatattgattacaaagacgatgacgataagagcctgggcagcggctcccccaagaaaaaacgcaaggtggaagatcctaagaaaaagcggaaagtgtaatgccctggcccacaagtatcactaagctcgctttcttgctgtccaatttctattaaaggttcctttgttccctaagtccaactactaaactgggggatattatgaagggccttgagcatctggattctgcctaataaaaaacatttattttcattgcaatgatgtatttaaattatttctgaatattttactaaaaagggaatgtgggaggtcagtgcatttaaaacataaagaaatgaagagctagttcaaaccttgggaaaatacactatatcttaaactccatgaaagaaggtgaggctgcaaacagctaatgcacattggcaacagcccctgatgcctatgccttattcatccctcagaaaaggattcaagtagaggcttgatttggaggttaaagttttgctatgctgtattttacattacttattgttttagctgtcctcatgaatgtcttttcactacccatttgcttatcctgcatctctcagccttgactccactcagttctcttgcttagagataccacctttcccctgaagtgttccttccatgttttacggcgagatggtttctcctcgcctggccactcagccttagttgtctctgttgtcttatagaggtctacttgaagaaggaaaaacagggggcatggtttgactgtcctgtgagcccttcttccctgcctcccccactcacagtgacccggaatccctcgacatggcagtctagcactagtgcggccgcagatctgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagtt

SEQ ID NO: 16534 - DNA, 10360 bp, synthetic construct
  source 1..10360: mol_type = other DNA
aactttagccagaactatccgattgtgcagaccggtatggacaagaagtacagcatcggcctggacatcggcaccaactctgtgggctgggccgtgatcaccgacgagtacaaggtgcccagcaagaaattcaaggtgctgggcaacaccgaccggcacagcatcaagaagaacctgatcggcgccctgctgttcgacagcggagaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggcaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacatcgatggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgccagcgcccagagcttcatcgagcggatgaccaacttcgataagaacctgcccaacgagaaggtgctgcccaagcacagcctgctgtacgagtacttcaccgtgtacaacgagctgaccaaagtgaaatacgtgaccgagggaatgagaaagcccgccttcctgagcggcgagcagaaaaaagccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggaccatatcgtgcctcagagctttctgaaggacgactccatcgataacaaagtgctgactcggagcgacaagaaccggggcaagagcgacaacgtgccctccgaagaggtcgtgaagaagatgaagaactactggcgccagctgctgaatgccaagctgattacccagaggaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaacgacaaactgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaacaggcgagatcgtgtgggataagggccgggactttgccaccgtgcggaaagtgctgtctatgccccaagtgaatatcgtgaaaaagaccgaggtgcagacaggcggcttcagcaaagagtctatcctgcccaagaggaacagcgacaagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaaacactacctggacgagatcatcgagcagatcagcgagttctccaagagagtgatcctggccgacgctaatctggacaaggtgctgagcgcctacaacaagcacagagacaagcctatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggcgacgccgactataaggaccacgacggagactacaaggatcatgatattgattacaaagacgatgacgataagagcctgggcagcggctcccccaagaaaaaacgcaaggtggaagatcctaagaaaaagcggaaagtgtaacacatggaattccggagcggccgcaggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttccgcggaattcaccccaccagtgcaggctgcctatcagaaagtggtggctggtgtggctaatgccctggcccacaagtatcactaagctcgctttcttgctgtccaatttctattaaaggttcctttgttccctaagtccaactactaaactgggggatattatgaagggccttgagcatctggattctgcctaataaaaaacatttattttcattgcaatgatgtatttaaattatttctgaatattttactaaaaagggaatgtgggaggtcagtgcatttaaaacataaagaaatgaagagctagttcaaaccttgggaaaatacactatatcttaaactccatgaaagaaggtgaggctgcaaacagctaatgcacattggcaacagcccctgatgcctatgccttattcatccctcagaaaaggattcaagtagaggcttgatttggaggttaaagttttgctatgctgtattttacattacttattgttttagctgtcctcatgaatgtcttttcactacccatttgcttatcctgcatctctcagccttgactccactcagttctcttgcttagagataccacctttcccctgaagtgttccttccatgttttacggcgagatggtttctcctcgcctggccactcagccttagttgtctctgttgtcttatagaggtctacttgaagaaggaaaaacagggggcatggtttgactgtcctgtgagcccttcttccctgcctcccccactcacagtgacccggaatccctcgacatggcagtctagcactagtgcggccgcagatctgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgggatcccctgagggggcccccatgggctagaggatccggcctcggcctctgcataaataaaaaaaattagtcagccatgagcttggcccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctcccctcgaagcttacatgtggtaccgagctcggatcctgagaacttcagggtgagtctatgggacccttgatgttttctttccccttcttttctatggttaagttcatgtcataggaaggggagaagtaacagggtacacatattgaccaaatcagggtaattttgcatttgtaattttaaaaaatgctttcttcttttaatatacttttttgtttatcttatttctaatactttccctaatctctttctttcagggcaataatgatacaatgtatcatgcctctttgcaccattctaaagaataacagtgataatttctgggttaaggcaatagcaatatttctgcatataaatatttctgcatataaattgtaactgatgtaagaggtttcatattgctaatagcagctacaatccagctaccattctgcttttattttatggttgggataaggctggattattctgagtccaagctaggcccttttgctaatcatgttcatacctcttatcttcctcccacagctcctgggcaacgtgctggtctgtgtgctggcccatcactttggcaaagcacgtgagatctgaattcgagatctgccgccgccatgggtgcgagagcgtcagtattaagcgggggagaattagatcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaaaaaagcacagcaagcagcagctgacacaggacacagcaatcaggtcagccaaaattaccctatagtgcagaacatccaggggcaaatggtacatcaggccatatcacctagaactttaaatgcatgggtaaaagtagtagaagagaaggctttcagcccagaagtgatacccatgttttcagcattatcagaaggagccaccccacaagatttaaacaccatgctaaacacagtggggggacatcaagcagccatgcaaatgttaaaagagaccatcaatgaggaagctgcagaatgggatagagtgcatccagtgcatgcagggcctattgcaccaggccagatgagagaaccaaggggaagtgacatagcaggaactactagtacccttcaggaacaaataggatggatgacacataatccacctatcccagtaggagaaatctataaaagatggataatcctgggattaaataaaatagtaagaatgtatagccctaccagcattctggacataagacaaggaccaaaggaaccctttagagactatgtagaccgattctataaaactctaagagccgagcaagcttcacaagaggtaaaaaattggatgacagaaaccttgttggtccaaaatgcgaacccagattgtaagactattttaaaagcattgggaccaggagcgacactagaagaaatgatgacagcatgtcagggagtggggggacccggccataaagcaagagttttggctgaagcaatgagccaagtaacaaatccagctaccataatgatacagaaaggcaattttaggaaccaaagaaagactgttaagtgtttcaattgtggcaaagaagggcacatagccaaaaattgcagggcccctaggaaaaagggctgttggaaatgtggaaaggaaggacaccaaatgaaagattgtactgagagacaggctaattttttagggaagatctggccttcccacaagggaaggccagggaattttcttcagagcagaccagagccaacagccccaccagaagagagcttcaggtttggggaagagacaacaactccctctcagaagcaggagccgatagacaaggaactgtatcctttagcttccctcagatcactctttggcagcgacccctcgtcacaa

SEQ ID NO: 16535 - DNA, 13152 bp, synthetic construct
  source 1..13152: mol_type = other DNA
cagcaaagctcctctggaaaggtgaaggggcagtagtaatacaagataatagtgacataaaagtagtgccaagaagaaaagcaaagatcatcagggattatggaaaacagatggcaggtgatgattgtgtggcaagtagacaggatgaggattaacacatggaattccggagcggccgcaggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttccgcggaattcaccccaccagtgcaggctgcctatcagaaagtggtggctggtgtggctaatgccctggcccacaagtatcactaagctcgctttcttgctgtccaatttctattaaaggttcctttgttccctaagtccaactactaaactgggggatattatgaagggccttgagcatctggattctgcctaataaaaaacatttattttcattgcaatgatgtatttaaattatttctgaatattttactaaaaagggaatgtgggaggtcagtgcatttaaaacataaagaaatgaagagctagttcaaaccttgggaaaatacactatatcttaaactccatgaaagaaggtgaggctgcaaacagctaatgcacattggcaacagcccctgatgcctatgccttattcatccctcagaaaaggattcaagtagaggcttgatttggaggttaaagttttgctatgctgtattttacattacttattgttttagctgtcctcatgaatgtcttttcactacccatttgcttatcctgcatctctcagccttgactccactcagttctcttgcttagagataccacctttcccctgaagtgttccttccatgttttacggcgagatggtttctcctcgcctggccactcagccttagttgtctctgttgtcttatagaggtctacttgaagaaggaaaaacagggggcatggtttgactgtcctgtgagcccttcttccctgcctcccccactcacagtgacccggaatccctcgacatggcagtctagcactagtgcggccgcagatctgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgggatcccctgagggggcccccatgggctagaggatccggcctcggcctctgcataaataaaaaaaattagtcagccatgagcttggcccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctcccctcgaagcttacatgtggtaccgagctcggatcctgagaacttcagggtgagtctatgggacccttgatgttttctttccccttcttttctatggttaagttcatgtcataggaaggggagaagtaacagggtacacatattgaccaaatcagggtaattttgcatttgtaattttaaaaaatgctttcttcttttaatatacttttttgtttatcttatttctaatactttccctaatctctttctttcagggcaataatgatacaatgtatcatgcctctttgcaccattctaaagaataacagtgataatttctgggttaaggcaatagcaatatttctgcatataaatatttctgcatataaattgtaactgatgtaagaggtttcatattgctaatagcagctacaatccagctaccattctgcttttattttatggttgggataaggctggattattctgagtccaagctaggcccttttgctaatcatgttcatacctcttatcttcctcccacagctcctgggcaacgtgctggtctgtgtgctggcccatcactttggcaaagcacgtgagatctgaattcgagatctgccgccgccatggacaagaagtacagcatcggcctggacatcggcaccaactctgtgggctgggccgtgatcaccgacgagtacaaggtgcccagcaagaaattcaaggtgctgggcaacaccgaccggcacagcatcaagaagaacctgatcggcgccctgctgttcgacagcggagaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggcaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacatcgatggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgccagcgcccagagcttcatcgagcggatgaccaacttcgataagaacctgcccaacgagaaggtgctgcccaagcacagcctgctgtacgagtacttcaccgtgtacaacgagctgaccaaagtgaaatacgtgaccgagggaatgagaaagcccgccttcctgagcggcgagcagaaaaaagccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggaccatatcgtgcctcagagctttctgaaggacgactccatcgataacaaagtgctgactcggagcgacaagaaccggggcaagagcgacaacgtgccctccgaagaggtcgtgaagaagatgaagaactactggcgccagctgctgaatgccaagctgattacccagaggaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaacgacaaactgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaacaggcgagatcgtgtgggataagggccgggactttgccaccgtgcggaaagtgctgtctatgccccaagtgaatatcgtgaaaaagaccgaggtgcagacaggcggcttcagcaaagagtctatcctgcccaagaggaacagcgacaagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaaacactacctggacgagatcatcgagcagatcagcgagttctccaagagagtgatcctggccgacgctaatctggacaaggtgctgagcgcctacaacaagcacagagacaagcctatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggcgacgccgactataaggaccacgacggagactacaaggatcatgatattgattacaaagacgatgacgataagagcctgggcagcggctcccccaagaaaaaacgcaaggtggaagatcctaagaaaaagcggaaagtgagccagaactatccgattgtgcagatgggtgcgagagcgtcagtattaagcgggggagaattagatcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaaaaaagcacagcaagcagcagctgacacaggacacagcaatcaggtcagccaaaattaccctatagtgcagaacatccaggggcaaatggtacatcaggccatatcacctagaactttaaatgcatgggtaaaagtagtagaagagaaggctttcagcccagaagtgatacccatgttttcagcattatcagaaggagccaccccacaagatttaaacaccatgctaaacacagtggggggacatcaagcagccatgcaaatgttaaaagagaccatcaatgaggaagctgcagaatgggatagagtgcatccagtgcatgcagggcctattgcaccaggccagatgagagaaccaaggggaagtgacatagcaggaactactagtacccttcaggaacaaataggatggatgacacataatccacctatcccagtaggagaaatctataaaagatggataatcctgggattaaataaaatagtaagaatgtatagccctaccagcattctggacataagacaaggaccaaaggaaccctttagagactatgtagaccgattctataaaactctaagagccgagcaagcttcacaagaggtaaaaaattggatgacagaaaccttgttggtccaaaatgcgaacccagattgtaagactattttaaaagcattgggaccaggagcgacactagaagaaatgatgacagcatgtcagggagtggggggacccggccataaagcaagagttttggctgaagcaatgagccaagtaacaaatccagctaccataatgatacagaaaggcaattttaggaaccaaagaaagactgttaagtgtttcaattgtggcaaagaagggcacatagccaaaaattgcagggcccctaggaaaaagggctgttggaaatgtggaaaggaaggacaccaaatgaaagattgtactgagagacaggctaattttttagggaagatctggccttcccacaagggaaggccagggaattttcttcagagcagaccagagccaacagccccaccagaagagagcttcaggtttggggaagagacaacaactccctctcagaagcaggagccgatagacaaggaactgtatcctttagcttccctcagatcactctttggcagcgacccctcgtcacaataaagataggggggcaattaaaggaagctctattagatacaggagcagatgatacagtattagaagaaatgaatttgccaggaagatggaaaccaaaaatgatagggggaattggaggttttatcaaagtaagacagtatgatcagatactcatagaaatctgcggacataaagctataggtacagtattagtaggacctacacctgtcaacataattggaagaaatctgttgactcagattggctgcactttaaattttcccattagtcctattgagactgtaccagtaaaattaaagccaggaatggatggcccaaaagttaaacaatggccattgacagaagaaaaaataaaagcattagtagaaatttgtacagaaatggaaaaggaaggaaaaatttcaaaaattgggcctgaaaatccatacaatactccagtatttgccataaagaaaaaagacagtactaaatggagaaaattagtagatttcagagaacttaataagagaactcaagatttctgggaagttcaattaggaataccacatcctgcagggttaaaacagaaaaaatcagtaacagtactggatgtgggcgatgcatatttttcagttcccttagataaagacttcaggaagtatactgcatttaccatacctagtataaacaatgagacaccagggattagatatcagtacaatgtgcttccacagggatggaaaggatcaccagcaatattccagtgtagcatgacaaaaatcttagagccttttagaaaacaaaatccagacatagtcatctatcaatacatggatgatttgtatgtaggatctgacttagaaatagggcagcatagaacaaaaatagaggaactgagacaacatctgttgaggtggggatttaccacaccagacaaaaaacatcagaaagaacctccattcctttggatgggttatgaactccatcctgataaatggacagtacagcctatagtgctgccagaaaaggacagctggactgtcaatgacatacagaaattagtgggaaaattgaattgggcaagtcagatttatgcagggattaaagtaaggcaattatgtaaacttcttaggggaaccaaagcactaacagaagtagtaccactaacagaagaagcagagctagaactggcagaaaacagggagattctaaaagaaccggtacatggagtgtattatgacccatcaaaagacttaatagcagaaatacagaagcaggggcaaggccaatggacatatcaaatttatcaagagccatttaaaaatctgaaaacaggaaagtatgcaagaatgaagggtgcccacactaatgatgtgaaacaattaacagaggcagtacaaaaaatagccacagaaagcatagtaatatggggaaagactcctaaatttaaattacccatacaaaaggaaacatgggaagcatggtggacagagtattggcaagccacctggattcctgagtgggagtttgtcaatacccctcccttagtgaagttatggtaccagttagagaaagaacccataataggagcagaaactttctatgtagatggggcagccaatagggaaactaaattaggaaaagcaggatatgtaactgacagaggaagacaaaaagttgtccccctaacggacacaacaaatcagaagactgagttacaagcaattcatctagctttgcaggattcgggattagaagtaaacatagtgacagactcacaatatgcattgggaatcattcaagcacaaccagataagagtgaatcagagttagtcagtcaaataatagagcagttaataaaaaaggaaaaagtctacctggcatgggtaccagcacacaaaggaattggaggaaatgaacaagtagataaattggtcagtgctggaatcaggaaagtactatttttagatggaatagataaggcccaagaagaacatgagaaatatcacagtaattggagagcaatggctagtgattttaacctaccacctgtagtagcaaaagaaatagtagccagctgtgataaatgtcagctaaaaggggaagccatgcatggacaagtagactgtagcccaggaatatggcagctagattgtacacatttagaaggaaaagttatcttggtagcagttcatgtagccagtggatatatagaagcagaagtaattccagcagagacagggcaagaaacagcatacttcctcttaaaattagcaggaagatggccagtaaaaacagtacatacagacaatggcagcaatttcaccagtactacagttaaggccgcctgttggtgggcggggatcaagcaggaatttggcattccctacaatccccaaagtcaaggagtaatagaatctatgaataaagaattaaagaaaattataggacaggtaagagatcaggctgaacatcttaagacagcagtacaaatggcagtattcatccacaattttaaaagaaaaggggggattggggggtacagtgcaggggaaagaatagtagacataatagcaacagacatacaaactaaagaattacaaaaacaaattacaaaaattcaaaattttcgggtttattacagggacagcagagatccagtttggaaaggac

SEQ ID NO: 16536 - DNA, 13767 bp, synthetic construct
  source 1..13767: mol_type = other DNA
cagcaaagctcctctggaaaggtgaaggggcagtagtaatacaagataatagtgacataaaagtagtgccaagaagaaaagcaaagatcatcagggattatggaaaacagatggcaggtgatgattgtgtggcaagtagacaggatgaggattaacacatggaattccggagcggccgcaggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttccgcggaattcaccccaccagtgcaggctgcctatcagaaagtggtggctggtgtggctaatgccctggcccacaagtatcactaagctcgctttcttgctgtccaatttctattaaaggttcctttgttccctaagtccaactactaaactgggggatattatgaagggccttgagcatctggattctgcctaataaaaaacatttattttcattgcaatgatgtatttaaattatttctgaatattttactaaaaagggaatgtgggaggtcagtgcatttaaaacataaagaaatgaagagctagttcaaaccttgggaaaatacactatatcttaaactccatgaaagaaggtgaggctgcaaacagctaatgcacattggcaacagcccctgatgcctatgccttattcatccctcagaaaaggattcaagtagaggcttgatttggaggttaaagttttgctatgctgtattttacattacttattgttttagctgtcctcatgaatgtcttttcactacccatttgcttatcctgcatctctcagccttgactccactcagttctcttgcttagagataccacctttcccctgaagtgttccttccatgttttacggcgagatggtttctcctcgcctggccactcagccttagttgtctctgttgtcttatagaggtctacttgaagaaggaaaaacagggggcatggtttgactgtcctgtgagcccttcttccctgcctcccccactcacagtgacccggaatccctcgacatggcagtctagcactagtgcggccgcagatctgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgggatcccctgagggggcccccatgggctagaggatccggcctcggcctctgcataaataaaaaaaattagtcagccatgagcttggcccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctcccctcgaagcttacatgtggtaccgagctcggatcctgagaacttcagggtgagtctatgggacccttgatgttttctttccccttcttttctatggttaagttcatgtcataggaaggggagaagtaacagggtacacatattgaccaaatcagggtaattttgcatttgtaattttaaaaaatgctttcttcttttaatatacttttttgtttatcttatttctaatactttccctaatctctttctttcagggcaataatgatacaatgtatcatgcctctttgcaccattctaaagaataacagtgataatttctgggttaaggcaatagcaatatttctgcatataaatatttctgcatataaattgtaactgatgtaagaggtttcatattgctaatagcagctacaatccagctaccattctgcttttattttatggttgggataaggctggattattctgagtccaagctaggcccttttgctaatcatgttcatacctcttatcttcctcccacagctcctgggcaacgtgctggtctgtgtgctggcccatcactttggcaaagcacgtgagatctgaattcgagatctgccgccgccatggacaagaagtacagcatcggcctggacatcggcaccaactctgtgggctgggccgtgatcaccgacgagtacaaggtgcccagcaagaaattcaaggtgctgggcaacaccgaccggcacagcatcaagaagaacctgatcggcgccctgctgttcgacagcggagaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggcaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacatcgatggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgccagcgcccagagcttcatcgagcggatgaccaacttcgataagaacctgcccaacgagaaggtgctgcccaagcacagcctgctgtacgagtacttcaccgtgtacaacgagctgaccaaagtgaaatacgtgaccgagggaatgagaaagcccgccttcctgagcggcgagcagaaaaaagccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggaccatatcgtgcctcagagctttctgaaggacgactccatcgataacaaagtgctgactcggagcgacaagaaccggggcaagagcgacaacgtgccctccgaagaggtcgtgaagaagatgaagaactactggcgccagctgctgaatgccaagctgattacccagaggaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaacgacaaactgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaacaggcgagatcgtgtgggataagggccgggactttgccaccgtgcggaaagtgctgtctatgccccaagtgaatatcgtgaaaaagaccgaggtgcagacaggcggcttcagcaaagagtctatcctgcccaagaggaacagcgacaagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaaacactacctggacgagatcatcgagcagatcagcgagttctccaagagagtgatcctggccgacgctaatctggacaaggtgctgagcgcctacaacaagcacagagacaagcctatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggcgacgccgactataaggaccacgacggagactacaaggatcatgatattgattacaaagacgatgacgataagagcctgggcagcggctcccccaagaaaaaacgcaaggtggaagatcctaagaaaaagcggaaagtgagccagaactatccgattgtgcagtccggactcagatctcgagctcaagcttcgaattctgcagtcgacggtaccgcgggcccgggatccatggactcgggccgggacttcctgaccctgcacggcctacaggatgatgaggatctacaggcgctgctgaagggcagccagctcctgaaggtgaagtccagctcatggaggagagagcgcttctacaagttgcaggaggactgcaagaccatctggcaggagtcccgcaaggtcatgcggaccccggagtcccagctgttctccatcgaggacattcaggaggtgcgaatggggcaccgcacggagggtctggagaagttcgcccgtgatgtgcccgaggaccgctgcttctccattgtcttcaaggaccagcgcaatacactagacctcatcgccccatcgccagctgatgcccagcactgggtgctggggctgcacaagatcatccaccactcaggctccatggaccagcgtcagaagctacagcactggattcactcctgcttgcgaaaagctgacaaaaacaaggacaacaagatgagcttcaaggagctgcagaacttcctgaaggagctcaacatccagcctcgagccgaattcaccctggccatgggtgcgagagcgtcagtattaagcgggggagaattagatcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaaaaaagcacagcaagcagcagctgacacaggacacagcaatcaggtcagccaaaattaccctatagtgcagaacatccaggggcaaatggtacatcaggccatatcacctagaactttaaatgcatgggtaaaagtagtagaagagaaggctttcagcccagaagtgatacccatgttttcagcattatcagaaggagccaccccacaagatttaaacaccatgctaaacacagtggggggacatcaagcagccatgcaaatgttaaaagagaccatcaatgaggaagctgcagaatgggatagagtgcatccagtgcatgcagggcctattgcaccaggccagatgagagaaccaaggggaagtgacatagcaggaactactagtacccttcaggaacaaataggatggatgacacataatccacctatcccagtaggagaaatctataaaagatggataatcctgggattaaataaaatagtaagaatgtatagccctaccagcattctggacataagacaaggaccaaaggaaccctttagagactatgtagaccgattctataaaactctaagagccgagcaagcttcacaagaggtaaaaaattggatgacagaaaccttgttggtccaaaatgcgaacccagattgtaagactattttaaaagcattgggaccaggagcgacactagaagaaatgatgacagcatgtcagggagtggggggacccggccataaagcaagagttttggctgaagcaatgagccaagtaacaaatccagctaccataatgatacagaaaggcaattttaggaaccaaagaaagactgttaagtgtttcaattgtggcaaagaagggcacatagccaaaaattgcagggcccctaggaaaaagggctgttggaaatgtggaaaggaaggacaccaaatgaaagattgtactgagagacaggctaattttttagggaagatctggccttcccacaagggaaggccagggaattttcttcagagcagaccagagccaacagccccaccagaagagagcttcaggtttggggaagagacaacaactccctctcagaagcaggagccgatagacaaggaactgtatcctttagcttccctcagatcactctttggcagcgacccctcgtcacaataaagataggggggcaattaaaggaagctctattagatacaggagcagatgatacagtattagaagaaatgaatttgccaggaagatggaaaccaaaaatgatagggggaattggaggttttatcaaagtaagacagtatgatcagatactcatagaaatctgcggacataaagctataggtacagtattagtaggacctacacctgtcaacataattggaagaaatctgttgactcagattggctgcactttaaattttcccattagtcctattgagactgtaccagtaaaattaaagccaggaatggatggcccaaaagttaaacaatggccattgacagaagaaaaaataaaagcattagtagaaatttgtacagaaatggaaaaggaaggaaaaatttcaaaaattgggcctgaaaatccatacaatactccagtatttgccataaagaaaaaagacagtactaaatggagaaaattagtagatttcagagaacttaataagagaactcaagatttctgggaagttcaattaggaataccacatcctgcagggttaaaacagaaaaaatcagtaacagtactggatgtgggcgatgcatatttttcagttcccttagataaagacttcaggaagtatactgcatttaccatacctagtataaacaatgagacaccagggattagatatcagtacaatgtgcttccacagggatggaaaggatcaccagcaatattccagtgtagcatgacaaaaatcttagagccttttagaaaacaaaatccagacatagtcatctatcaatacatggatgatttgtatgtaggatctgacttagaaatagggcagcatagaacaaaaatagaggaactgagacaacatctgttgaggtggggatttaccacaccagacaaaaaacatcagaaagaacctccattcctttggatgggttatgaactccatcctgataaatggacagtacagcctatagtgctgccagaaaaggacagctggactgtcaatgacatacagaaattagtgggaaaattgaattgggcaagtcagatttatgcagggattaaagtaaggcaattatgtaaacttcttaggggaaccaaagcactaacagaagtagtaccactaacagaagaagcagagctagaactggcagaaaacagggagattctaaaagaaccggtacatggagtgtattatgacccatcaaaagacttaatagcagaaatacagaagcaggggcaaggccaatggacatatcaaatttatcaagagccatttaaaaatctgaaaacaggaaagtatgcaagaatgaagggtgcccacactaatgatgtgaaacaattaacagaggcagtacaaaaaatagccacagaaagcatagtaatatggggaaagactcctaaatttaaattacccatacaaaaggaaacatgggaagcatggtggacagagtattggcaagccacctggattcctgagtgggagtttgtcaatacccctcccttagtgaagttatggtaccagttagagaaagaacccataataggagcagaaactttctatgtagatggggcagccaatagggaaactaaattaggaaaagcaggatatgtaactgacagaggaagacaaaaagttgtccccctaacggacacaacaaatcagaagactgagttacaagcaattcatctagctttgcaggattcgggattagaagtaaacatagtgacagactcacaatatgcattgggaatcattcaagcacaaccagataagagtgaatcagagttagtcagtcaaataatagagcagttaataaaaaaggaaaaagtctacctggcatgggtaccagcacacaaaggaattggaggaaatgaacaagtagataaattggtcagtgctggaatcaggaaagtactatttttagatggaatagataaggcccaagaagaacatgagaaatatcacagtaattggagagcaatggctagtgattttaacctaccacctgtagtagcaaaagaaatagtagccagctgtgataaatgtcagctaaaaggggaagccatgcatggacaagtagactgtagcccaggaatatggcagctagattgtacacatttagaaggaaaagttatcttggtagcagttcatgtagccagtggatatatagaagcagaagtaattccagcagagacagggcaagaaacagcatacttcctcttaaaattagcaggaagatggccagtaaaaacagtacatacagacaatggcagcaatttcaccagtactacagttaaggccgcctgttggtgggcggggatcaagcaggaatttggcattccctacaatccccaaagtcaaggagtaatagaatctatgaataaagaattaaagaaaattataggacaggtaagagatcaggctgaacatcttaagacagcagtacaaatggcagtattcatccacaattttaaaagaaaaggggggattggggggtacagtgcaggggaaagaatagtagacataatagcaacagacatacaaactaaagaattacaaaaacaaattacaaaaattcaaaattttcgggtttattacagggacagcagagatccagtttggaaaggac

SEQ ID NO: 16537 - DNA, 9163 bp, synthetic construct
  source 1..9163: mol_type = other DNA
cccatgggctagaggatccggcctcggcctctgcataaataaaaaaaattagtcagccatgagcttggcccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctcccctcgaagcttacatgtggtaccgagctcggatcctgagaacttcagggtgagtctatgggacccttgatgttttctttccccttcttttctatggttaagttcatgtcataggaaggggagaagtaacagggtacacatattgaccaaatcagggtaattttgcatttgtaattttaaaaaatgctttcttcttttaatatacttttttgtttatcttatttctaatactttccctaatctctttctttcagggcaataatgatacaatgtatcatgcctctttgcaccattctaaagaataacagtgataatttctgggttaaggcaatagcaatatttctgcatataaatatttctgcatataaattgtaactgatgtaagaggtttcatattgctaatagcagctacaatccagctaccattctgcttttattttatggttgggataaggctggattattctgagtccaagctaggcccttttgctaatcatgttcatacctcttatcttcctcccacagctcctgggcaacgtgctggtctgtgtgctggcccatcactttggcaaagcacgtgagatctgaattcgagatctgccgccgccatggaagcaccggaagaccaagggcctcagagggaacctcacaacgagtggacactcgaactgcttgaggagttgaagagggaggccgtgagacattttccacgtccatggctgcacggcctcggacagcacatctacgagacctatggggatacatgggcgggtgtcgaggccatcatacgcatcctccagcagctattatttatccatttcagaattggatgtcagcacagtcggatcgggattatccagcaaaggcgagcccggaatggcgcttcacgcagcgacctgctgacccagataggctgcactctgaacttccccatttcccccattgaaacggacaagaagtacagcatcggcctggacatcggcaccaactctgtgggctgggccgtgatcaccgacgagtacaaggtgcccagcaagaaattcaaggtgctgggcaacaccgaccggcacagcatcaagaagaacctgatcggcgccctgctgttcgacagcggagaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggcaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacatcgatggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgccagcgcccagagcttcatcgagcggatgaccaacttcgataagaacctgcccaacgagaaggtgctgcccaagcacagcctgctgtacgagtacttcaccgtgtacaacgagctgaccaaagtgaaatacgtgaccgagggaatgagaaagcccgccttcctgagcggcgagcagaaaaaagccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggaccatatcgtgcctcagagctttctgaaggacgactccatcgataacaaagtgctgactcggagcgacaagaaccggggcaagagcgacaacgtgccctccgaagaggtcgtgaagaagatgaagaactactggcgccagctgctgaatgccaagctgattacccagaggaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaacgacaaactgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaacaggcgagatcgtgtgggataagggccgggactttgccaccgtgcggaaagtgctgtctatgccccaagtgaatatcgtgaaaaagaccgaggtgcagacaggcggcttcagcaaagagtctatcctgcccaagaggaacagcgacaagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaaacactacctggacgagatcatcgagcagatcagcgagttctccaagagagtgatcctggccgacgctaatctggacaaggtgctgagcgcctacaacaagcacagagacaagcctatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggcgacgccgactataaggaccacgacggagactacaaggatcatgatattgattacaaagacgatgacgataagagcctgggcagcggctcccccaagaaaaaacgcaaggtggaagatcctaagaaaaagcggaaagtgtaacacatggaattccggagcggccgcaggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttccgcggaattcaccccaccagtgcaggctgcctatcagaaagtggtggctggtgtggctaatgccctggcccacaagtatcactaagctcgctttcttgctgtccaatttctattaaaggttcctttgttccctaagtccaactactaaactgggggatattatgaagggccttgagcatctggattctgcctaataaaaaacatttattttcattgcaatgatgtatttaaattatttctgaatattttactaaaaagggaatgtgggaggtcagtgcatttaaaacataaagaaatgaagagctagttcaaaccttgggaaaatacactatatcttaaactccatgaaagaaggtgaggctgcaaacagctaatgcacattggcaacagcccctgatgcctatgccttattcatccctcagaaaaggattcaagtagaggcttgatttggaggttaaagttttgctatgctgtattttacattacttattgttttagctgtcctcatgaatgtcttttcactacccatttgcttatcctgcatctctcagccttgactccactcagttctcttgcttagagataccacctttcccctgaagtgttccttccatgttttacggcgagatggtttctcctcgcctggccactcagccttagttgtctctgttgtcttatagaggtctacttgaagaaggaaaaacagggggcatggtttgactgtcctgtgagcccttcttccctgcctcccccactcacagtgacccggaatccctcgacatggcagtctagcactagtgcggccgcagatctgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgggatcccctgagggggcc

SEQ ID NO: 16538 - DNA, 8941 bp, synthetic construct
  source 1..8941: mol_type = other DNA
cccatgggctagaggatccggcctcggcctctgcataaataaaaaaaattagtcagccatgagcttggcccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctcccctcgaagcttacatgtggtaccgagctcggatcctgagaacttcagggtgagtctatgggacccttgatgttttctttccccttcttttctatggttaagttcatgtcataggaaggggagaagtaacagggtacacatattgaccaaatcagggtaattttgcatttgtaattttaaaaaatgctttcttcttttaatatacttttttgtttatcttatttctaatactttccctaatctctttctttcagggcaataatgatacaatgtatcatgcctctttgcaccattctaaagaataacagtgataatttctgggttaaggcaatagcaatatttctgcatataaatatttctgcatataaattgtaactgatgtaagaggtttcatattgctaatagcagctacaatccagctaccattctgcttttattttatggttgggataaggctggattattctgagtccaagctaggcccttttgctaatcatgttcatacctcttatcttcctcccacagctcctgggcaacgtgctggtctgtgtgctggcccatcactttggcaaagcacgtgagatctgaattcgagatctgccgccgccatggaagcaccggaagaccaagggcctcagagggaacctcacaacgagtggacactcgaactgcttgaggagttgaagagggaggccgtgagacattttccacgtccatggctgcacggcctcggacagcacatctacgagacctatggggatacatgggcgggtgtcgaggccatcatacgcatcctccagcagctattatttatccatttcagaattggatgtcagcacagtcggatcgggattatccagcaaaggcgagcccggaatggcgcttcacgcagcgacctgctgacccagataggctgcactctgaacttccccatttcccccattgaaacgatgactcaatttgagggcttcacgaacctgtatcaagtatccaagacgcttcgtttcgagctgatcccccaaggaaagaccttaaaacacattcaggagcagggtttcatcgaagaggacaaagcccgcaatgatcactacaaagagttaaaaccaattatcgaccgtatctacaagacctacgccgatcagtgtctgcaattagttcaacttgactgggaaaatcttagcgcggccatcgatagttatcgcaaggagaaaacagaggagacacgtaatgcacttatcgaagaacaagccacatatcgcaacgccattcacgactatttcatcggacgcacagacaacctgacagatgcgattaataagcgtcatgcggaaatttataagggacttttcaaggctgaattatttaatggaaaggtgcttaaacaactgggcactgtcactacaacggagcatgaaaatgccttacttcgcagcttcgacaaatttacaacctacttctctgggttctatgagaatcgtaaaaacgtattctctgcagaggacatttcaacagcgatcccgcaccgcatcgtgcaagacaacttcccgaagttcaaggagaattgtcatatctttacacgcttgattactgctgtcccttcgttacgcgagcattttgagaatgtgaagaaggcgattggaatcttcgtttccaccagcatcgaggaggtatttagttttccgttttacaaccaattgctgactcaaacgcagatcgacctttataatcaactgcttggcggcatctcccgtgaggctggaacagaaaaaattaaaggtcttaatgaagttttaaacttggcgattcagaaaaatgacgaaacggcacatattatcgcaagtcttccacatcgtttcatcccgttatttaaacaaattttatccgatcgtaacacgctttcgttcattttggaggagttcaagtcggatgaagaagtaatccaatccttttgtaaatacaagacgcttcttcgtaatgagaatgttctggagactgcagaggcccttttcaacgagctgaactcgatcgatttgacacacatctttatcagccataagaagctggagacaatttcttccgccctgtgcgaccattgggacacgttacgcaacgcgctttatgagcgccgtatctcggagttgaccggcaaaattactaagtctgccaaagagaaggttcagcgttcccttaagcacgaggatatcaacttacaagaaattatctcagctgccggcaaggaactgtcggaggcgttcaagcaaaaaacaagcgaaatcctttctcatgcacacgcagcgttagaccagcccttgcctaccacgttaaaaaaacaagaggagaaagagatccttaagagccaactggattctctgctgggtttatatcatcttttagactggttcgccgtggatgaaagtaatgaggtcgacccagaattctccgcacgtcttactggaatcaaactggagatggagccaagcctttccttttacaataaagcacgtaattacgcgactaaaaagccgtactcagtggaaaaatttaagttaaactttcaaatgccaactttggcatccggatgggacgtcaacaaagagaagaataatggagccatcctttttgtgaaaaatggtttatattatttgggcattatgcctaaacagaaaggtcgctacaaagcgctttccttcgaacctaccgaaaagacttcggaaggttttgataaaatgtactatgattactttccagatgcggcgaagatgatccccaaatgctcgactcaattgaaagcagttacagcgcacttccagacacatactacccccattttgttgagcaataatttcattgaacctctggagattacaaaggaaatttacgacttgaataatcccgagaaggaaccaaagaagttccaaactgcctacgcaaaaaagaccggagaccagaaagggtatcgcgaggcactgtgcaaatggattgacttcacacgcgacttcttgtcaaaatacactaagacgacgtcaatcgatttaagctccctgcgtcctagtagccaatataaggacttaggagaatactacgctgagcttaatccacttttgtatcacattagtttccaacgtatcgcggagaaggagatcatggacgcggttgaaacaggaaagctttacctgtttcagatctacaataaggacttcgcgaaagggcaccatgggaaaccgaacctgcatacgctgtattggacggggttgttcagtccagaaaatttggccaagacctctatcaaacttaatggtcaagctgagttattctaccgccccaagtcgcgtatgaaacgcatggcacatcgtctgggggaaaagatgcttaacaagaaattgaaagatcagaaaacaccgattccagataccctttaccaggagctttacgactatgttaatcatcgcttgtcacacgacttatccgacgaggcgcgcgcccttttaccaaacgtcatcacaaaggaagtctcgcacgagatcattaaagatcgccgttttacttcagataagttcttctttcacgtgcccattacattgaactatcaggcggctaatagtccttctaaattcaaccaacgcgtcaatgcttacttgaaagaacaccctgaaacccctattattggcatcgaccgcggtgaacgcaatttaatctatattacggtaatcgattctacgggcaagattcttgaacaacgtagtttgaacacaatccagcaattcgattatcagaaaaaacttgataatcgcgagaaggagcgcgtagcggctcgccaggcatggagtgtagttggtactatcaaggacctgaagcagggatacttatcgcaagtaatccacgagatcgtagatttaatgattcattaccaggcagtagtcgtcttggaaaaccttaatttcggtttcaagagtaaacgcaccgggattgcagagaaggcggtctaccagcaattcgagaagatgcttattgataaacttaattgcctggtgctgaaggattatcctgcagaaaaagtgggcggtgttctgaacccctaccaactgactgatcaattcacctctttcgccaagatgggcacgcagtccgggttcttgttctacgtacctgcgccgtatacgtctaaaatcgacccgttaacaggcttcgttgacccttttgtctggaagacaatcaaaaaccacgagtcacgcaaacattttcttgagggatttgatttcttacattatgacgtcaagacgggcgatttcattctgcattttaaaatgaaccgcaacctttctttccagcgcggtttgccaggtttcatgcccgcgtgggacattgtttttgagaaaaacgagacccaattcgacgcgaagggtacaccctttattgcgggtaagcgtattgttccggtgattgaaaaccaccgttttactggacgttaccgcgacctgtatcccgcaaatgaactgattgcactgttagaagaaaagggcattgtatttcgcgacggaagcaatatccttcccaaattgttggaaaacgatgactctcatgcaattgatacaatggtggctttaattcgttcggtcctgcagatgcgtaacagtaacgctgcgactggcgaggattacatcaatagtcccgttcgcgatttaaacggagtctgtttcgactcccgtttccagaatccggagtggcccatggacgcagatgctaatggggcctatcacattgcactgaagggccagttgttacttaatcaccttaaggagtccaaggaccttaagctgcaaaacggtatctccaatcaagattggttagcctatattcaagagcttcgtaataaacgtccggcagcgactaagaaggcggggcaagctaagaagaaaaaggggtcgggtcctgctgccaagagggtcaagttggacggcagtggttaacacatggaattccggagcggccgcaggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttccgcggaattcaccccaccagtgcaggctgcctatcagaaagtggtggctggtgtggctaatgccctggcccacaagtatcactaagctcgctttcttgctgtccaatttctattaaaggttcctttgttccctaagtccaactactaaactgggggatattatgaagggccttgagcatctggattctgcctaataaaaaacatttattttcattgcaatgatgtatttaaattatttctgaatattttactaaaaagggaatgtgggaggtcagtgcatttaaaacataaagaaatgaagagctagttcaaaccttgggaaaatacactatatcttaaactccatgaaagaaggtgaggctgcaaacagctaatgcacattggcaacagcccctgatgcctatgccttattcatccctcagaaaaggattcaagtagaggcttgatttggaggttaaagttttgctatgctgtattttacattacttattgttttagctgtcctcatgaatgtcttttcactacccatttgcttatcctgcatctctcagccttgactccactcagttctcttgcttagagataccacctttcccctgaagtgttccttccatgttttacggcgagatggtttctcctcgcctggccactcagccttagttgtctctgttgtcttatagaggtctacttgaagaaggaaaaacagggggcatggtttgactgtcctgtgagcccttcttccctgcctcccccactcacagtgacccggaatccctcgacatggcagtctagcactagtgcggccgcagatctgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgggatcccctgagggggcc

SEQ ID NO: 16539 - DNA, 8920 bp, synthetic construct
  source 1..8920: mol_type = other DNA
cccatgggctagaggatccggcctcggcctctgcataaataaaaaaaattagtcagccatgagcttggcccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctcccctcgaagcttacatgtggtaccgagctcggatcctgagaacttcagggtgagtctatgggacccttgatgttttctttccccttcttttctatggttaagttcatgtcataggaaggggagaagtaacagggtacacatattgaccaaatcagggtaattttgcatttgtaattttaaaaaatgctttcttcttttaatatacttttttgtttatcttatttctaatactttccctaatctctttctttcagggcaataatgatacaatgtatcatgcctctttgcaccattctaaagaataacagtgataatttctgggttaaggcaatagcaatatttctgcatataaatatttctgcatataaattgtaactgatgtaagaggtttcatattgctaatagcagctacaatccagctaccattctgcttttattttatggttgggataaggctggattattctgagtccaagctaggcccttttgctaatcatgttcatacctcttatcttcctcccacagctcctgggcaacgtgctggtctgtgtgctggcccatcactttggcaaagcacgtgagatctgaattcgagatctgccgccgccatggaagcaccggaagaccaagggcctcagagggaacctcacaacgagtggacactcgaactgcttgaggagttgaagagggaggccgtgagacattttccacgtccatggctgcacggcctcggacagcacatctacgagacctatggggatacatgggcgggtgtcgaggccatcatacgcatcctccagcagctattatttatccatttcagaattggatgtcagcacagtcggatcgggattatccagcaaaggcgagcccggaatggcgcttcacgcagcgacctgctgacccagataggctgcactctgaacttccccatttcccccattgaaacgatgaactttcagccgtttttccagaaatttgttcatctgtatccgattagcaaaaccctgcgttttgaactgattccgcagggtgcaacccagaaatttattagcgaaaaacaggttctgctgcaggatgaaattcgtgcacgtaaatatccggaaatgaaacaggcaattgatggttatcataaagattttattcagcgtgcactgagcaatattgatagccaggtttttgaacaggcactgaatacctttgaagatctgtttctgcgtagccaggcagaacgtgcaaccgatgcatataagaaagatttcgaaaccgcacagaccaaactgcgtgaactgattgttcatagctttgaaaaaggtgaatttaagcaggaatataagagcctgtttgataaaaatctgattaccaatctgctgaaaccgtgggttgaacagcagaatcagattggtgatagcaactatacctatcatgaagattttaacaaatttaccacctattttctgggttttcatgaaaatcgcaagaatatttatagcaaagatccgcataaaaccgcactggcatatcgtctgattcatgaaaatttaccgaagttcctggaaaataacaagattctgctgaaaattcaaaatgatcatccgagcctgtgggaacagctgcagaccctgaatcagaccatgccgcagctgtttgatggttgggattttagccagctgatgcaggttagcttttttagcaataccctgacccagaccggtattgatcagtataataccattattggtggtattagcgaaggtgaaaatcgtcagaaaattcagggtattaatgagctgattaacctgtataatcagaaacaggataaaaaaaatcgtgttgcaaaactgaagcagctgtataaacagattctgagcgatcgtagcaccctgagctttctgccggaaaaatttgttgatgataccgaactgtatcatgcaattaatatgttttacctggaacatctgcatcatcagagcatgattaatggtcatagctataccctgctggaacgtgttcagctgctgattaatgaactggcaaattatgatctgagcaaagtttatctggcaccgaatcagctgagcaccgttagccatcagatgtttggtgattttggttatatcggtcgtgccctgaattattattatatgcaggttattcagccggattatgaacagctgctggcaagcgcaaaaaccaccaaaaaaattgaagcaaccgaaaagctgaaaacaattttcctggataccccgcagagcctggttgttattcaggcagcaattgatgaatatattcagctgcagccgagcaccaaaccgcatacccagctgaccgattttattattagcctgctgaaacagtatgaaaccgttgcagatgatcagagcattaaagttattaatgtttttagcgatattgagggtaagtatagctgtatcaaaggtctggttaataccaaaagcgaaagcaaacgtgaagttttacaggatgaaaaactggcaaccgatattaaggccttcatggatgcagtgaataatgttattaaactgctgaagccgtttagcctgaatgaaaagctggttgcaagcgttgaaaaagatgcacgtttttatagcgattttgaagaaatttatcagtctctgctgatttttgttccgctgtataataaagttcgtaattatattacccagaaaccgtatagcaccgaaaaatttaaactgaatttcaataagccgaccctgctgagcggttgggatgcaaataaagaagcagataatctgagcattctgctgcgtaaaaatggtaattattacctggcaattatggataccgcaaaaggtgcaaacaaagcatttgaaccgaagaccttaaatcagctgaaagttgatgatacaaccgattgttatgaaaagatggtttataaactgctgtcaggtccgagcaaaatgtttccgaaagcatttaaagcaaaaaataacgagggtaattattatccgaccccggaactgctgaccagctataataataacgaacacctgaaaaatgataaaaactttaccctggcaagcctgcatgcatatattgattggtgtaaagagtatattaatcgtaacccgagctggcatcagtttaattttaaatttagcccgacccagagctttcaggatattagccagttttatagcgaagttagcagccagagctataaagttcattttcagaccattccgagcgattatattgatcagctggttgcagaaggtaaactgtatctgtttcagatttataataaagatttcagcccgaatgcaaaaggtaaggaaaatctgcataccctgtattttaaagcactgtttagcgatgaaaatttaaaacagccggtttttaaactgagcggtgaagcagaaatgttttatcgtccggcaagcttacagctggcaaataccaccattcataaagcaggtgaaccgatggcagcaaaaaatccgctgaccccgaatgcaacccgtaccctggcatatgatattattaaagatcgtcgttttaccaccgataaatatctgctgcatgttccgattagcctgaattttcatgcacaggaaagcatgagcattaagaaacataatgatctggttcgtcagatgattaaacataatcatcaggatctgcatgttattggtattgatcgtggtgaaaaacatctgctgtatgttagcgttattgatctgaaaggtaatattgtttaccaggaaagcctgaatagcattaagagcgaagcacagaattttgaaaccccgtatcatcagctgctgcagcatcgtgaagaaggtcgtgcacaggcacgtaccgcatggggtaaaatcgaaaatattaaagaactgaaagatggttacctgagccaggttgttcatcgtattcagcagctgattctgaaatacaatgcaattgttatgctggaagacctgaattttggttttaaacgtggtcgttttaaaatcgagaaacagatttatcagaaatttgaaaaggccctgattcataaactgaattatgttgttgataaaagcacccaggcagatgaactgggtggtgttcgtaaagcatatcagctgaccgcaccgtttgaaagctttgaaaagctgggtaaacagagcggtgttctgttttatgttccggcatggaataccagcaaaattgatccggttaccggttttgttgatctgttaaaaccgaaatatgaaaatctggataaagcacaggcattttttaatgcatttgacagcattcattacaatgcacagaaaaactactttgagttcaaagtgaatctgaaacaatttgcaggtctgaaagcacaggccgcacaggcagaatggaccatttgtagctatggtgatgaacgtcatgtttatcagaaaaaaaatgcacagcagggtgaaaccgttattgttaacgtgaccgaagaattaaaagttctgtttgcaaaaaataatattgaagttgcccagagcgttgaactgaaagaaaccatttgtacccagacccaggttgatttttttaaacgtctgatgtggctgctgcaggttctgttagcactgcgttatagcagcagcaaagataaactggattatattctgagcccggttgcaaatgcacagggtgaattttttgatagccgtcatgcaagcgttcagctgccgcaggatagcgatgcaaatggtgcatatcatattgcactgaaaggtctgtgggttattgaacagctgaaagcagcagataatttagataaggttaaactggcaattagcaatgatgattggctgcattttgcacagcagaaaccttatctggcaaaacgtccggcagcgactaagaaggcggggcaagctaagaagaaaaaggggtcgggtcctgctgccaagagggtcaagttggacggcagtggttaacacatggaattccggagcggccgcaggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttccgcggaattcaccccaccagtgcaggctgcctatcagaaagtggtggctggtgtggctaatgccctggcccacaagtatcactaagctcgctttcttgctgtccaatttctattaaaggttcctttgttccctaagtccaactactaaactgggggatattatgaagggccttgagcatctggattctgcctaataaaaaacatttattttcattgcaatgatgtatttaaattatttctgaatattttactaaaaagggaatgtgggaggtcagtgcatttaaaacataaagaaatgaagagctagttcaaaccttgggaaaatacactatatcttaaactccatgaaagaaggtgaggctgcaaacagctaatgcacattggcaacagcccctgatgcctatgccttattcatccctcagaaaaggattcaagtagaggcttgatttggaggttaaagttttgctatgctgtattttacattacttattgttttagctgtcctcatgaatgtcttttcactacccatttgcttatcctgcatctctcagccttgactccactcagttctcttgcttagagataccacctttcccctgaagtgttccttccatgttttacggcgagatggtttctcctcgcctggccactcagccttagttgtctctgttgtcttatagaggtctacttgaagaaggaaaaacagggggcatggtttgactgtcctgtgagcccttcttccctgcctcccccactcacagtgacccggaatccctcgacatggcagtctagcactagtgcggccgcagatctgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgggatcccctgagggggcc

SEQ ID NO: 16540 - DNA, 9742 bp, synthetic construct
  source 1..9742: mol_type = other DNA
cccatgggctagaggatccggcctcggcctctgcataaataaaaaaaattagtcagccatgagcttggcccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctcccctcgaagcttacatgtggtaccgagctcggatcctgagaacttcagggtgagtctatgggacccttgatgttttctttccccttcttttctatggttaagttcatgtcataggaaggggagaagtaacagggtacacatattgaccaaatcagggtaattttgcatttgtaattttaaaaaatgctttcttcttttaatatacttttttgtttatcttatttctaatactttccctaatctctttctttcagggcaataatgatacaatgtatcatgcctctttgcaccattctaaagaataacagtgataatttctgggttaaggcaatagcaatatttctgcatataaatatttctgcatataaattgtaactgatgtaagaggtttcatattgctaatagcagctacaatccagctaccattctgcttttattttatggttgggataaggctggattattctgagtccaagctaggcccttttgctaatcatgttcatacctcttatcttcctcccacagctcctgggcaacgtgctggtctgtgtgctggcccatcactttggcaaagcacgtgagatctgaattcgagatctgccgccgccatggaagcaccggaagaccaagggcctcagagggaacctcacaacgagtggacactcgaactgcttgaggagttgaagagggaggccgtgagacattttccacgtccatggctgcacggcctcggacagcacatctacgagacctatggggatacatgggcgggtgtcgaggccatcatacgcatcctccagcagctattatttatccatttcagaattggatgtcagcacagtcggatcgggattatccagcaaaggcgagcccggaatggcgcttcacgcagcgacctgctgacccagataggctgcactctgaacttccccatttcccccattgaaacgatgaaacggacagccgacggaagcgagttcgagtcaccaaagaagaagcggaaagtctctgaggtggagttttcccacgagtactggatgagacatgccctgaccctggccaagagggcacgggatgagagggaggtgcctgtgggagccgtgctggtgctgaacaatagagtgatcggcgagggctggaacagagccatcggcctgcacgacccaacagcccatgccgaaattatggccctgagacagggcggcctggtcatgcagaactacagactgattgacgccaccctgtacgtgacattcgagccttgcgtgatgtgcgccggcgccatgatccactctaggatcggccgcgtggtgtttggcgtgaggaactcaaaaagaggcgccgcaggctccctgatgaacgtgctgaactaccccggcatgaatcaccgcgtcgaaattaccgagggaatcctggcagatgaatgtgccgccctgctgtgcgatttctatcggatgcctagacaggtgttcaatgctcagaagaaggcccagagctccatcaactccggaggatctagcggaggctcctctggctctgagacacctggcacaagcgagagcgcaacacctgaaagcagcgggggcagcagcggggggtcagacaagaagtacagcatcggcctggccatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggaaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggaccatatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggtgactctggcggctcaaaaagaaccgccgacggcagcgaattcgagcccaagaagaagaggaaagtctaacacatggaattccggagcggccgcaggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttccgcggaattcaccccaccagtgcaggctgcctatcagaaagtggtggctggtgtggctaatgccctggcccacaagtatcactaagctcgctttcttgctgtccaatttctattaaaggttcctttgttccctaagtccaactactaaactgggggatattatgaagggccttgagcatctggattctgcctaataaaaaacatttattttcattgcaatgatgtatttaaattatttctgaatattttactaaaaagggaatgtgggaggtcagtgcatttaaaacataaagaaatgaagagctagttcaaaccttgggaaaatacactatatcttaaactccatgaaagaaggtgaggctgcaaacagctaatgcacattggcaacagcccctgatgcctatgccttattcatccctcagaaaaggattcaagtagaggcttgatttggaggttaaagttttgctatgctgtattttacattacttattgttttagctgtcctcatgaatgtcttttcactacccatttgcttatcctgcatctctcagccttgactccactcagttctcttgcttagagataccacctttcccctgaagtgttccttccatgttttacggcgagatggtttctcctcgcctggccactcagccttagttgtctctgttgtcttatagaggtctacttgaagaaggaaaaacagggggcatggtttgactgtcctgtgagcccttcttccctgcctcccccactcacagtgacccggaatccctcgacatggcagtctagcactagtgcggccgcagatctgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgggatcccctgagggggcc

SEQ ID NO: 16541 - DNA, 10483 bp, synthetic construct
  source 1..10483: mol_type = other DNA
cccatgggctagaggatccggcctcggcctctgcataaataaaaaaaattagtcagccatgagcttggcccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctcccctcgaagcttacatgtggtaccgagctcggatcctgagaacttcagggtgagtctatgggacccttgatgttttctttccccttcttttctatggttaagttcatgtcataggaaggggagaagtaacagggtacacatattgaccaaatcagggtaattttgcatttgtaattttaaaaaatgctttcttcttttaatatacttttttgtttatcttatttctaatactttccctaatctctttctttcagggcaataatgatacaatgtatcatgcctctttgcaccattctaaagaataacagtgataatttctgggttaaggcaatagcaatatttctgcatataaatatttctgcatataaattgtaactgatgtaagaggtttcatattgctaatagcagctacaatccagctaccattctgcttttattttatggttgggataaggctggattattctgagtccaagctaggcccttttgctaatcatgttcatacctcttatcttcctcccacagctcctgggcaacgtgctggtctgtgtgctggcccatcactttggcaaagcacgtgagatctgaattcgagatctgccgccgccatggaagcaccggaagaccaagggcctcagagggaacctcacaacgagtggacactcgaactgcttgaggagttgaagagggaggccgtgagacattttccacgtccatggctgcacggcctcggacagcacatctacgagacctatggggatacatgggcgggtgtcgaggccatcatacgcatcctccagcagctattatttatccatttcagaattggatgtcagcacagtcggatcgggattatccagcaaaggcgagcccggaatggcgcttcacgcagcgacctgctgacccagataggctgcactctgaacttccccatttcccccattgaaacgaaacggacagccgacggaagcgagttcgagtcaccaaagaagaagcggaaagtctcctcagagactgggcctgtcgccgtcgatccaaccctgcgccgccggattgaacctcacgagtttgaagtgttctttgacccccgggagctgagaaaggagacatgcctgctgtacgagatcaactggggaggcaggcactccatctggaggcacacctctcagaacacaaataagcacgtggaggtgaacttcatcgagaagtttaccacagagcggtacttctgccccaataccagatgtagcatcacatggtttctgagctggtccccttgcggagagtgtagcagggccatcaccgagttcctgtccagatatccacacgtgacactgtttatctacatcgccaggctgtatcaccacgcagacccaaggaataggcagggcctgcgcgatctgatcagctccggcgtgaccatccagatcatgacagagcaggagtccggctactgctggcggaacttcgtgaattattctcctagcaacgaggcccactggcctaggtacccacacctgtgggtgcgcctgtacgtgctggagctgtattgcatcatcctgggcctgcccccttgtctgaatatcctgcggagaaagcagccccagctgaccttctttacaatcgccctgcagtcttgtcactatcagaggctgccaccccacatcctgtgggccacaggcctgaagtctggaggatctagcggaggatcctctggcagcgagacaccaggaacaagcgagtcagcaacaccagagagcagtggcggcagcagcggcggcagcgacaagaagtacagcatcggcctggccatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggaaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggaccatatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggtgacagcggcgggagcggcgggagcggggggagcactaatctgagcgacatcattgagaaggagactgggaaacagctggtcattcaggagtccatcctgatgctgcctgaggaggtggaggaagtgatcggcaacaagccagagtctgacatcctggtgcacaccgcctacgacgagtccacagatgagaatgtgatgctgctgacctctgacgcccccgagtataagccttgggccctggtcatccaggattctaacggcgagaataagatcaagatgctgagcggaggatccggaggatctggaggcagcaccaacctgtctgacatcatcgagaaggagacaggcaagcagctggtcatccaggagagcatcctgatgctgcccgaagaagtcgaagaagtgatcggaaacaagcctgagagcgatatcctggtccataccgcctacgacgagagtaccgacgaaaatgtgatgctgctgacatccgacgccccagagtataagccctgggctctggtcatccaggattccaacggagagaacaaaatcaaaatgctgtctggcggctcaaaaagaaccgccgacggcagcgaattcgagcccaagaagaagaggaaagtctaacacatggaattccggagcggccgcaggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttccgcggaattcaccccaccagtgcaggctgcctatcagaaagtggtggctggtgtggctaatgccctggcccacaagtatcactaagctcgctttcttgctgtccaatttctattaaaggttcctttgttccctaagtccaactactaaactgggggatattatgaagggccttgagcatctggattctgcctaataaaaaacatttattttcattgcaatgatgtatttaaattatttctgaatattttactaaaaagggaatgtgggaggtcagtgcatttaaaacataaagaaatgaagagctagttcaaaccttgggaaaatacactatatcttaaactccatgaaagaaggtgaggctgcaaacagctaatgcacattggcaacagcccctgatgcctatgccttattcatccctcagaaaaggattcaagtagaggcttgatttggaggttaaagttttgctatgctgtattttacattacttattgttttagctgtcctcatgaatgtcttttcactacccatttgcttatcctgcatctctcagccttgactccactcagttctcttgcttagagataccacctttcccctgaagtgttccttccatgttttacggcgagatggtttctcctcgcctggccactcagccttagttgtctctgttgtcttatagaggtctacttgaagaaggaaaaacagggggcatggtttgactgtcctgtgagcccttcttccctgcctcccccactcacagtgacccggaatccctcgacatggcagtctagcactagtgcggccgcagatctgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgggatcccctgagggggcc

SEQ ID NO: 16542 - DNA, 7975 bp, synthetic construct
  source 1..7975: mol_type = other DNA
cccatgggctagaggatccggcctcggcctctgcataaataaaaaaaattagtcagccatgagcttggcccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctcccctcgaagcttacatgtggtaccgagctcggatcctgagaacttcagggtgagtctatgggacccttgatgttttctttccccttcttttctatggttaagttcatgtcataggaaggggagaagtaacagggtacacatattgaccaaatcagggtaattttgcatttgtaattttaaaaaatgctttcttcttttaatatacttttttgtttatcttatttctaatactttccctaatctctttctttcagggcaataatgatacaatgtatcatgcctctttgcaccattctaaagaataacagtgataatttctgggttaaggcaatagcaatatttctgcatataaatatttctgcatataaattgtaactgatgtaagaggtttcatattgctaatagcagctacaatccagctaccattctgcttttattttatggttgggataaggctggattattctgagtccaagctaggcccttttgctaatcatgttcatacctcttatcttcctcccacagctcctgggcaacgtgctggtctgtgtgctggcccatcactttggcaaagcacgtgagatctgaattcgagatctgccgccgccatggaagcaccggaagaccaagggcctcagagggaacctcacaacgagtggacactcgaactgcttgaggagttgaagagggaggccgtgagacattttccacgtccatggctgcacggcctcggacagcacatctacgagacctatggggatacatgggcgggtgtcgaggccatcatacgcatcctccagcagctattatttatccatttcagaattggatgtcagcacagtcggatcgggattatccagcaaaggcgagcccggaatggcgcttcacgcagcgacctgctgacccagataggctgcactctgaacttccccatttcccccattgaaacgatggccccaaagaagaagcggaaggtcagcatgcaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcccgctcctaagaacatcgaccagagaaagctgatccccgtgaaggacggcaacgagagactgacctctagcggctttgcctgcagccagtgttgccagcctctgtacgtgtacaagctggaacaagtgaacgacaagggcaagccccacaccaactacttcggcagatgcaacgtgtccgagcacgagaggctgatcctgctgtctcctcacaagcccgaggccaacgatgagctggtcacatacagcctgggcaagttcggacagagagccctggacttctacagcatccacgtgaccagggagagcaatcaccctgtgaagcccctggaacagatcggcggcaatagctgtgcctctggacctgtgggaaaagccctgagcgacgcctgtatgggagccgtggcatccttcctgaccaagtaccaggacatcatcctggaacaccagaaagtgatcaagaagaacgagaaaagactggccaacctcaaggatatcgccagcgctaacggcctggcctttcctaagatcaccctgcctccacagcctcacaccaaagagggcatcgaggcctacaacaacgtggtggcccagatcgtgatttgggtcaacctgaatctgtggcagaagctgaagatcggcagggacgaagccaagccactgcagagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgctgccttacctgagcagcgaagaggaccggaagaagggcaagaagttcgccagataccagttcggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcatcgaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccgccaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgcccagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgactagtccaaaaaagaagagaaaggtagattacaaagatgacgatgacaaagactacaaggatgatgatgataagggatccggctaacacatggaattccggagcggccgcaggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttccgcggaattcaccccaccagtgcaggctgcctatcagaaagtggtggctggtgtggctaatgccctggcccacaagtatcactaagctcgctttcttgctgtccaatttctattaaaggttcctttgttccctaagtccaactactaaactgggggatattatgaagggccttgagcatctggattctgcctaataaaaaacatttattttcattgcaatgatgtatttaaattatttctgaatattttactaaaaagggaatgtgggaggtcagtgcatttaaaacataaagaaatgaagagctagttcaaaccttgggaaaatacactatatcttaaactccatgaaagaaggtgaggctgcaaacagctaatgcacattggcaacagcccctgatgcctatgccttattcatccctcagaaaaggattcaagtagaggcttgatttggaggttaaagttttgctatgctgtattttacattacttattgttttagctgtcctcatgaatgtcttttcactacccatttgcttatcctgcatctctcagccttgactccactcagttctcttgcttagagataccacctttcccctgaagtgttccttccatgttttacggcgagatggtttctcctcgcctggccactcagccttagttgtctctgttgtcttatagaggtctacttgaagaaggaaaaacagggggcatggtttgactgtcctgtgagcccttcttccctgcctcccccactcacagtgacccggaatccctcgacatggcagtctagcactagtgcggccgcagatctgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgggatcccctgagggggcc

SEQ ID NO: 16543 - DNA, 11278 bp, synthetic construct
  source 1..11278: mol_type = other DNA
cccatgggctagaggatccggcctcggcctctgcataaataaaaaaaattagtcagccatgagcttggcccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctcccctcgaagcttacatgtggtaccgagctcggatcctgagaacttcagggtgagtctatgggacccttgatgttttctttccccttcttttctatggttaagttcatgtcataggaaggggagaagtaacagggtacacatattgaccaaatcagggtaattttgcatttgtaattttaaaaaatgctttcttcttttaatatacttttttgtttatcttatttctaatactttccctaatctctttctttcagggcaataatgatacaatgtatcatgcctctttgcaccattctaaagaataacagtgataatttctgggttaaggcaatagcaatatttctgcatataaatatttctgcatataaattgtaactgatgtaagaggtttcatattgctaatagcagctacaatccagctaccattctgcttttattttatggttgggataaggctggattattctgagtccaagctaggcccttttgctaatcatgttcatacctcttatcttcctcccacagctcctgggcaacgtgctggtctgtgtgctggcccatcactttggcaaagcacgtgagatctgaattcgagatctgccgccgccatggaagcaccggaagaccaagggcctcagagggaacctcacaacgagtggacactcgaactgcttgaggagttgaagagggaggccgtgagacattttccacgtccatggctgcacggcctcggacagcacatctacgagacctatggggatacatgggcgggtgtcgaggccatcatacgcatcctccagcagctattatttatccatttcagaattggatgtcagcacagtcggatcgggattatccagcaaaggcgagcccggaatggcgcttcacgcagcgacctgctgacccagataggctgcactctgaacttccccatttcccccattgaaacgatgaaacggacagccgacggaagcgagttcgagtcaccaaagaagaagcggaaagtcgacaagaagtacagcatcggcctggacatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggaaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggacgctatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggtgactctggaggatctagcggaggatcctctggcagcgagacaccaggaacaagcgagtcagcaacaccagagagcagtggcggcagcagcggcggcagcagcaccctaaatatagaagatgagtatcggctacatgagacctcaaaagagccagatgtttctctagggtccacatggctgtctgattttcctcaggcctgggcggaaaccgggggcatgggactggcagttcgccaagctcctctgatcatacctctgaaagcaacctctacccccgtgtccataaaacaataccccatgtcacaagaagccagactggggatcaagccccacatacagagactgttggaccagggaatactggtaccctgccagtccccctggaacacgcccctgctacccgttaagaaaccagggactaatgattataggcctgtccaggatctgagagaagtcaacaagcgggtggaagacatccaccccaccgtgcccaacccttacaacctcttgagcgggctcccaccgtcccaccagtggtacactgtgcttgatttaaaggatgcctttttctgcctgagactccaccccaccagtcagcctctcttcgcctttgagtggagagatccagagatgggaatctcaggacaattgacctggaccagactcccacagggtttcaaaaacagtcccaccctgtttaatgaggcactgcacagagacctagcagacttccggatccagcacccagacttgatcctgctacagtacgtggatgacttactgctggccgccacttctgagctagactgccaacaaggtactcgggccctgttacaaaccctagggaacctcgggtatcgggcctcggccaagaaagcccaaatttgccagaaacaggtcaagtatctggggtatcttctaaaagagggtcagagatggctgactgaggccagaaaagagactgtgatggggcagcctactccgaagacccctcgacaactaagggagttcctagggaaggcaggcttctgtcgcctcttcatccctgggtttgcagaaatggcagcccccctgtaccctctcaccaaaccggggactctgtttaattggggcccagaccaacaaaaggcctatcaagaaatcaagcaagctcttctaactgccccagccctggggttgccagatttgactaagccctttgaactctttgtcgacgagaagcagggctacgccaaaggtgtcctaacgcaaaaactgggaccttggcgtcggccggtggcctacctgtccaaaaagctagacccagtagcagctgggtggcccccttgcctacggatggtagcagccattgccgtactgacaaaggatgcaggcaagctaaccatgggacagccactagtcattctggccccccatgcagtagaggcactagtcaaacaaccccccgaccgctggctttccaacgcccggatgactcactatcaggccttgcttttggacacggaccgggtccagttcggaccggtggtagccctgaacccggctacgctgctcccactgcctgaggaagggctgcaacacaactgccttgatatcctggccgaagcccacggaacccgacccgacctaacggaccagccgctcccagacgccgaccacacctggtacacggatggaagcagtctcttacaagagggacagcgtaaggcgggagctgcggtgaccaccgagaccgaggtaatctgggctaaagccctgccagccgggacatccgctcagcgggctgaactgatagcactcacccaggccctaaagatggcagaaggtaagaagctaaatgtttatactgatagccgttatgcttttgctactgcccatatccatggagaaatatacagaaggcgtgggtggctcacatcagaaggcaaagagatcaaaaataaagacgagatcttggccctactaaaagccctctttctgcccaaaagacttagcataatccattgtccaggacatcaaaagggacacagcgccgaggctagaggcaaccggatggctgaccaagcggcccgaaaggcagccatcacagagactccagacacctctaccctcctcatagaaaattcatcaccctctggcggctcaaaaagaaccgccgacggcagcgaattcgagcccaagaagaagaggaaagtctaacacatggaattccggagcggccgcaggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttccgcggaattcaccccaccagtgcaggctgcctatcagaaagtggtggctggtgtggctaatgccctggcccacaagtatcactaagctcgctttcttgctgtccaatttctattaaaggttcctttgttccctaagtccaactactaaactgggggatattatgaagggccttgagcatctggattctgcctaataaaaaacatttattttcattgcaatgatgtatttaaattatttctgaatattttactaaaaagggaatgtgggaggtcagtgcatttaaaacataaagaaatgaagagctagttcaaaccttgggaaaatacactatatcttaaactccatgaaagaaggtgaggctgcaaacagctaatgcacattggcaacagcccctgatgcctatgccttattcatccctcagaaaaggattcaagtagaggcttgatttggaggttaaagttttgctatgctgtattttacattacttattgttttagctgtcctcatgaatgtcttttcactacccatttgcttatcctgcatctctcagccttgactccactcagttctcttgcttagagataccacctttcccctgaagtgttccttccatgttttacggcgagatggtttctcctcgcctggccactcagccttagttgtctctgttgtcttatagaggtctacttgaagaaggaaaaacagggggcatggtttgactgtcctgtgagcccttcttccctgcctcccccactcacagtgacccggaatccctcgacatggcagtctagcactagtgcggccgcagatctgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgggatcccctgagggggcc

SEQ ID NO: 16544 - DNA, 9142 bp, synthetic construct
  source 1..9142: mol_type = other DNA
cccatgggctagaggatccggcctcggcctctgcataaataaaaaaaattagtcagccatgagcttggcccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctcccctcgaagcttacatgtggtaccgagctcggatcctgagaacttcagggtgagtctatgggacccttgatgttttctttccccttcttttctatggttaagttcatgtcataggaaggggagaagtaacagggtacacatattgaccaaatcagggtaattttgcatttgtaattttaaaaaatgctttcttcttttaatatacttttttgtttatcttatttctaatactttccctaatctctttctttcagggcaataatgatacaatgtatcatgcctctttgcaccattctaaagaataacagtgataatttctgggttaaggcaatagcaatatttctgcatataaatatttctgcatataaattgtaactgatgtaagaggtttcatattgctaatagcagctacaatccagctaccattctgcttttattttatggttgggataaggctggattattctgagtccaagctaggcccttttgctaatcatgttcatacctcttatcttcctcccacagctcctgggcaacgtgctggtctgtgtgctggcccatcactttggcaaagcacgtgagatctgaattcgagatctgccgccgccatggaagcaccggaagaccaagggcctcagagggaacctcacaacgagtggacactcgaactgcttgaggagttgaagagggaggccgtgagacattttccacgtccatggctgcacggcctcggacagcacatctacgagacctatggggatacatgggcgggtgtcgaggccatcatacgcatcctccagcagctattatttatccatttcagaattggatgtcagcacagtcggatcgggattatccagcaaaggcgagcccggaatggcgcttcacgcagcgacctgctgacccagataggctgcactctgaacttccccatttcccccattgaaacgatggccccaaagaagaagcggaaggtcggtatccacggagtcccagcagccgacaagaagtacagcatcggcctggccatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggaaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggaccatatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggcgacaaaaggccggcggccacgaaaaaggccggccaggcaaaaaagaaaaaggaattcggcagtggataacacatggaattccggagcggccgcaggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttccgcggaattcaccccaccagtgcaggctgcctatcagaaagtggtggctggtgtggctaatgccctggcccacaagtatcactaagctcgctttcttgctgtccaatttctattaaaggttcctttgttccctaagtccaactactaaactgggggatattatgaagggccttgagcatctggattctgcctaataaaaaacatttattttcattgcaatgatgtatttaaattatttctgaatattttactaaaaagggaatgtgggaggtcagtgcatttaaaacataaagaaatgaagagctagttcaaaccttgggaaaatacactatatcttaaactccatgaaagaaggtgaggctgcaaacagctaatgcacattggcaacagcccctgatgcctatgccttattcatccctcagaaaaggattcaagtagaggcttgatttggaggttaaagttttgctatgctgtattttacattacttattgttttagctgtcctcatgaatgtcttttcactacccatttgcttatcctgcatctctcagccttgactccactcagttctcttgcttagagataccacctttcccctgaagtgttccttccatgttttacggcgagatggtttctcctcgcctggccactcagccttagttgtctctgttgtcttatagaggtctacttgaagaaggaaaaacagggggcatggtttgactgtcctgtgagcccttcttccctgcctcccccactcacagtgacccggaatccctcgacatggcagtctagcactagtgcggccgcagatctgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgggatcccctgagggggcc

SEQ ID NO: 16545 - DNA, 10738 bp, synthetic construct
  source 1..10738: mol_type = other DNA
cccatgggctagaggatccggcctcggcctctgcataaataaaaaaaattagtcagccatgagcttggcccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctcccctcgaagcttacatgtggtaccgagctcggatcctgagaacttcagggtgagtctatgggacccttgatgttttctttccccttcttttctatggttaagttcatgtcataggaaggggagaagtaacagggtacacatattgaccaaatcagggtaattttgcatttgtaattttaaaaaatgctttcttcttttaatatacttttttgtttatcttatttctaatactttccctaatctctttctttcagggcaataatgatacaatgtatcatgcctctttgcaccattctaaagaataacagtgataatttctgggttaaggcaatagcaatatttctgcatataaatatttctgcatataaattgtaactgatgtaagaggtttcatattgctaatagcagctacaatccagctaccattctgcttttattttatggttgggataaggctggattattctgagtccaagctaggcccttttgctaatcatgttcatacctcttatcttcctcccacagctcctgggcaacgtgctggtctgtgtgctggcccatcactttggcaaagcacgtgagatctgaattcgagatctgccgccgccatggaagcaccggaagaccaagggcctcagagggaacctcacaacgagtggacactcgaactgcttgaggagttgaagagggaggccgtgagacattttccacgtccatggctgcacggcctcggacagcacatctacgagacctatggggatacatgggcgggtgtcgaggccatcatacgcatcctccagcagctattatttatccatttcagaattggatgtcagcacagtcggatcgggattatccagcaaaggcgagcccggaatggcgcttcacgcagcgacctgctgacccagataggctgcactctgaacttccccatttcccccattgaaacgatggacaagaagtactccattgggctcgctatcggcacaaacagcgtcggctgggccgtcattacggacgagtacaaggtgccgagcaaaaaattcaaagttctgggcaataccgatcgccacagcataaagaagaacctcattggcgccctcctgttcgactccggggagacggccgaagccacgcggctcaaaagaacagcacggcgcagatatacccgcagaaagaatcggatctgctacctgcaggagatctttagtaatgagatggctaaggtggatgactctttcttccataggctggaggagtcctttttggtggaggaggataaaaagcacgagcgccacccaatctttggcaatatcgtggacgaggtggcgtaccatgaaaagtacccaaccatatatcatctgaggaagaagcttgtagacagtactgataaggctgacttgcggttgatctatctcgcgctggcgcatatgatcaaatttcggggacacttcctcatcgagggggacctgaacccagacaacagcgatgtcgacaaactctttatccaactggttcagacttacaatcagcttttcgaagagaacccgatcaacgcatccggagttgacgccaaagcaatcctgagcgctaggctgtccaaatcccggcggctcgaaaacctcatcgcacagctccctggggagaagaagaacggcctgtttggtaatcttatcgccctgtcactcgggctgacccccaactttaaatctaacttcgacctggccgaagatgccaagcttcaactgagcaaagacacctacgatgatgatctcgacaatctgctggcccagatcggcgaccagtacgcagacctttttttggcggcaaagaacctgtcagacgccattctgctgagtgatattctgcgagtgaacacggagatcaccaaagctccgctgagcgctagtatgatcaagcgctatgatgagcaccaccaagacttgactttgctgaaggcccttgtcagacagcaactgcctgagaagtacaaggaaattttcttcgatcagtctaaaaatggctacgccggatacattgacggcggagcaagccaggaggaattttacaaatttattaagcccatcttggaaaaaatggacggcaccgaggagctgctggtaaagcttaacagagaagatctgttgcgcaaacagcgcactttcgacaatggaagcatcccccaccagattcacctgggcgaactgcacgctatcctcaggcggcaagaggatttctacccctttttgaaagataacagggaaaagattgagaaaatcctcacatttcggataccctactatgtaggccccctcgcccggggaaattccagattcgcgtggatgactcgcaaatcagaagagaccatcactccctggaacttcgaggaagtcgtggataagggggcctctgcccagtccttcatcgaaaggatgactaactttgataaaaatctgcctaacgaaaaggtgcttcctaaacactctctgctgtacgagtacttcacagtttataacgagctcaccaaggtcaaatacgtcacagaagggatgagaaagccagcattcctgtctggagagcagaagaaagctatcgtggacctcctcttcaagacgaaccggaaagttaccgtgaaacagctcaaagaagactatttcaaaaagattgaatgtttcgactctgttgaaatcagcggagtggaggatcgcttcaacgcatccctgggaacgtatcacgatctcctgaaaatcattaaagacaaggacttcctggacaatgaggagaacgaggacattcttgaggacattgtcctcacccttacgttgtttgaagatagggagatgattgaagaacgcttgaaaacttacgctcatctcttcgacgacaaagtcatgaaacagctcaagaggcgccgatatacaggatgggggcggctgtcaagaaaactgatcaatgggatccgagacaagcagagtggaaagacaatcctggattttcttaagtccgatggatttgccaaccggaacttcatgcagttgatccatgatgactctctcacctttaaggaggacatccagaaagcacaagtttctggccagggggacagtcttcacgagcacatcgctaatcttgcaggtagcccagctatcaaaaagggaatactgcagaccgttaaggtcgtggatgaactcgtcaaagtaatgggaaggcataagcccgagaatatcgttatcgagatggcccgagagaaccaaactacccagaagggacagaagaacagtagggaaaggatgaagaggattgaagagggtataaaagaactggggtcccaaatccttaaggaacacccagttgaaaacacccagcttcagaatgagaagctctacctgtactacctgcagaacggcagggacatgtacgtggatcaggaactggacatcaatcggctctccgactacgacgtggctgctatcgtgccccagtcttttctcaaagatgattctattgataataaagtgttgacaagatccgataaagctagagggaagagtgataacgtcccctcagaagaagttgtcaagaaaatgaaaaattattggcggcagctgctgaacgccaaactgatcacacaacggaagttcgataatctgactaaggctgaacgaggtggcctgtctgagttggataaagccggcttcatcaaaaggcagcttgttgagacacgccagatcaccaagcacgtggcccaaattctcgattcacgcatgaacaccaagtacgatgaaaatgacaaactgattcgagaggtgaaagttattactctgaagtctaagctggtctcagatttcagaaaggactttcagttttataaggtgagagagatcaacaattaccaccatgcgcatgatgcctacctgaatgcagtggtaggcactgcacttatcaaaaaatatcccaagcttgaatctgaatttgtttacggagactataaagtgtacgatgttaggaaaatgatcgcaaagtctgagcaggaaataggcaaggccaccgctaagtacttcttttacagcaatattatgaattttttcaagaccgagattacactggccaatggagagattcggaagcgaccacttatcgaaacaaacggagaaacaggagaaatcgtgtgggacaagggtagggatttcgcgacagtccggaaggtcctgtccatgccgcaggtgaacatcgttaaaaagaccgaagtacagaccggaggcttctccaaggaaagtatcctcccgaaaaggaacagcgacaagctgatcgcacgcaaaaaagattgggaccccaagaaatacggcggattcgattctcctacagtcgcttacagtgtactggttgtggccaaagtggagaaagggaagtctaaaaaactcaaaagcgtcaaggaactgctgggcatcacaatcatggagcgatcaagcttcgaaaaaaaccccatcgactttctcgaggcgaaaggatataaagaggtcaaaaaagacctcatcattaagcttcccaagtactctctctttgagcttgaaaacggccggaaacgaatgctcgctagtgcgggcgagctgcagaaaggtaacgagctggcactgccctctaaatacgttaatttcttgtatctggccagccactatgaaaagctcaaagggtctcccgaagataatgagcagaagcagctgttcgtggaacaacacaaacactaccttgatgagatcatcgagcaaataagcgaattctccaaaagagtgatcctcgccgacgctaacctcgataaggtgctttctgcttacaataagcacagggataagcccatcagggagcaggcagaaaacattatccacttgtttactctgaccaacttgggcgcgcctgcagccttcaagtacttcgacaccaccatagacagaaagcggtacacctctacaaaggaggtcctggacgccacactgattcatcagtcaattacggggctctatgaaacaagaatcgacctctctcagctcggtggagacagcagggctgaccccaagaagaagaggaaggtgtcgccagggatccgtcgacttgacgcgttgatatcaacaagtttgtacaaaaaagcaggctacaaagaggccagcggttccggacgggctgacgcattggacgattttgatctggatatgctgggaagtgacgccctcgatgattttgaccttgacatgcttggttcggatgcccttgatgactttgacctcgacatgctcggcagtgacgcccttgatgatttcgacctggacatgctgattaactctagaagttccggatctccgaaaaagaaacgcaaagttggtagccagtacctgcccgacaccgacgaccggcaccggatcgaggaaaagcggaagcggacctacgagacattcaagagcatcatgaagaagtcccccttcagcggccccaccgaccctagacctccacctagaagaatcgccgtgcccagcagatccagcgccagcgtgccaaaacctgccccccagccttaccccttcaccagcagcctgagcaccatcaactacgacgagttccctaccatggtgttccccagcggccagatctctcaggcctctgctctggctccagcccctcctcaggtgctgcctcaggctcctgctcctgcaccagctccagccatggtgtctgcactggctcaggcaccagcacccgtgcctgtgctggctcctggacctccacaggctgtggctccaccagcccctaaacctacacaggccggcgagggcacactgtctgaagctctgctgcagctgcagttcgacgacgaggatctgggagccctgctgggaaacagcaccgatcctgccgtgttcaccgacctggccagcgtggacaacagcgagttccagcagctgctgaaccagggcatccctgtggcccctcacaccaccgagcccatgctgatggaataccccgaggccatcacccggctcgtgacaggcgctcagaggcctcctgatccagctcctgcccctctgggagcaccaggcctgcctaatggactgctgtctggcgacgaggacttcagctctatcgccgatatggatttctcagccttgctgggctctggcagcggcagccgggattccagggaagggatgtttttgccgaagcctgaggccggctccgctattagtgacgtgtttgagggccgcgaggtgtgccagccaaaacgaatccggccatttcatcctccaggaagtccatgggccaaccgcccactccccgccagcctcgcaccaacaccaaccggtccagtacatgagccagtcgggtcactgaccccggcaccagtccctcagccactggatccagcgcccgcagtgactcccgaggccagtcacctgttggaggatcccgatgaagagacgagccaggctgtcaaagcccttcgggagatggccgatactgtgattccccagaaggaagaggctgcaatctgtggccaaatggacctttcccatccgcccccaaggggccatctggatgagctgacaaccacacttgagtccatgaccgaggatctgaacctggactcacccctgaccccggaattgaacgagattctggataccttcctgaacgacgagtgcctcttgcatgccatgcatatcagcacaggactgtccatcttcgacacatctctgtttggatccggcagcggctaacacatggaattccggagcggccgcaggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttccgcggaattcaccccaccagtgcaggctgcctatcagaaagtggtggctggtgtggctaatgccctggcccacaagtatcactaagctcgctttcttgctgtccaatttctattaaaggttcctttgttccctaagtccaactactaaactgggggatattatgaagggccttgagcatctggattctgcctaataaaaaacatttattttcattgcaatgatgtatttaaattatttctgaatattttactaaaaagggaatgtgggaggtcagtgcatttaaaacataaagaaatgaagagctagttcaaaccttgggaaaatacactatatcttaaactccatgaaagaaggtgaggctgcaaacagctaatgcacattggcaacagcccctgatgcctatgccttattcatccctcagaaaaggattcaagtagaggcttgatttggaggttaaagttttgctatgctgtattttacattacttattgttttagctgtcctcatgaatgtcttttcactacccatttgcttatcctgcatctctcagccttgactccactcagttctcttgcttagagataccacctttcccctgaagtgttccttccatgttttacggcgagatggtttctcctcgcctggccactcagccttagttgtctctgttgtcttatagaggtctacttgaagaaggaaaaacagggggcatggtttgactgtcctgtgagcccttcttccctgcctcccccactcacagtgacccggaatccctcgacatggcagtctagcactagtgcggccgcagatctgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgggatcccctgagggggcc

SEQ ID NO: 16546 - DNA, 9403 bp, synthetic construct
  source 1..9403: mol_type = other DNA
cccatgggctagaggatccggcctcggcctctgcataaataaaaaaaattagtcagccatgagcttggcccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctcccctcgaagcttacatgtggtaccgagctcggatcctgagaacttcagggtgagtctatgggacccttgatgttttctttccccttcttttctatggttaagttcatgtcataggaaggggagaagtaacagggtacacatattgaccaaatcagggtaattttgcatttgtaattttaaaaaatgctttcttcttttaatatacttttttgtttatcttatttctaatactttccctaatctctttctttcagggcaataatgatacaatgtatcatgcctctttgcaccattctaaagaataacagtgataatttctgggttaaggcaatagcaatatttctgcatataaatatttctgcatataaattgtaactgatgtaagaggtttcatattgctaatagcagctacaatccagctaccattctgcttttattttatggttgggataaggctggattattctgagtccaagctaggcccttttgctaatcatgttcatacctcttatcttcctcccacagctcctgggcaacgtgctggtctgtgtgctggcccatcactttggcaaagcacgtgagatctgaattcgagatctgccgccgccatggaagcaccggaagaccaagggcctcagagggaacctcacaacgagtggacactcgaactgcttgaggagttgaagagggaggccgtgagacattttccacgtccatggctgcacggcctcggacagcacatctacgagacctatggggatacatgggcgggtgtcgaggccatcatacgcatcctccagcagctattatttatccatttcagaattggatgtcagcacagtcggatcgggattatccagcaaaggcgagcccggaatggcgcttcacgcagcgacctgctgacccagataggctgcactctgaacttccccatttcccccattgaaacgatggatgctaagtcactaactgcctggtcccggacactggtgaccttcaaggatgtatttgtggacttcaccagggaggagtggaagctgctggacactgctcagcagatcgtgtacagaaatgtgatgctggagaactataagaacctggtttccttgggttatcagcttactaagccagatgtgatcctccggttggagaagggagaagagcccggcggttccggcggagggtcgatggacaagaagtacagcatcggcctggccatcggcaccaactctgtgggctgggccgtgatcaccgacgagtacaaggtgcccagcaagaaattcaaggtgctgggcaacaccgaccggcacagcatcaagaagaacctgatcggcgccctgctgttcgacagcggagaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggcaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacatcgatggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgccagcgcccagagcttcatcgagcggatgaccaacttcgataagaacctgcccaacgagaaggtgctgcccaagcacagcctgctgtacgagtacttcaccgtgtacaacgagctgaccaaagtgaaatacgtgaccgagggaatgagaaagcccgccttcctgagcggcgagcagaaaaaagccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggacgctatcgtgcctcagagctttctgaaggacgactccatcgataacaaagtgctgactcggagcgacaagaaccggggcaagagcgacaacgtgccctccgaagaggtcgtgaagaagatgaagaactactggcgccagctgctgaatgccaagctgattacccagaggaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaacgacaaactgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaacaggcgagatcgtgtgggataagggccgggactttgccaccgtgcggaaagtgctgtctatgccccaagtgaatatcgtgaaaaagaccgaggtgcagacaggcggcttcagcaaagagtctatcctgcccaagaggaacagcgacaagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaaacactacctggacgagatcatcgagcagatcagcgagttctccaagagagtgatcctggccgacgctaatctggacaaggtgctgagcgcctacaacaagcacagagacaagcctatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggcgacgcctatccctatgacgtgcccgattatgccagcctgggcagcggctcccccaagaaaaaacgcaaggtggaagatcctaagaaaaagcggaaagtggacggcattggtagtgggagcaacggcagcagcggatcctaacacatggaattccggagcggccgcaggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttccgcggaattcaccccaccagtgcaggctgcctatcagaaagtggtggctggtgtggctaatgccctggcccacaagtatcactaagctcgctttcttgctgtccaatttctattaaaggttcctttgttccctaagtccaactactaaactgggggatattatgaagggccttgagcatctggattctgcctaataaaaaacatttattttcattgcaatgatgtatttaaattatttctgaatattttactaaaaagggaatgtgggaggtcagtgcatttaaaacataaagaaatgaagagctagttcaaaccttgggaaaatacactatatcttaaactccatgaaagaaggtgaggctgcaaacagctaatgcacattggcaacagcccctgatgcctatgccttattcatccctcagaaaaggattcaagtagaggcttgatttggaggttaaagttttgctatgctgtattttacattacttattgttttagctgtcctcatgaatgtcttttcactacccatttgcttatcctgcatctctcagccttgactccactcagttctcttgcttagagataccacctttcccctgaagtgttccttccatgttttacggcgagatggtttctcctcgcctggccactcagccttagttgtctctgttgtcttatagaggtctacttgaagaaggaaaaacagggggcatggtttgactgtcctgtgagcccttcttccctgcctcccccactcacagtgacccggaatccctcgacatggcagtctagcactagtgcggccgcagatctgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgggatcccctgagggggcc

SEQ ID NO: 16547 - protein, 495 aa, unidentified
KFTIVFPHNQKGNWKNVPSNYHYCPSSSDLNWHNDLIGTAIQVKMPKSHKAIQADGWMCHASKWVTTCDFRWYGPKYITQSIRSFTPSVEQCKESIEQTKQGTWLNPGFPPQSCGYATVTDAEAVIVQVTPHHVLVDEYTGEWVDSQFINGKCSNYICPTVHNSTTWHSDYKVKGLCDSNLISMDITFFSEDGELSSLGKEGTGFRSNYFAYETGGKACKMQYCKHWGVRLPSGVWFEMADKDLFAAARFPECPEGSSISAPSQTSVDVSLIQDVERILDYSLCQETWSKIRAGLPISPVDLSYLAPKNPGTGPAFTIINGTLKYFETRYIRVDIAAPILSRMVGMISGTTTERELWDDWAPYEDVEIGPNGVLRTSSGYKFPLYMIGHGMLDSDLHLSSKAQVFEHPHIQDAASQLPDDESLFFGDTGLSKNPIELVEGWFSSWKSSIASFFFIIGLIIGLFLVLRVGIHLCIKLKHTKKRQIYTDIEMNRLGK

SEQ ID NO: 16548 - protein, 6 aa, synthetic construct
GAPGAS

SEQ ID NO: 16549 - protein, 5 aa, synthetic construct
GGGGS

SEQ ID NO: 16550 - protein, 20 aa, synthetic construct
METDTLLLWVLLLWVPGSTG

SEQ ID NO: 16551 - protein, 20 aa, synthetic construct
MSRSVALAVLALLSLSGLEA

SEQ ID NO: 16552 - protein, 19 aa, synthetic construct
AVGQDTQEVIVVPHSLPFK

SEQ ID NO: 16553 - protein, 49 aa, synthetic construct
ASAKPTTTPAPRPPTPAPTIASQPLSLRPEAARPAAGGAVHTRGLDFAK

SEQ ID NO: 16554 - protein, 17 aa, synthetic construct
GAPGSGGGGSGGGGSAS

SEQ ID NO: 16555 - protein, 33 aa, synthetic construct
ASESKYGPPCPPCPAVGQDTQEVIVVPHSLPFK

SEQ ID NO: 16556 - protein, 39 aa, synthetic construct
ASGGGGSGELAAIKQELAAIKKELAAIKWELAAIKQGAG

SEQ ID NO: 16557 - protein, 14 aa, synthetic construct
ASESKYGPPCPPCP

SEQ ID NO: 16558 - protein, 25 aa, synthetic construct
IASFFFIIGLIIGLFLVLRVGIHLC
